US007919608B2

(12) United States Patent
Abad et al.

(10) Patent No.: US 7,919,608 B2
(45) Date of Patent: Apr. 5, 2011

(54) NUCLEIC ACID MOLECULES AND OTHER MOLECULES ASSOCIATED WITH PLANTS

(75) Inventors: Mark S. Abad, Webster Groves, MO (US); Scott E. Andersen, St. Louis, MO (US); Patrice Dubois, Richmond Heights, MO (US); Debbie A. Mahadeo, St. Louis, MO (US); James D. Masucci, Ballwin, MO (US)

(73) Assignee: Monsanto Technology LLC, St. Louis, MO (US)

( * ) Notice: Subject to any disclaimer, the term of this patent is extended or adjusted under 35 U.S.C. 154(b) by 28 days.

(21) Appl. No.: 12/502,096

(22) Filed: Jul. 13, 2009

(65) Prior Publication Data

US 2009/0293158 A1 Nov. 26, 2009

Related U.S. Application Data

(63) Continuation of application No. 11/330,364, filed on Jan. 12, 2006, now Pat. No. 7,572,902, which is a continuation of application No. 09/696,664, filed on Oct. 25, 2000, now abandoned, which is a continuation-in-part of application No. 09/553,094, filed on Apr. 18, 2000, now abandoned, which is a continuation-in-part of application No. 09/237,183, filed on Jan. 26, 1999, now Pat. No. 7,598,361, which is a continuation-in-part of application No. 09/198,779, filed on Nov. 24, 1998, now abandoned, said application No. 09/237,183 is a continuation-in-part of application No. 09/227,586, filed on Jan. 8, 1999, now abandoned, said application No. 09/237,183 is a continuation-in-part of application No. 09/229,413, filed on Jan. 12, 1999, now abandoned, said application No. 09/237,183 is a continuation-in-part of application No. 09/233,218, filed on Jan. 20, 1999, now abandoned, said application No. 09/696,664 is a continuation-in-part of application No. 09/371,146, filed on Aug. 9, 1999, now abandoned, which is a continuation-in-part of application No. 09/304,517, filed on May 6, 1999, now abandoned, said application No. 09/696,664 is a continuation-in-part of application No. 09/565,306, filed on May 4, 2000, now abandoned, said application No. 09/371,146 is a continuation-in-part of application No. 09/244,000, filed on Feb. 8, 1999, now abandoned, said application No. 09/371,146 is a continuation-in-part of application No. 09/252,974, filed on Feb. 19, 1999, now abandoned, said application No. 09/237,183 is a continuation-in-part of application No. 09/227,586, filed on Jan. 8, 1999, now abandoned, said application No. 09/252,974, said application No. 09/371,146 is a continuation-in-part of application No. 09/262,979, filed on Mar. 4, 1999, now abandoned, said application No. 09/371,146 is a continuation-in-part of application No. 09/267,199, filed on Mar. 12, 1999, now abandoned, said application No. 09/371,146 is a continuation-in-part of application No. 09/300,482, filed on Apr. 28, 1999, now Pat. No. 7,655,770, said application No. 09/371,146 is a continuation-in-part of application No. 09/333,535, filed on Jun. 14, 1999, now abandoned, which is a continuation-in-part of application No. 09/263,191, filed on Mar. 5, 1999, now abandoned, and a continuation-in-part of application No. 09/283,466, filed on Apr. 2, 1999, now abandoned, and a continuation-in-part of application No. 09/210,297, filed on Dec. 8, 1998, now abandoned, and a continuation-in-part of application No. 09/206,040, filed on Dec. 4, 1998, now abandoned, said application No. 09/333,535 is a continuation-in-part of application No. 09/306,349, filed on May 10, 1999, now abandoned, said application No. 09/210,297, said application No. 09/333,535 is a continuation-in-part of application No. 09/199,129, filed on Nov. 24, 1998, now abandoned, said application No. 09/371,146 is a continuation-in-part of application No. 09/304,517, filed on May 6, 1999, now abandoned, said application No. 09/237,183 is a continuation-in-part of application No. 09/227,586, filed on Jan. 8, 1999, now abandoned, said application No. 09/300,482 is a continuation-in-part of application No. 09/267,199, filed on Mar. 12, 1999, now abandoned, and a continuation-in-part of application No. 09/198,779, filed on Nov. 24, 1998, now abandoned.

(Continued)

(51) Int. Cl.
*C07H 21/04* (2006.01)

(52) U.S. Cl. ..................................................... 536/23.6

(58) Field of Classification Search ........................ None
See application file for complete search history.

(56) References Cited

U.S. PATENT DOCUMENTS 4,784,949 A 11/1988 Gelfand et al.

(Continued)

FOREIGN PATENT DOCUMENTS

WO WO 00/18922 4/2000

OTHER PUBLICATIONS

Gencore N_Geneseq database run Dec. 22, 2009 see result 4.*

(Continued)

*Primary Examiner* — Wendy C. Haas

(74) *Attorney, Agent, or Firm* — Matthew Madsen; Ying-Horng Liu; Arnold & Porter LLP

(57) ABSTRACT

Expressed Sequence Tags (ESTs) isolated from maize are disclosed. The ESTs provide a unique molecular tool for the targeting and isolation of novel genes for plant protection and improvement. The disclosed ESTs have utility in the development of new strategies for understanding critical plant developmental and metabolic pathways. The disclosed ESTs

17 Claims, No Drawings

Related U.S. Application Data

(60) Provisional application No. 60/067,000, filed on Nov. 24, 1997, provisional application No. 60/066,873, filed on Nov. 25, 1997, provisional application No. 60/069,472, filed on Dec. 9, 1997, provisional application No. 60/074,201, filed on Feb. 10, 1998, provisional application No. 60/074,282, filed on Feb. 10, 1998, provisional application No. 60/074,280, filed on Feb. 10, 1998, provisional application No. 60/074,281, filed on Feb. 10, 1998, provisional application No. 60/074,565, filed on Feb. 12, 1998, provisional application No. 60/074,566, filed on Feb. 12, 1998, provisional application No. 60/074,567, filed on Feb. 12, 1998, provisional application No. 60/075,462, filed on Feb. 19, 1998, provisional application No. 60/074,789, filed on Feb. 19, 1998, provisional application No. 60/075,459, filed on Feb. 19, 1998, provisional application No. 60/075,461, filed on Feb. 19, 1998, provisional application No. 60/075,464, filed on Feb. 19, 1998, provisional application No. 60/075,460, filed on Feb. 19, 1998, provisional application No. 60/075,463, filed on Feb. 19, 1998, provisional application No. 60/077,231, filed on Mar. 9, 1998, provisional application No. 60/077,229, filed on Mar. 9, 1998, provisional application No. 60/077,230, filed on Mar. 9, 1998, provisional application No. 60/078,031, filed on Mar. 16, 1998, provisional application No. 60/078,368, filed on Mar. 18, 1998, provisional application No. 60/080,844, filed on Apr. 7, 1998, provisional application No. 60/083,067, filed on Apr. 27, 1998, provisional application No. 60/083,387, filed on Apr. 29, 1998, provisional application No. 60/083,388, filed on Apr. 29, 1998, provisional application No. 60/083,389, filed on Apr. 29, 1998, provisional application No. 60/085,245, filed on May 13, 1998, provisional application No. 60/085,224, filed on May 13, 1998, provisional application No. 60/085,223, filed on May 13, 1998, provisional application No. 60/085,222, filed on May 13, 1998, provisional application No. 60/086,186, filed on May 21, 1998, provisional application No. 60/086,339, filed on May 21, 1998, provisional application No. 60/086,187, filed on May 21, 1998, provisional application No. 60/086,185, filed on May 21, 1998, provisional application No. 60/086,184, filed on May 21, 1998, provisional application No. 60/086,183, filed on May 21, 1998, provisional application No. 60/086,188, filed on May 21, 1998, provisional application No. 60/089,524, filed on Jun. 16, 1998, provisional application No. 60/089,810, filed on Jun. 18, 1998, provisional application No. 60/089,814, filed on Jun. 18, 1998, provisional application No. 60/092,036, filed on Jul. 8, 1998, provisional application No. 60/099,667, filed on Sep. 9, 1998, provisional application No. 60/099,668, filed on Sep. 9, 1998, provisional application No. 60/099,670, filed on Sep. 9, 1998, provisional application No. 60/099,697, filed on Sep. 9, 1998, provisional application No. 60/100,674, filed on Sep. 16, 1998, provisional application No. 60/100,673, filed on Sep. 16, 1998, provisional application No. 60/100,672, filed on Sep. 16, 1998, provisional application No. 60/101,132, filed on Sep. 21, 1998, provisional application No. 60/101,130, filed on Sep. 21, 1998, provisional application No. 60/101,347, filed on Sep. 22, 1998, provisional application No. 60/101,343, filed on Sep. 22, 1998, provisional application No. 60/104,124, filed on Oct. 13, 1998, provisional application No. 60/104,126, filed on Oct. 13, 1998, provisional application No. 60/104,127, filed on Oct. 13, 1998, provisional application No. 60/104,128, filed on Oct. 13, 1998, provisional application No. 60/083,386, filed on Apr. 29, 1998, provisional application No. 60/084,684, filed on May 8, 1998, provisional application No. 60/091,247, filed on Jun. 30, 1998, provisional application No. 60/101,508, filed on Sep. 22, 1998, provisional application No. 60/108,996, filed on Nov. 18, 1998, provisional application No. 60/101,344, filed on Sep. 22, 1998, provisional application No. 60/109,018, filed on Nov. 19, 1998, provisional application No. 60/071,064, filed on Jan. 9, 1998, provisional application No. 60/090,170, filed on Jun. 22, 1998, provisional application No. 60/104,121, filed on Oct. 13, 1998, provisional application No. 60/071,479, filed on Jan. 13, 1998, provisional application No. 60/085,533, filed on May 15, 1998, provisional application No. 60/089,808, filed on Jun. 18, 1998, provisional application No. 60/089,812, filed on Jun. 18, 1998, provisional application No. 60/089,807, filed on Jun. 18, 1998, provisional application No. 60/089,806, filed on Jun. 18, 1998, provisional application No. 60/089,813, filed on Jun. 18, 1998, provisional application No. 60/089,811, filed on Jun. 18, 1998, provisional application No. 60/089,793, filed on Jun. 18, 1998, provisional application No. 60/091,405, filed on Jun. 30, 1998, provisional application No. 60/111,742, filed on Dec. 10, 1998, provisional application No. 60/111,033, filed on Dec. 4, 1998, provisional application No. 60/110,109, filed on Nov. 25, 1998, provisional application No. 60/110,108, filed on Nov. 25, 1998, provisional application No. 60/100,963, filed on Sep. 17, 1998, provisional application No. 60/091,035, filed on Jun. 29, 1998, provisional application No. 60/090,928, filed on Jun. 26, 1998, provisional application No. 60/090,856, filed on Jun. 26, 1998, provisional application No. 60/089,789, filed on Jun. 18, 1998, provisional application No. 60/089,627, filed on Jun. 16, 1998, provisional application No. 60/088,441, filed on Jun. 8, 1998, provisional application No. 60/087,972, filed on Jun. 4, 1998, provisional application No. 60/087,762, filed on Jun. 2, 1998, provisional application No. 60/087,631, filed on Jun. 2, 1998, provisional application No. 60/087,422, filed on Jun. 1, 1998, provisional application No. 60/086,608, filed on May 22, 1998, provisional application No. 60/086,594, filed on May 22, 1998, provisional application No. 60/085,940, filed on May 19, 1998, provisional application No. 60/085,429, filed on May 14, 1998, provisional application No. 60/085,057, filed on May 12, 1998, provisional application No. 60/083,390, filed on Apr. 29, 1998, provisional application No. 60/076,912, filed on Mar. 6, 1998, provisional application No. 60/076,709, filed on Jun. 9, 1998, provisional application No. 60/072,888, filed on Jan. 27, 1998, provisional application No. 60/072,027, filed on Jan. 21, 1998, provisional application No. 60/069,472, filed on Dec. 9, 1997, provisional application No. 60/101,347, filed on Sep. 22, 1998, provisional application No. 60/078,031, filed on Mar. 16, 1998. have particular utility in isolating genes and promoters, identifying and mapping the genes involved in developmental and metabolic pathways, and determining gene function. Sequence homology analyses using the ESTs provided in the present invention, will result in more efficient gene screening for desirable agronomic traits. An expanding database of these select pieces of the plant genomics puzzle will quickly expand the knowledge necessary for subsequent functional validation, a key limitation in current plant biotechnology efforts.

(56) References Cited

U.S. PATENT DOCUMENTS

| | | | | |
|---|---|---|---|---|
| 4,956,282 | A | 9/1990 | Goodman et al. | |
| 5,011,912 | A | 4/1991 | Hopp et al. | |
| 6,093,545 | A | 7/2000 | Goodearl et al. | |
| 7,569,389 | B2 * | 8/2009 | Feldmann et al. | 435/468 |
| 7,572,902 | B2 * | 8/2009 | Abad et al. | 536/23.6 |
| 2006/0236419 | A1 * | 10/2006 | La Rosa et al. | 800/278 |
| 2007/0039067 | A1 * | 2/2007 | Feldmann et al. | 800/278 |
| 2008/0276335 | A1 * | 11/2008 | Abad et al. | 800/312 |

OTHER PUBLICATIONS

GenCore GenEmbl database, run on Dec. 22, 2009 see result 1.*
GenCore EST database, run on Dec. 22, 2009 see result 5.*
GenCore Issued Patents Databse run on Dec. 22, 2009 see results 2, 3, and 4.*
Bai et al "Functions of OsBZR1 and 14-3-3- proteins in brassinosteriod signaling in rice." PNAS Voil. 104 No. 34, pp. 13839-13844 Aug. 21, 2007.*
Yao et al. "molecular Analysis and Expression Patterns of the 14-3-3 Gene Family from *Oryza sativa*" Jouranl of Biochemisty and molecular biology v9ol. 40 No. 3, pp. 349-357 May 2007.*
U.S. Appl. No. 09/815,254, filed Mar. 23, 2001, Boukharov et al.
U.S. Appl. No. 10/425,114, filed Mar. 28, 2003, Liu et al.
U.S. Appl. No. 11/329,175, filed Jan. 11, 2006, CaJacob et al.
U.S. Appl. No. 11/329,160, filed Jan. 11, 2006, Bhat et al.
U.S. Appl. No. 11/329,388, filed Jan. 11, 2006, Andersen et al.
U.S. Appl. No. 11/330,082, filed Jan. 12, 2006, Buehler et al.
U.S. Appl. No. 11/330,083, filed Jan. 12, 2006, Byrum et al.
U.S. Appl. No. 11/331,019, filed Jan. 13, 2006, Fincher et al.
U.S. Appl. No. 11/331,032, filed Jan. 13, 2006, Fincher et al.
U.S. Appl. No. 11/352,295, filed Feb. 13, 2006, Andersen et al.
U.S. Appl. No. 11/353,150, filed Feb. 14, 2006, Andersen et al.
U.S. Appl. No. 11/486,299, filed Jul. 14, 2006, Byrum.
U.S. Appl. No. 11/490,207, filed Jul. 21, 2006, Brown et al.
U.S. Appl. No. 11/491,125, filed Jul. 24, 2006, Boukharov et al.
U.S. Appl. No. 11/491,178, filed Jul. 24, 2006, Hinkle et al.
U.S. Appl. No. 11/491,371, filed Jul. 24, 2006, Byrum.
U.S. Appl. No. 11/497,489, filed Aug. 2, 2006, Byrum et al.
U.S. Appl. No. 11/503,243, filed Aug. 14, 2006, Kovalic et al.
U.S. Appl. No. 11/520,715, filed Sep. 14, 2006, Liu et al.
U.S. Appl. No. 11/521,349, filed Sep. 15, 2006, Byrum et al.
U.S. Appl. No. 11/595,983, filed Nov. 13, 2006, Boukharov et al.
AA501409, EST Database (Aug. 19, 1997).
Aach et al., "*ent*-Kaurene Biosynthesis in a Cell-Free System From Wheat (*Triticum aestivum* L.) Seedlings and the Localisation of *ent*-Kaurene Synthetase in Plastids of Three Species", *Planta* 197(2), 333-342 (1995).
Adams et al., "Complementary DNA Sequencing: Expressed Sequence Tags and Human Genome Project", *Science* 252(5013), 1651-1656 (1991).
Ait-Ali et al., "The *LS* Locus of Pea Encodes the Gibberellin Biosynthesis Enzyme *ent*-Kaurene Synthase A", *Plant J.* 11(3), 443-454 (1997).
Anaviev et al., "Oat-Maize Chromosome Addition Lines: A New System for Mapping the Maize Genome", *Proc. Natl. Acad. Sci. USA* 94, 3524-3529 (1997).
Anton et al., "Sequencing and Overexpression of the *Escherichia coli aroE* Gene Encoding Shikimate Dehydrogenase", *Biochem. J.* 249, 319-326 (1988).
Attwood, "The Babel of Bioinoformatics", *Science* 290(5491), 471-473 (2000).
Bensen et al., "Cloning and Characterization of the Maize Anl Gene", *Plant Cell* 7, 75-84.
Bentley, "The Shikimate Pathway—A Metabolic Tree with Many Branches," *Critical Rev. Biochem. Mol. Biol.* 25(5), 307-384 (1990).
Birkenbihl et al., "Cosmid-Derived Map of *E.coli* Strain BHE2600 in Comparison to the Map of Strain W3110", *Nucleic Acids Res.* 17(13), 5057-5069 (1989).
Bishop et al., "The Tomato *Dwarf* Gene Isolated by Heterologous Transposon Tagging Encodes the First Member of a New Cytochrome P450 Family", *Plant Cell* 8, 959-969 (1996).
BLASTN Search of "Nucleotide collection (nr/nt)" database performed Dec. 16, 2008 (11 pages).
BLASTP Search of "Swissprot" database performed Dec. 16, 2008, (26 pages).
BLASTX Search of "Non-redundant protein sequences (nr)" database performed Dec. 16, 2008, (35 pages).
Bonner et al., "Cloning of cDNA Encoding the Bifunctional Dehydroquinase-Shikimate Dehydrogenease of Aromatic-Amino-Acid Biosynthesis in *Nicotiana tabacum", Biochem J.* 362, 11-14 (1994).
Bork, "Powers and Pitfalls in Sequence Analysis: The 70% Hurdle", *Genome Res.*, 10, 398-400 (2000).
Bougri et al., "Members of a Low-Copy Number Gene Family Encoding Glutamyl-tRNA Reductase are Differentially Expressed in Barley," *Plant J.* 9(6), 867-878 (1996).
Broun et al., "Catalytic Plasticity of Fatty Acid Modification Enzymes Underlying Chemical Diversity of Plant Lipids", *Science* 282, 1315-1317 (1998).
Bukanov et al., "Ordered Cosmid Library and High-Resolution Physical-Genetic Aap of *Helicobacter pylori* Strain NCTC11638", *Mol. Microbiol.* 11(3), 509-523 (1994).
Charles et al., "Isolation, Characterization and Nucleotide Sequences of the *aroC* Genes encoding Chorismate Synthase from *Salmonella typhi* and *Escherichia coli", J. Gen. Microbiol.* 136, 353-358 (1990).
Chen et al., "Microcolinearity in *sh2*-Homologous Regions of the Maize, Rice, and Sorghum Genomes", *Proc. Natl. Acad. Sci. USA* 94, 3431-3435 (1997).
Coulson et al., "Toward a Physical Map of the Genome of the Nematode *Caenorhabditis elegans", Proc. Natl. Acad. Sci. USA* 83, 7821-7825 (1986).
Day et al., "Cloning of the cDNA for Glutamyl-tRNA Synthetase from *Arabidopsis thaliana", Biochim. Biophys. Acta* 1399(2-3):219-224 (1998).
Duncan et al., "The Overexpression and Complete Amino Acid Sequence of *Escherichia coli* 3-Dehydroquinase", *Biochem. J.* 238, 475-483 (1986).
Eberhard et al., "Cloning and Expression in Yeast of a Higher Plant Chorismate Mutase", *FEBS Lett.* 334(2), 233-236 (1993).
Ebert et al., "Identification of an Essential Upstream Element in the Nopaline Synthase Promoter by Stable and Transient Assays", *Proc. Natl. Acad. Sci. USA* 84(16), 5745-5749 (1987).
Efstratiadis et al., "Enzymatic in Vitro Synthesis of Globin Genes", *Cell* 7, 279-288 (1976).
Eiglmeier et al., "Use of an Ordered Cosmid Library to Deduce the Genomic Organization of *Mycobacterium leprae", Mol. Microbiol.* 7(2), 197-206 (1993).
Evans et al., "Immunodetection of Recombinant Proteins Based on Antibodies Directed Against a Metal Binding Peptide Engineered for Purification by Immobilized Metal Affinity Chromatography," *J. Immunol. Meth.* 156(2), 231-238 (1992) (Abstract Only).
Entrez Accession No. M21071 J03227 (Sep. 15, 1989).
Entrez Accession No. 170374 (Sep. 15, 1989).
Entrez Accession No. M27715 (Jun. 15, 1990).
Entrez Accession No. 153878 (Jun. 15, 1990).
Entrez Accession No. X59509 S55160 (Jun. 30, 1993).

Entrez Accession No. 48906 (Jun. 30, 1993).
Entrez Accession No. Y00710 (Sep. 12, 1993).
Entrez Accession No. 40978 (Sep. 12, 1993).
Entrez Accession No. Z26519 (Dec. 2, 1993).
Entrez Accession No. 429153 (Dec. 2, 1993).
Entrez Accession No. 551666 (Jan. 25, 1995).
Entrez Accession No. X81413 (Jan. 25, 1995).
Entrez Accession No. M87280 M99707 (Apr. 12, 1995).
Entrez Accession No. 551855 (Apr. 12, 1995).
Entrez Accession No. 313150 (Jun. 13, 1995).
Entrez Accession No. X73535 (Jun. 13, 1995).
Entrez Accession No. X04306 (Jul. 12, 1995).
Entrez Accession No. 40973 (Jul. 12, 1995).
Entrez Accession No. D63474 D16312 (Jul. 27, 1995).
Entrez Accession No. 474964 (Jul. 27, 1995).
Entrez Accession No. 987267 (Jul. 31, 1995).
Entrez Accession No. U32579 (Sep. 16, 1995).
Entrez Accession No. X82831 (Mar. 1, 1996).
Entrez Accession No. 1213067 (Mar. 1, 1996).
Entrez Accession No. 1220402 (Mar. 5, 1996).
Entrez Accession No. M63245 (Mar. 11, 1996).
Entrez Accession No. W49458 (May 28, 1996).
Entrez Accession No. 1421741 (Oct. 17, 1996).
Entrez Accession No. U54770 (Oct. 18, 1996).
Entrez Accession No. X86101 (Nov. 8, 1996).
Entrez Accession No. 520943 (Feb. 26, 1997).
Entrez Accession No. 2160544 (Jun. 5, 1997).
Entrez Accession No. U63652 (Jun. 6, 1997).
Entrez Accession No. 2257714 (Jul. 15, 1997).
Entrez Accession No. U93215 (Jul. 15, 1997).
Entrez Accession No. 2224890 (Jul. 31, 1997).
Entrez Accession No. 2224892 (Jul. 31, 1997).
Entrez Accession No. U61385 (Aug. 1, 1997).
Entrez Accession No. U61386 (Aug. 1, 1997).
Entrez Accession No. 2316104 (Aug. 8, 1997).
Entrez Accession No. AF010169 (Aug. 9, 1997).
Entrez Accession No. 1524045 (Aug. 20, 1997).
Entrez Accession No. X96943 (Aug. 20, 1997).
Entrez Accession No. Y12809 (Dec. 2, 1997).
Entrez Accession No. D88382 (Mar. 17, 1998).
Entrez Accession No. 3068709 (Apr. 2, 1998).
Entrez Accession No. AF058763 (Aug. 16, 1998).
Entrez Accession No. 3420233 (Apr. 20, 1998).
Entrez Accession No. AF049236 (Apr. 22, 1998).
Entrez Accession No. AF038152 (May 7, 1998).
Entrez Accession No. 2708690 (May 7, 1998).
Entrez Accession No. AC003058 (May 16, 1998).
Entrez Accession No. 3135277 (May 16, 1998).
Entrez Accession No. 3288821 (Jul. 20, 1998).
Entrez Accession No. AF063901 (Jul. 21, 1998).
Entrez Accession No. 3435196 (Sep. 21, 1998).
Entrez Accession No. AF067773 (Sep. 22, 1998).
Entrez Accession No. 3694811 (Sep. 24, 1998).
Entrez Accession No. AJ225107 (Oct. 1, 1998).
Entrez Accession No. 3093410 (Oct. 1, 1998).
Entrez Accession No. AF060481 (Oct. 4, 1998).
Entrez Accession No. 3925407 (Nov. 24, 1998).
Entrez Accession No. AF083948 (Nov. 25, 1998).
Entrez Accession No. AB015492 (Dec. 11, 1998).
Entrez Accession No. 4001680 (Dec. 11, 1998).
Entrez Accession No. AF017431 (Jan. 2, 1999).
Entrez Accession No. 3080490 (Jan. 12, 1999).
Entrez Accession No. AL022602 (Jan. 12, 1999).
Entrez Accession No. AB011416 (Feb. 5, 1999).
Entrez Accession No. AAC17095 GI:315616 (Apr. 5, 1999).
Entrez Accession No. AP000836; GI:6539551 (Aug. 12, 2000).
Entrez Accession No. AY013245 (May 7, 2002).
Fiedler et al., "The Formation of Homogentisate in the Biosynthesis of Tocopherol and Plastoquinone in Spinach Chloroplasts", *Planta* 155, 511-515 (1982).
Garbe et al., "The *Mycobacterium tuberculosis* Shikimate Pathway Genes: Evolutionary Relationship Between Biosynthetic and Catabolic 3-Dehydroquinases", *Mol. Gen. Genet*. 228, 385-392 (1991).
Gasser et al., "Structure, Expression, and Evolution of the 5-Enolpyruvylshikimate-3-Phosphate Synthase Genes of Petunia and Tomato", *J. Biol. Chem*. 263, 4280-4289 (1988).
Gaubier et al., "A Chlorophyll Synthetase Gene from *Arabidopsis thaliana", Mol. Gen. Genet*. 249, 58-64 (1995).
GenBank Accession No. U03774 (Jun. 22, 1994).
GenBank Accession No. L37750 (Aug. 3, 1995).
GenBank Accession No. H30177 (Aug. 16, 1995).
GenBank Accession No. W21756 (May 6, 1996).
GenBank Accession No. X80265 (Feb. 26, 1997).
GenBank Accession No. E03435 (Sep. 29, 1997).
GenBank Accession No. AF015462 (Jul. 16, 1998).
Genbank Accession No. AC005922 (Nov. 14, 1998).
GenBank Accession No. X74737 (Jan. 21, 1999).
GenBank Accession No. AU033328 (Apr. 28, 1999).
GenBank Accession No. AQ402486 (Mar. 13, 1999).
GenBank Accession No. AI861202 (Jul. 19, 1999).
GenBank Accession No. AC018632 (Dec. 15, 1999).
GenBank Accession No. AI834598 (Feb. 2, 2000).
GenBank Accession No. AZ134591 (Jun. 2, 2000).
GenBank Accession No. BE428765 (Jul. 26, 2000).
GenBank Accession No. BF542512 (Dec. 11, 2000).
GenBank Accession No. AW871780 (Dec. 11, 2001).
GenBank Accession No. BQ603510 (Jun. 24, 2002).
GenBank Accession No. DR37H4T (Nov. 22, 2002).
GenBank Accession No. BX513761 (May 27, 2003).
GenEMBL Accession No. AF096555 (Jul. 22, 1999).
GenEMBL Accession No. AL096768 (Dec. 12, 1999).
GenSeq Accession No. AAZ35275 (Mar. 27, 2000).
Gerhold et al., "It's the genes! EST access to human genome content", *BioEssays* 18(2), 973-981 (1996).
Gibson et al., "The Bacteriochlorophyll Biosynthesis Gene, *bchM*, of *Rhodobacter sphaeroides* Encodes *S*-Adenosyl-1-Methionine: Mg Protoporphyrin IX Methyltransferase", *FEBS Lett*. 352, 127-130 (1994).
Goers et al., "The Differential Allosteric Regulation of Two Chorismate-Mutase Isoenzymes of *Nicotiana silvestris", Planta* 162, 117-124 (1984).
Goff, "Rice as a Model for Cereal Genomics", *Curr. Opin. Plant Biol*. 2, 86-89 (1999).
Hedden et al., "Gibberellin Biosynthesis: Enzymes, Genes and Their Regulation", *Annu. Rev. Plant Physiol. Plant Mol. Biol*. 48, 431-460 (1997).
Herrmann, "The Shikimate Pathway as an Entry to Aromatic Secondary Metabolism," *Plant Physiol*. 107, 7-12 (1995).
Hong, "A Rapid and Accurate Strategy for Rice Contig Map Construction by Combination of Fingerprinting and Hybridization", *Plant Mol. Biol*. 35,129-133 (1997).
Hundle et al., "Functional Assignment of *Erwinia herbicola* Eho 10 Carotenoid Genes Expressed in *Escherichia coli", Mol. Gen. Genet*. 245, 406-416 (1994).
Ibba, "Biochemistry and Bioinformatics: When Worlds Collide," *Trends in Biochem. Sci*. 27(2), 64 (2000).
Iyer et al.,"*Quod erat demonstrandum*? The Mystery of Experimental Validation of Apparently Erroneous Computational Analysis of Protein Aequences", *Genome Biol*. 2(12), 1-11 (2001).
Johnston et al., "Cloning and Characterization of Potato cDNAs Involved in Tetrapyrrole Biosynthesis: Ferrochelatase (Accession No. AJ005802), Chloroplatic Protoporphyrinogen IX Oxidase (Accession No. AJ225107), and Mitochondrial Protoporphyrinogen IX Oxidase (Accession No. AJ225108)", *Plant Physiol*. 118, 329-331 (1998).
Keon et al., "Isolation and Heterologous Expression of a Gene Encoding 4-Hydroxyphenylpyruvate Dioxygenase from the Wheat Leaf-Spot Pathogen, *Mycosphaerella graminicola", FEMS Microbiol. Lett*. 161, 337-343 (1998).
Kidwell et al., "Transposable Elements as Sources of Variation in Animals and Plants", *Proc. Natl. Acad. Sci. USA* 94, 7704-7711 (1997).
Kim et al., "Construction and Characterization of a Human Bacterial Artificial Chromosome Library", *Genomics* 34, 213-218 (1996).

Knott et al., "Randomly Picked Cosmid Clones Overlap the *pyr*B and *ori*C gap in the Physical Map of the *E.coli* Chromosome", *Nucleic Acids Res.* 16, 2601-2612 (1988).
Ko et al, "An 'Equalized cDNA' Library by the Reassociation of Short Double-Stranded cDNAs", *Nucleic Acids Res.* 18(19), 5705-5711 (1990).
Kyrpides et al., "Whole-Genome Sequence Annotation: 'Going Wrong With Confidence'", *Mol. Microbiol.* 32, 886-887 (1999).
Kurata et al., "A 300 Kilobase Interval Genetic Map of Rice Including 883 Expressed Sequences," *Nature Gen.* 8(4), 362-372 (1994).
Lange et al., "Cloning and Expression of a Gibberellin 2β,3β-Hydroxylase cDNA from Pumpkin Endosperm," *Plant Cell* 9(8), 1459-1467 (1997).
Lange "Cloning Gibberellin Dioxygenase Genes from Pumpkin Endosperm by Heterologous Expression of Enzyme Activities in *Escherichia coli", Proc. Natl. Acad. Sci. USA* 94(12), 6553-6558 (1997).
Lange et al., "Expression Cloning of a Gibberellin 20-Oxidase, a Multifunctional Enzyme Involved in Gibberellin Biosynthesis", *Proc. Natl. Acad. Sci. USA* 91(18), 8552-8556 (1994).
Liepman et al., "Sequence Analysis of a cDNA Encoding Alanine:Glyoxylate Amino Transferase from *Arabidopsis* (Accession No. AF063901)", *Plant Physiol.* 117, 1125-1127 (1998).
Lim et al., "Porphobilinogen Deaminase is Encoded by a Single Gene in *Arabidopsis thaliana* and Is Targeted to the Chloroplasts," *Plant Mol. Biol.* 26, 863-872 (1994).
Mahairas et al., "Sequence-Tagged Connectors: A Sequence Approach to Mapping and Scanning the Human Genome", *Proc. Natl. Acad. Sci. USA* 96, 9739-9744 (1999).
Martin et al., "MYB Transcription Factors in Plants", *Trends Genet.* 13(2), 67-73 (1997).
Martin et al., "Mendel's Dwarfing Gene: cDNAs from the *Le* Alleles and Function of the Expressed Proteins", *Proc. Natl. Acad. Sci. USA*, 94(16):8907-8911 (1997).
McCombie et al.,"*Caenorhabditis elegans* Expressed Sequence Tags Identify Gene Families and Disease Gene Homologues," *Nature Gen.* 1, 124-131 (1992).
Meinkoth et al., "Hybridization of Nucleic Acids Immobilized on Solid Supports", *Anal. Biochem.* 138, 267-284 (1984).
Mende et al., "The Geranylgeranyl Diphosphate Synthase Gene of *Gibberella fujikuroi*: Isolation and Expression", *Mol. Gen. Genet.* 255(1), 96-105 (1997).
Mohan et al., "Genome Mapping, Molecular Markers and Marker-Assisted Selection Crop Plants", *Mol. Breed.* 3, 87-103 (1997).
Nakane et al., "Nucleotide Sequence of the Shikimate Kinase Gene (*arol*) of *Bacillus subtilis", J. Ferment. Bioeng.* 77, 312-314 (1994).
Nakayashiki et al., "Nucleotide Sequence of a cDNA Clone Encoding Glutamyl-tRNA Reductase from Rice (Accession No. AB011416)", *Plant Physiol.* 117, 332 (1998).
NCBI Accession No. S42508 (May 8, 1993).
NCBI Accession No. D23883 (Nov. 29, 1993).
NCBI Accession No. AI416616 dated Jul. 23, 2004.
NCBI Accession No. AI437891 dated Jul. 24, 2004.
NCBI Accession No. AI442596 dated Jul. 23, 2004.
NCBI Accession No. AI507744 dated Jul. 12, 2004.
NCBI Accession No. AI496422 dated Jul. 24, 2004.
NCBI Accession No. AI900979 dated Jul. 12, 2004.
NCBI Accession No. AI937985 dated Jul. 12, 2004.
NCBI Accession No. AW132562 dated Jul. 8, 2004.
NCBI Accession No. AW279362 dated Jul. 16, 2004.
NCBI Accession No. AW472030 dated Jul. 14, 2004.
NCBI Accession No. AAB07458 dated Sep. 5, 1996.
NCBI Accession No. 1321993 dated May 14, 1996.
NCBI Accession No. Q06967 dated Jun. 1, 1994.
NCBI Accession No. 22607 dated Feb. 15, 1993.
NCBI Accession No. P29305 dated Dec. 1, 1992.
NCBI Accession No. T04153 dated Jun. 18, 1999.
NCBI Accession No. CAD43308 dated Aug. 12, 2002.
NCBI Accession No. 303859 dated Jun. 7, 1993.
NCBI Accession No. P42652 dated Nov. 1, 1995.
NCBI Accession No. 466336 dated Mar. 26, 1994.
NCBI Accession No. AAA34069, corresponding to gi:535771 (Sep. 11, 1994).
NCBI Record by BLASTP search conducted December; Accession Q9FMM0 [gi:75334076] obtained Dec. 19, 2008.
NCBI Record by BLASTP search conducted December; Accession P42743 [gi:26454674] obtained Dec. 19, 2008.
NCBI Record by BLASTP search conducted December; Accession Q9FWT2 [gi:75334430] obtained Dec. 19, 2008.
NCBI Record by BLASTP search conducted December; Accession O23239 [gi:75318090] obtained Dec. 19, 2008.
NCBI Record by BLASTP search conducted December; Accession Q55EY8 [gi:74897457] obtained Dec. 19, 2008.
NCBI Record by BLASTP search conducted December; Accession Q4VBH4 [gi:93140723] obtained Dec. 19, 2008.
NCBI Record by BLASTP search conducted December; Accession Q96B02 [gi:74751754] obtained Dec. 19, 2008.
NCBI Record by BLASTP search conducted December; Accession Q8VDW4 [gi:81901996] obtained Dec. 19, 2008.
NCBI Record by BLASTP search conducted December; Accession P51668 [gi:1717848] obtained Dec. 19, 2008.
NCBI Record by BLASTN search conducted December; Accession 195620115 [gi:195620115] obtained Dec. 19, 2008.
NCBI Record by BLASTN search conducted December; Accession 194693775 [gi:194693775] obtained Dec. 19, 2008.
NCBI Record by BLASTN search conducted December; Accession 21207415 [gi:21207415] obtained Dec. 19, 2008.
NCBI Record by BLASTN search conducted December; Accession 195650616 [gi:195650616] obtained Dec. 19, 2008.
NCBI Record by BLASTN search conducted December; Accession 195623547 [gi:195623547 ] obtained Dec. 19, 2008.
NCBI Record by BLASTN search conducted December; Accession 195610241 [gi:195610241] obtained Dec. 19, 2008.
NCBI Record by BLASTN search conducted December; Accession 115454610 [gi:115454610] obtained Dec. 19, 2008.
NCBI Record by BLASTN search conducted December; Accession 32989018 [gi:32989018] obtained Dec. 19, 2008.
NCBI Record by BLASTN search conducted December; Accession 195604635 [gi:195604635] obtained Dec. 19, 2008.
NCBI Record by BLASTN search conducted December; Accession 212722863 [gi:212722863] obtained Dec. 19, 2008.
NCBI Record by BLASTN search conducted December; Accession 54652986 [gi:54652986] obtained Dec. 19, 2008.
NCBI Record by BLASTN search conducted December; Accession 157888166 [gi:157888166] obtained Dec. 19, 2008.
NCBI Record by BLASTN search conducted December; Accession 57164485 [gi:57164485] obtained Dec. 19, 2008.
NCBI Record by BLASTN search conducted December; Accession 31712067 [gi:31712067] obtained Dec. 19, 2008.
NCBI Record by BLASTN search conducted December; Accession 58530789 [gi:58530789] obtained Dec. 19, 2008.
NCBI Record by BLASTX search conducted December; Accession ACG31888 [gi:195620116] obtained Dec. 19, 2008.
NCBI Record by BLASTX search conducted December; Accession NP_001050906 [gi:115454611] obtained Dec. 19, 2008.
NCBI Record by BLASTX search conducted December; Accession ACG24564 [gi:195605468] obtained Dec. 19, 2008.
NCBI Record by BLASTX search conducted December; Accession ACF83463 [gi:194698758] obtained Dec. 19, 2008.
NCBI Record by BLASTX search conducted December; Accession ACG36729 [gi:195633091] obtained Dec. 19, 2008.
NCBI Record by BLASTX search conducted December; Accession NP_001067367 [GI:115489760 ] obtained Dec. 19, 2008.
NCBI Record by BLASTX search conducted December; Accession NP_568619 [gi:18422281] obtained Dec. 19, 2008.
NCBI Record by BLASTX search conducted December; Accession ABK95735 [gi:118487824] obtained Dec. 19, 2008.
NCBI Record by BLASTX search conducted December; Accession CAO48290 [gi:157354944] obtained Dec. 19, 2008.
NCBI Record by BLASTX search conducted December; Accession ABR14728 [gi:148841111] obtained Dec. 19, 2008.
NCBI Record by BLASTX search conducted December; Accession ABK21203 [gi:116779255] obtained Dec. 19, 2008.
NCBI Record by BLASTX search conducted December; Accession CAA48378 [gi:22658] obtained Dec. 19, 2008.

NCBI Record by BLASTX search conducted December; Accession NP_564493 [gi:18401461] obtained Dec. 19, 2008.
NCBI Record by BLASTX search conducted December; Accession NP_565110 [gi:18410856] obtained Dec. 19, 2008.
NCBI Record by BLASTX search conducted December; Accession CAN82081 [gi:147844523] obtained Dec. 19, 2008.
NCBI Record by BLASTX search conducted December; Accession ACG33604 [gi:195623548] obtained Dec. 19, 2008.
NCBI Record by BLASTX search conducted December; Accession ABK93923 [gi:118484075] obtained Dec. 19, 2008.
NCBI Record by BLASTX search conducted December; Accession CAA10494 [gi:4090259] obtained Dec. 19, 2008.
NCBI Record by BLASTX search conducted December; Accession ABK23710 [gi:116785406] obtained Dec. 19, 2008.
NCBI Record by BLASTX search conducted December; Accession XP_001776786 [gi:168048665] obtained Dec. 19, 2008.
NCBI Record by BLASTX search conducted December; Accession EAZ21342 [gi:125580196] obtained Dec. 19, 2008.
NCBI Record by BLASTX search conducted December; Accession NP_568004 [gi:18419831] obtained Dec. 19, 2008.
NCBI Record by BLASTX search conducted December; Accession AAC39325 [gi:280144] obtained Dec. 19, 2008.
NCBI Record by BLASTX search conducted December; Accession ABG22107 [gi:108863022] obtained Dec. 19, 2008.
NCBI Record by BLASTX search conducted December; Accession XP_001775540 [gi:168046155] obtained Dec. 19, 2008.
NCBI Record by BLASTX search conducted December; Accession AAP68373 [gi:31712068] obtained Dec. 19, 2008.
NCBI Record by BLASTX search conducted December; Accession AAC39327 [gi:2801448] obtained Dec. 19, 2008.
NCBI Record by BLASTX search conducted December; Accession ACF80972 [gi:194693776] obtained Dec. 19, 2008.
NCBI Record by BLASTX search conducted December; Accession AAF69157 [gi:7767660] obtained Dec. 19, 2008.
NCBI Record by BLASTX search conducted December; Accession EEC75939 [gi:218193512] obtained Dec. 19, 2008.
NCBI Record by BLASTX search conducted December; Accession ABK93246 [gi:118482654] obtained Dec. 19, 2008.
NCBI Record by BLASTX search conducted December; Accession XP_646882 [gi:66827055] obtained Dec. 19, 2008.
NCBI Record by BLASTX search conducted December; Accession XP_001624113 [gi:156357206] obtained Dec. 19, 2008.
NCBI Record by BLASTX search conducted December; Accession XP_974790 [gi:91079008] obtained Dec. 19, 2008.
NCBI Record by BLASTX search conducted December; Accession Q4VBH4 [gi:93140723] obtained Dec. 19, 2008.
NCBI Record by BLASTX search conducted December; Accession AAH95816 [gi:66267363] obtained Dec. 19, 2008.
NCBI Record by BLASTX search conducted December; Accession EEA47037 [gi:210098935] obtained Dec. 19, 2008.
NCBI Record by BLASTX search conducted December; Accession XP_001662805 [gi:157133217] obtained Dec. 19, 2008.
NCBI Record by BLASTX search conducted December; Accession BAA91954 [gi:7023411] obtained Dec. 19, 2008.
NCBI Record by BLASTX search conducted December; Accession XP_001927700 [gi:194036624] obtained Dec. 19, 2008.
NCBI Record by BLASTX search conducted December; Accession XP_001491727 [GI:149721310] obtained Dec. 19, 2008.
NCBI Record by BLASTX search conducted December; Accession EDL14346 [gi:148682399] obtained Dec. 19, 2008.
NCBI Record by BLASTX search conducted December; Accession EAW87009 [gi:119607415] obtained Dec. 19, 2008.
NCBI Record by BLASTX search conducted December; Accession XP_001062727 [gi:109475992] obtained Dec. 19, 2008.
NCBI Record by BLASTX search conducted December; Accession XP_001085749 [gi:109086705] obtained Dec. 19, 2008.
NCBI Record by BLASTX search conducted December; Accession NP_080049 [gi:110625675] obtained Dec. 19, 2008.
NCBI Record by BLASTX search conducted December; Accession BAB13883 [gi:10432979] obtained Dec. 19, 2008.
NCBI Record by BLASTX search conducted December; Accession NP_060769 [gi:145301543] obtained Dec. 19, 2008.
NCBI Record by BLASTX search conducted December; Accession NP_001001481 [gi:47933381] obtained Dec. 19, 2008.
NCBI Record by BLASTX search conducted December; Accession XP_001378231 [gi126321270] obtained Dec. 19, 2008.
NCBI Record by BLASTX search conducted December; Accession XP_418298 [gi:50731626] obtained Dec. 19, 2008.
NCBI Record by BLASTX search conducted December; Accession NP_001016132 [gi:62859305] obtained Dec. 19, 2008.
NCBI Record by BLASTX search conducted December; Accession AAI16564 [gi:95132432] obtained Dec. 19, 2008.
NCBI Record by BLASTX search conducted December; Accession NP_001038758 [gi:147900051] obtained Dec. 19, 2008.
NCBI Record by BLASTX search conducted December; Accession EAZ28149 [gi:125587485] obtained Dec. 19, 2008.
NCBI Record by BLASTX search conducted December; Accession EEC09834 [gi:215500340] obtained Dec. 19, 2008.
NCBI Record by BLASTX search conducted December; Accession XP_001688635 [gi:158293993] obtained Dec. 19, 2008.
NCBI Record by BLASTX search conducted December; Accession XP_315339 [gi:158293991] obtained Dec. 19, 2008.
NCBI Record by BLASTX search conducted December; Accession XP_001659332 [gi:157119091] obtained Dec. 19, 2008.
NCBI Record by BLASTX search conducted December; Accession NP_493587 [gi:17510293] obtained Dec. 19, 2008.
NCBI Record by BLASTX search conducted December; Accession AAQ97779 [gi:37681803] obtained Dec. 19, 2008.
NCBI Record by BLASTX search conducted December; Accession XP_392626 [gi:66549055] obtained Dec. 19, 2008.
NCBI Record by BLASTX search conducted December; Accession XP_001901039 [gi:170592573] obtained Dec. 19, 2008.
NCBI Record by BLASTX search conducted December; Accession BAB29807 [gi:12853653] obtained Dec. 19, 2008.
NCBI Record by BLASTX search conducted December; Accession BAC37094 [gi:26346891] obtained Dec. 19, 2008.
NCBI Record by BLASTX search conducted December; Accession EAQ87010 [gi:119607416] obtained Dec. 19, 2008.
NCBI Record by BLASTX search conducted December; Accession CAF98020 [gi:47223533] obtained Dec. 19, 2008.
NCBI Record by BLASTX search conducted December; Accession XP_001950447 [gi:193609423] obtained Dec. 19, 2008.
NCBI Record by BLASTX search conducted December; Accession XP_787137 [gi:115663109] obtained Dec. 19, 2008.
Norris et al., "Complementation of the *Arabidopsis pds 1* Mutation with the Gene Encoding *p*-Hydroxyphenylpuruvate Dioxygenase", *Plant Physiol.* 117, 1317-1323 (1998).
Oka et al., "Replication Origin of the *Escherichia coli* K-12 Chromosome: The Size and Structure of the Minimum DNA Segment Carrying the Information for Autonomous Replication", *Mol. Gen. Genet.* 178(1), 9-20 (1980).
Okubo et al., "Large Scale cDNA Sequencing for Analysis of Quantitative and Qualitative Aspects of Gene Expression", *Nature Gen.* 2, 173-179 (1992).
Phillips et al., "Isolation and Expression of Three Gibberellin 20-Oxidase cDNA Clones from *Arabidopsis", Plant Physiol.* 108(3), 1049-1057 (1995).
Porra, "Recent Progress in Porphyrin and Chlorophyll Biosynthesis", *Photochem. Photobiol.* 65(3), 492-516 (1997).
Russell et al., "Structural Features can be Unconserved in Proteins with Similar Folds. An Analysis of Side-Chain to Side-Chain Contacts Secondary Structure and Accessibility", *J. Mol. Biol.* 244, 332-350 (1994).
Sakamoto et al., "An Overview of Gibberellin Metabolism Enzyme Genes and Their Related Mutants in Rice", *Plant Physiol.* 134, 1642-1653 (2004).
Schmitz et al., "The Tomato *Blind* Gene Encodes a MYB Transcription Factor that Controls the Formation of Lateral Meristems", *Proc. Nat. Acad. Sci.* 99(2), 1064-1069 (2002).
Schünmann et al., "Identification of Three cDNA Clones Expressed in the Leaf Extension Zone and with Altered Patterns of Expression in the *Slender* Mutant of Barley: A Tonoplast Intrinsic Protein, a Putative Structural Protein and Protochlorophylide Oxidoreductase," *Plant Mol. Biol.* 31, 529-537 (1996).

Seffernick et al., "Melamine Deaminase and Atrazine Chlorohydrolase: 98 Percent Identical but Functionally Different", *J. Bacteriol.* 183(8), 2405-2410 (2001).
Sigma Chemical Catalogue (Sigma Chemical Co.; P.O. Box 14508, St. Louis MO 63178) 1993, product Nos. 01256, 03628, 04375, pp. 736-737.
Smith et al., "Partial Purification and Characterization of the Gibberellin $A_{20}$ 3β-Hydroxylase from Seeds of *Phaseolus vulgaris"*, *Plant Physiol.* 94:1390-1401 (1990).
Smith et al., "The First Step of Gibberellin Biosynthesis in Pumpkin is Catalyzed by at Least Two Copalyl Diphosphate Synthases Encoded by Differentially Regulated Genes", *Plant Physiol.* 118, 1411-1419 (1998).
Stammers et al., "Rapid Purification and Characterization of HIV-1 Reverse Transcriptase and RNaseH Engineered to Incorporate a C-terminal Tripeptide α-Tubulin Epitope", *FEBS Lett.* 283(2), 298-302 (1991).
Tanaka et al., "The Third Member of the *hemA* gene Family Encoding Glutamyl-tRNA Reductase is Primarily Expressed in Roots in *Hordeum vulgare", Photosynthesis Res.* 53, 161-171 (1997).
Tanksley et al., "Chromosome landing: a paradigm for map-based gene cloning in plants with large genomes", *Trends in Genet.* 11(2), 63-68 (1995).
Tikhonov et al., "Colinearity and its Exceptions in Orthologous *adh* Regions of Maize and Sorghum", *Proc. Natl. Acad. Sci. USA* 96, 7409-7414 (1999).
van de Loo et al., "An Oleate 12-Hydroxylase from *Ricirus communis* L. is a Fatty Acyl Desaturase Homolog", *Proc. Nat. Acad. Sci.* 92, 6743-6747 (1995).
Venter et al., "A New Strategy for Genome Sequencing", *Nature* 381, 364-366 (1996).
Venter et al., "The Sequence of the Human Genome" *Science* 291, 1304-1351 (2001).
Wang et al., "Construction of a Rice Bacterial Artificial Chromosome Library and Identification of Clones Linked to the Xa-21 Disease Resistance Locus", *Plant J.* 7(3), 525-533 (1995).
Wells et al., "The Chemokine Information Source: Identification and Characterization of Novel Chemokines Using the WorldWideWeb and Expressed Sequence Tag Databases", *J. Leukocyte Biol.* 61(5), 545-550 (1997).
Wendel et al., "New Isozyme Systems for Maize (*Zea mays* L.): Aconitate Hydratase, Adenylate Kinase, NADH Dehydrogenase, and Shikimate Dehydrogenase", *Biochem. Genet.* 26(5-6), 421-446 (1988) (Abstract Only).
Wenzel et al., "Physical mapping of the *Mycoplasma pneumoniae* genome", *Nucleic Acids Res.* 16(17), 8323-8336 (1988).
Winkler et al., "The Maize *Dwarf3* Gene Encodes a Cytochrome P450-Mediated Early Step in Gibberellin Biosynthesis", *Plant Cell* 7(8), 1307-1317 (1995).
Woese et al., "Conservation of Primary Structure in 16S Ribosomal RNA", *Nature* 254, 83-85 (1975).
Written Description Training Material, Example 7, pp. 30-32.
Yomo et al., "Histochemical Studies on Protease Formation in the Cotyledons of Germinating Bean Seeds," *Planta* 112(1), 35-43 (1973).
Zhang et al., "Physical Mapping of the Rice Genome with BACs", *Plant Mol. Biol.* 35, 115-127 (1997).
Zhang et al., "Construction and Characterization of Two Rice Bacterial Artificial Chromosome Libraries from the Parents of a Permanent Recombinant Inbred Mapping Population", *Mol. Breeding* 2, 11-24 (1996).
Zwick et al., "Physical Mapping of the *liguleless* Linkage Group in *Sorghum bicolor* Using Rice RFLP-Selected Sorghum BACs", *Genetics* 248, 1983-1992 (1998).
Brenner et al., "Assessing Sequence Comparison Methods with Reliable Structurally Identified Distant Evolutionary Relationships", *Proc. Natl. Acad. Sci. USA*, 95:6073-6078 (1998).
Schultz et al., "14-3-3 Proteins Are Part of an Abscisic Acid-VIVIPAROUS1 (VP1) Response Complex in the *Em* Promoter and Interact with VP1 and EmBP1", *Plant Cell*, 10:837-847 (1998).
Todd et al., "Evolution of Protein Function, from a Structural Perspective", *Current Opinion in Chemical Biology*, 3:548-556 (1999).

* cited by examiner

NUCLEIC ACID MOLECULES AND OTHER MOLECULES ASSOCIATED WITH PLANTS

CROSS REFERENCE TO RELATED APPLICATIONS

This application is a continuation under 35 U.S.C. §120 of U.S. application Ser. No. 11/330,364 filed Jan. 12, 2006 now U.S. Pat. No. 7,572,902, which is a continuation of U.S. application Ser. No. 09/696,664 filed Oct. 25, 2000 (abandoned), which is a continuation-in-part of U.S. application Ser. No. 09/553,094, filed Apr. 18, 2000 now abandoned, which is a continuation-in-part of U.S. application Ser. No. 09/237,183, filed Jan. 26, 1999 now U.S. Pat. No. 7,598,361, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998;

and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S.

Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/553,094 is also a continuation-in-part of U.S. application Ser. No. 09/394,745, filed Sep. 15, 1999, which is a continuation-in-part of U.S. application Ser. No. 09/237,183, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998;

and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/394,745 also claims the benefit of U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,707, filed Sep. 25, 1998; and to U.S. Provisional Appln. Ser. No. 60/104,119, filed Oct. 13, 1998; and to U.S. Provisional Appln. Ser. No. 60/104,121, filed Oct. 13, 1998; and to U.S. Provisional Appln. Ser. No. 60/104,123, filed Oct. 13, 1998; and to U.S. Provisional Appln. Ser. No. 60/104,124, filed Oct. 13, 1998; and to U.S. Provisional Appln. Ser. No. 60/104,127, filed Oct. 13, 1998; and to U.S. Provisional Appln. Ser. No. 60/111,033, filed Dec. 4, 1998; and to U.S. Provisional Appln. Ser. No. 60/130,180, filed Apr. 20, 1999; and to U.S. Provisional Appln. Ser. No. 60/145,146, filed Jul. 22, 1999; and to U.S. Provisional Appln. Ser. No. 60/145,147, filed Jul. 22, 1999; and to U.S. Provisional Appln. Ser. No. 60/145,148, filed Jul. 22, 1999; and to U.S. Provisional Appln. Ser. No. 60/145,485, filed Jul. 23, 1999; and to U.S. Provisional Appln. Ser. No. 60/146,904, filed Aug. 2, 1999; and to U.S. Provisional Appln. Ser. No. 60/146,907, filed Aug. 2, 1999. U.S. application Ser. No. 09/553,094 also claims the benefit of U.S. Provisional Appln. Ser. No. 60/130,178, filed Apr. 20, 1999; and to U.S. Provisional Appln. Ser. No. 60/130,180, filed Apr. 20, 1999; and to U.S. Provisional Appln. Ser. No. 60/132,860, filed May 7, 1999; and to U.S. Provisional Appln. Ser. No. 60/145,146, filed Jul. 22, 1999; and to U.S. Provisional Appln. Ser. No. 60/145,147, filed Jul. 22, 1999; and to U.S. Provisional Appln. Ser. No. 60/145,148, filed Jul. 22, 1999; and to U.S. Provisional Appln. Ser. No. 60/145,485, filed Jul. 23, 1999; and to U.S. Provisional Appln. Ser. No. 60/146,904, filed Aug. 2, 1999; and to U.S. Provisional Appln. Ser. No. 60/146,907, filed Aug. 2, 1999; and to U.S. Provisional Appln. Ser. No. 60/161,619, filed Oct. 26, 1999. U.S. application Ser. No. 09/696,664 is also a continuation-in-part of U.S. application Ser. No. 09/371,146, filed Aug. 9, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar.

9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/371,146 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/371,146 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S.

Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/371,146 is also a continuation-in-part of U.S. application Ser. No. 09/244,000, filed Feb. 8, 1999 (abandoned), which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S.

Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/244,000 also claims the benefit of U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/086,183, filed May 21, 1998; and to U.S. Provisional Appln. Ser. No. 60/086,188, filed May 21, 1998. U.S. application Ser. No. 09/371,146 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/371,146 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/371,146 is also a continuation-in-part of U.S. application Ser. No. 09/304,517, filed May 6, 1999 (abandoned). U.S. application Ser. No. 09/371,146 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No.

60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No.

60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/267,199, filed Mar. 12, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998;

and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/267,199 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/267,199 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/267,199 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/267,199 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/267,199 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998;

and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 is also a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S.

Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 also claims the benefit of U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No.

60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/300,482, filed Apr. 28, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/300,482 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/300,482 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998;

and to U.S. Provisional Appln. Ser. No. 60/111,981, filed Dec. 11, 1998. U.S. application Ser. No. 09/300,482 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/300,482 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/300,482 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S.

Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/300,482 is also a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/300,482 is also a continuation-in-part of U.S. application Ser. No. 09/267,199, filed Mar. 12, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/267,199 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/267,199 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/267,199 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/267,199 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/267,199 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 is also a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S.

application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 also claims the benefit of U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/300,482 also claims the benefit of U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/333,535, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/333,535 is also a continuation-in-part of U.S. application Ser. No. 09/206,040, filed Dec. 4, 1998 (abandoned), which claims the benefit of U.S. Provisional Appln. Ser. No. 60/100,647, filed Sep. 16, 1998. U.S. application Ser. No. 09/333,535 is also a continuation-in-part of U.S. application Ser. No. 09/210,297, filed Dec. 8, 1998 (abandoned), which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No.

60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/333,535 is also a continuation-in-part of U.S. application Ser. No. 09/244,000, filed Feb. 8, 1999 (abandoned), which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/244,000 also claims the benefit of U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/086,183, filed May 21, 1998; and to U.S. Provisional Appln. Ser. No. 60/086,188, filed May 21, 1998. U.S. application Ser. No. 09/333,535 is also a continuation-in-part of U.S. application Ser. No. 09/263,191, filed Mar. 5, 1999 (abandoned). U.S. application Ser. No. 09/333,535 is also a continuation-in-part of U.S. application Ser. No. 09/283,466, filed Apr. 2, 1999 (abandoned). U.S. application Ser. No. 09/333,535 is also a continuation-in-part of U.S. application Ser. No. 09/306,349, filed May 10, 1999 (abandoned). U.S. application Ser. No. 09/333,535 is also a continuation-in-part of U.S. application Ser. No. 09/199,129, filed Nov. 24, 1998, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/199,129 also claims the benefit of U.S. Provisional Appln. Ser. No. 60/067,000, filed Nov. 24, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/089,524, filed Jun. 16, 1998; and to U.S. Provisional Appln. Ser. No. 60/089,793, filed Jun. 18, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,131, filed Sep. 21, 1998; and to U.S. Provisional Appln. Ser. No. 60/101,132, filed September 21, and to U.S. Provisional Appln. Ser. No.

60/108,996, filed Nov. 18, 1998; and to U.S. Provisional Appln. Ser. No. 60/109,018, filed Nov. 18, 1998. U.S. application Ser. No. 09/333,535 also claims the benefit of U.S. Provisional Appln. Ser. No. 60/089,524, filed Jun. 16, 1998; and to U.S. Provisional Appln. Ser. No. 60/089,793, filed Jun. 18, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,131, filed Sep. 21, 1998; and to U.S. Provisional Appln. Ser. No. 60/101,132, filed September 21, and to U.S. Provisional Appln. Ser. No. 60/108,996, filed Nov. 18, 1998; and to U.S. Provisional Appln. Ser. No. 60/109,018, filed Nov. 18, 1998; and to U.S. Provisional Appln. Ser. No. 60/111,981, filed Dec. 11, 1998; and to U.S. Provisional Appln. Ser. No. 60/112,221, filed Dec. 14, 1998; and to U.S. Provisional Appln. Ser. No. 60/112,229, filed Dec. 14, 1998; and to U.S. Provisional Appln. Ser. No. 60/112,808, filed Dec. 18, 1998; and to U.S. Provisional Appln. Ser. No. 60/113,224, filed Dec. 22, 1998; and to U.S. Provisional Appln. Ser. No. 60/125,816, filed Mar. 23, 1999; and to U.S. Provisional Appln. Ser. No. 60/125,817, filed Mar. 23, 1999; and to U.S. Provisional Appln. Ser. No. 60/125,818, filed Mar. 23, 1999; and to U.S. Provisional Appln. Ser. No. 60/130,174, filed Apr. 20, 1999; and to U.S. Provisional Appln. Ser. No. 60/130,464, filed Apr. 22, 1999; and to U.S. Provisional Appln. Ser. No. 60/133,690, filed May 10, 1999; and to U.S. Provisional Appln. Ser. No. 60/133,691, filed May 10, 1999; and to U.S. Provisional Appln. Ser. No. 60/133,692, filed May 10, 1999. U.S. application Ser. No. 09/371,146 also claims the benefit of U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/100,672, filed Sep. 16, 1998; and to U.S. Provisional Appln. Ser. No. 60/100,963, filed Sep. 17, 1998; and to U.S. Provisional Appln. Ser. No. 60/101,130, filed Sep. 21, 1998; and to U.S. Provisional Appln. Ser. No. 60/101,131, filed Sep. 21, 1998; and to U.S. Provisional Appln. Ser. No. 60/101,132, filed Sep. 21, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/101,708, filed Sep. 25, 1998; and to U.S. Provisional Appln. Ser. No. 60/101,709, filed Sep. 25, 1998; and to U.S. Provisional Appln. Ser. No. 60/104,119, filed Oct. 13, 1998; and to U.S. Provisional Appln. Ser. No. 60/104,121, filed Oct. 13, 1998; and to U.S. Provisional Appln. Ser. No. 60/104,122, filed Oct. 13, 1998; and to U.S. Provisional Appln. Ser. No. 60/104,123, filed Oct. 13, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/108,996, filed Nov. 18, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998; and to U.S. Provisional Appln. Ser. No. 60/112,221, filed Dec. 14, 1998; and to U.S. Provisional Appln. Ser. No. 60/112,229, filed Dec. 14, 1998; and to U.S. Provisional Appln. Ser. No. 60/112,807, filed Dec. 18, 1998; and to U.S. Provisional Appln. Ser. No. 60/113,224, filed Dec. 22, 1998; and to U.S. Provisional Appln. Ser. No. 60/130,174, filed Apr. 20, 1999; and to U.S. Provisional Appln. Ser. No. 60/130,177, filed Apr. 20, 1999; and to U.S. Provisional Appln. Ser. No. 60/130,178, filed Apr. 20, 1999; and to U.S. Provisional Appln. Ser. No. 60/130,179, filed Apr. 20, 1999; and to U.S. Provisional Appln. Ser. No. 60/130,180, filed Apr. 20, 1999; and to U.S. Provisional Appln. Ser. No. 60/130,181, filed Apr. 20, 1999; and to U.S. Provisional Appln. Ser. No. 60/132,860, filed May 7, 1999; and to U.S. Provisional Appln. Ser. No. 60/133,691, filed May 10, 1999; and to U.S. Provisional Appln. Ser. No. 60/133,692, filed May 10, 1999; and to U.S. Provisional Appln. Ser. No. 60/141,128, filed Jun. 28, 1999; and to U.S. Provisional Appln. Ser. No. 60/141,134, filed Jun. 28, 1999; and to U.S. Provisional Appln. Ser. No. 60/144,084, filed Jul. 16, 1999; and to U.S. Provisional Appln. Ser. No. 60/145,146, filed Jul. 22, 1999; and to U.S. Provisional Appln. Ser. No. 60/145,147, filed Jul. 22, 1999; and to U.S. Provisional Appln. Ser. No. 60/145,148, filed Jul. 22, 1999; and to U.S. Provisional Appln. Ser. No. 60/145,485, filed Jul. 23, 1999. U.S. application Ser. No. 09/696,664 is also a continuation-in-part of U.S. application Ser. No. 09/565,306, filed May 4, 20002, which is a continuation-in-part of U.S. application Ser. No. 09/371,146, filed Aug. 9, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No.

60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/371,146 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/371,146 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/371,146 is also a continuation-in-part of U.S. application Ser. No. 09/244,000, filed Feb. 8, 1999 (abandoned), which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/244,000 also claims the benefit of U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/086,183, filed May 21, 1998; and to U.S. Provisional Appln. Ser. No. 60/086,188, filed May 21, 1998. U.S. application Ser. No. 09/371,146 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/371,146 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/371,146 is also a continuation-in-part of U.S. application Ser. No. 09/304,517, filed May 6, 1999 (abandoned). U.S. application Ser. No. 09/371,146 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/267,199, filed Mar. 12, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998;

and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/267,199 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/267,199 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/267,199 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/267,199 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/267,199 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998;

and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 is also a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 also claims the benefit of U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No.

60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/300,482, filed Apr. 28, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/300,482 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/300,482 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/300,482 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/300,482 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/300,482 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S.

Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/300,482 is also a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998;

and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/300,482 is also a continuation-in-part of U.S. application Ser. No. 09/267,199, filed Mar. 12, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/267,199 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/267,199 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S.

Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/267,199 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/267,199 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/267,199 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 is also a continuation-in-part of U.S. Appln. Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun.

30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No.

60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 also claims the benefit of U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/300,482 also claims the benefit of U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/333,535, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/333,535 is also a continuation-in-part of U.S. application Ser. No. 09/206,040, filed Dec. 4, 1998 (abandoned), which claims the benefit of U.S. Provisional Appln. Ser. No. 60/100,647, filed Sep. 16, 1998. U.S. application Ser. No. 09/333,535 is also a continuation-in-part of U.S. application Ser. No. 09/210,297, filed Dec. 8, 1998 (abandoned), which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No.

60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/333,535 is also a continuation-in-part of U.S. application Ser. No. 09/244,000, filed Feb. 8, 1999 (abandoned), which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/244,000 also claims the benefit of U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/086,183, filed May 21, 1998; and to U.S. Provisional Appln. Ser. No. 60/086,188, filed May 21, 1998. U.S. application Ser. No. 09/333,535 is also a continuation-in-part of U.S. application Ser. No. 09/263,191, filed Mar. 5, 1999 (abandoned). U.S. application Ser. No. 09/333,535 is also a continuation-in-part of U.S. application Ser. No. 09/283,466, filed Apr. 2, 1999 (abandoned). U.S. application Ser. No. 09/333,535 is also a continuation-in-part of U.S. application Ser. No. 09/306,349, filed May 10, 1999 (abandoned). U.S. application Ser. No. 09/333,535 is also a continuation-in-part of U.S. application Ser. No. 09/199,129, filed Nov. 24, 1998, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998;

and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/199,129 also claims the benefit of U.S. Provisional Appln. Ser. No. 60/067,000, filed Nov. 24, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/089,524, filed Jun. 16, 1998; and to U.S. Provisional Appln. Ser. No. 60/089,793, filed Jun. 18, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,131, filed Sep. 21, 1998; and to U.S. Provisional Appln. Ser. No. 60/101,132, filed September 21, and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/333,535 also claims the benefit of U.S. Provisional Appln. Ser. No. 60/089,524, filed Jun. 16, 1998; and to U.S. Provisional Appln. Ser. No. 60/089,793, filed Jun. 18, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,131, filed Sep. 21, 1998; and to U.S. Provisional Appln. Ser. No. 60/101,132, filed September 21, and to U.S. Provisional Appln. Ser. No. 60/108,996, filed Nov. 18, 1998; and to U.S. Provisional Appln. Ser. No. 60/109,018, filed Nov. 18, 1998; and to U.S. Provisional Appln. Ser. No. 60/111,981, filed Dec. 11, 1998; and to U.S. Provisional Appln. Ser. No. 60/112,221, filed Dec. 14, 1998; and to U.S. Provisional Appln. Ser. No. 60/112,229, filed Dec. 14, 1998; and to U.S. Provisional Appln. Ser. No. 60/112,808, filed Dec. 18, 1998; and to U.S. Provisional Appln. Ser. No. 60/113,224, filed Dec. 22, 1998; and to U.S. Provisional Appln. Ser. No. 60/125,816, filed Mar. 23, 1999; and to U.S. Provisional Appln. Ser. No. 60/125,817, filed Mar. 23, 1999; and to U.S. Provisional Appln. Ser. No. 60/125,818, filed Mar. 23, 1999; and to U.S. Provisional Appln. Ser. No. 60/130,174, filed Apr. 20, 1999; and to U.S. Provisional Appln. Ser. No. 60/130,464, filed Apr. 22, 1999; and to U.S. Provisional Appln. Ser. No. 60/133,690, filed May 10, 1999; and to U.S. Provisional Appln. Ser. No. 60/133,691, filed May 10, 1999; and to U.S. Provisional Appln. Ser. No. 60/133,692, filed May 10, 1999. U.S. application Ser. No. 09/371,146 also claims the benefit of U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/100,672, filed Sep. 16, 1998; and to U.S. Provisional Appln. Ser. No. 60/100,963, filed Sep. 17, 1998; and to U.S. Provisional Appln. Ser. No. 60/101,130, filed Sep. 21, 1998; and to U.S. Provisional Appln. Ser. No. 60/101,131, filed Sep. 21, 1998; and to U.S. Provisional Appln. Ser. No. 60/101,132, filed Sep. 21, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/101,708, filed Sep. 25, 1998; and to U.S. Provisional Appln. Ser. No. 60/101,709, filed Sep. 25, 1998; and to U.S. Provisional Appln. Ser. No. 60/104,119, filed Oct. 13, 1998; and to U.S. Provisional Appln. Ser. No. 60/104,121, filed Oct. 13, 1998; and to U.S. Provisional Appln. Ser. No. 60/104,122, filed Oct. 13, 1998; and to U.S. Provisional Appln. Ser. No. 60/104,123, filed Oct. 13, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/108,996, filed Nov. 18, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998; and to U.S. Provisional Appln. Ser. No. 60/112,221, filed Dec. 14, 1998; and to U.S. Provisional Appln. Ser. No. 60/112,229, filed Dec. 14, 1998; and to U.S. Provisional Appln. Ser. No. 60/112,807, filed Dec. 18, 1998; and to U.S. Provisional Appln. Ser. No. 60/113,224, filed Dec. 22, 1998; and to U.S. Provisional Appln. Ser. No. 60/130,174, filed Apr. 20, 1999; and to U.S. Provisional Appln. Ser. No. 60/130,177, filed Apr. 20, 1999; and to U.S. Provisional Appln. Ser. No. 60/130,178, filed Apr. 20, 1999; and to U.S. Provisional Appln. Ser. No. 60/130,179, filed Apr. 20, 1999; and to U.S. Provisional Appln. Ser. No. 60/130,180, filed Apr. 20, 1999; and to U.S. Provisional Appln. Ser. No. 60/130,181, filed Apr. 20, 1999; and to U.S. Provisional Appln. Ser. No. 60/132,860, filed May 7, 1999; and to U.S. Provisional Appln. Ser. No. 60/133,691, filed May 10, 1999; and to U.S. Provisional Appln. Ser. No. 60/133,692, filed May 10, 1999; and to U.S. Provisional Appln. Ser. No. 60/141,128, filed Jun. 28, 1999; and to U.S. Provisional Appln. Ser. No. 60/141,134, filed Jun. 28, 1999; and to U.S. Provisional Appln. Ser. No. 60/144,084, filed Jul. 16, 1999; and to U.S. Provisional Appln. Ser. No. 60/145,146, filed Jul. 22, 1999; and to U.S. Provisional Appln. Ser. No. 60/145,147, filed Jul. 22, 1999; and to U.S. Provisional Appln. Ser. No. 60/145,148, filed Jul. 22, 1999; and to U.S. Provisional Appln. Ser. No. 60/145,485, filed Jul. 23, 1999. U.S. application Ser. No. 09/565,306 is also a continuation-in-part of U.S. application Ser. No. 09/394,745, filed Sep. 15, 1999, which is a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998;

and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/394,745 also claims the benefit of U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,707, filed Sep. 25, 1998; and to U.S. Provisional Appln. Ser. No. 60/104,119, filed Oct. 13, 1998; and to U.S. Provisional Appln. Ser. No. 60/104,121, filed Oct. 13, 1998; and to U.S. Provisional Appln. Ser. No. 60/104,123, filed Oct. 13, 1998; and to U.S. Provisional Appln. Ser. No. 60/104,124, filed Oct. 13, 1998; and to U.S. Provisional Appln. Ser. No. 60/104,127, filed Oct. 13, 1998; and to U.S. Provisional Appln. Ser. No. 60/111,033, filed Dec. 4, 1998; and to U.S. Provisional Appln. Ser. No. 60/130,180, filed Apr. 20, 1999; and to U.S. Provisional Appln. Ser. No. 60/145,146, filed Jul. 22, 1999; and to U.S. Provisional Appln. Ser. No. 60/145,147, filed Jul. 22, 1999; and to U.S. Provisional Appln. Ser. No. 60/145,148, filed Jul. 22, 1999; and to U.S. Provisional Appln. Ser. No. 60/145,485, filed Jul. 23, 1999; and to U.S. Provisional Appln. Ser. No. 60/146,904, filed Aug. 2, 1999;

and to U.S. Provisional Appln. Ser. No. 60/146,907, filed Aug. 2, 1999. U.S. application Ser. No. 09/565,306 is also a continuation-in-part of U.S. application Ser. No. 09/533,094, filed Apr. 18, 2000, which is a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb.

19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No.

60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/533,094 is also a continuation-in-part of U.S. application Ser. No. 09/371,146, filed Aug. 9, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/371,146 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/371,146 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S.

Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/371,146 is also a continuation-in-part of U.S. application Ser. No. 09/244,000, filed Feb. 8, 1999 (abandoned), which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/244,000 also claims the benefit of U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/086,183, filed May 21, 1998; and to U.S. Provisional Appln. Ser. No. 60/086,188, filed May 21, 1998. U.S. application Ser. No. 09/371,146 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/371,146 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/371,146 is also a continuation-in-part of U.S. application Ser. No. 09/304,517, filed May 6, 1999 (abandoned). U.S. application Ser. No. 09/371,146 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S.

Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S.

Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/267,199, filed Mar. 12, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/267,199 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/267,199 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/267,199 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/267,199 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/267,199 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Serial No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Serial. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 is also a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb.

10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071, 064, filed Jan. 9, 1998; and to U.S. Provisional Appln. Serial No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S.

Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 also claims the benefit of U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/300,482, filed Apr. 28, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Serial No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S.

Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/300,482 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/300,482 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/300,482 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/300,482 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/300,482 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Serial No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S.

Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/300,482 is also a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998;

and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/300,482 is also a continuation-in-part of U.S. application Ser. No. 09/267,199, filed Mar. 12, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/267,199 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/267,199 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/267,199 is also a continuation-in-part of U.S. application Ser. No. 09/252,974, filed Feb. 19, 1999 (abandoned), which claims the benefit of U.S. Provisional Appln. Ser. No. 60/076,709, filed Mar. 4, 1998; and to U.S. Provisional Appln. Ser. No. 60/084,684, filed May 8, 1998. U.S. application Ser. No. 09/267,199 is also a continuation-in-part of U.S. application Ser. No. 09/262,979, filed Mar. 4, 1999 (abandoned), which claims the benefit of U.S. Provisional Appln. Ser. No. 60/076,912, filed Mar. 6, 1998. U.S. application Ser. No. 09/267,199 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 is also a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998;

and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Serial No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Serial. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Serial No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/267,199 also claims the benefit of U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/300,482 also claims the benefit of U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/371,146 is also a continuation-in-part of U.S. application Ser. No. 09/333,535, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Serial No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/333,535 is also a continuation-in-part of U.S. application Ser. No. 09/206,040, filed Dec. 4, 1998 (abandoned), which claims the benefit of U.S. Provisional Appln. Ser. No. 60/100,647, filed Sep. 16, 1998. U.S. application Ser. No. 09/333,535 is also a continuation-in-part of U.S. application Ser. No. 09/210,297, filed Dec. 8, 1998 (abandoned), which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998;

and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/333,535 is also a continuation-in-part of U.S. application Ser. No. 09/244,000, filed Feb. 8, 1999 (abandoned), which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998;

and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/244,000 also claims the benefit of U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/086,183, filed May 21, 1998; and to U.S. Provisional Appln. Ser. No. 60/086,188, filed May 21, 1998. U.S. application Ser. No. 09/333,535 is also a continuation-in-part of U.S. application Ser. No. 09/263,191, filed Mar. 5, 1999 (abandoned). U.S. application Ser. No. 09/333,535 is also a continuation-in-part of U.S. application Ser. No. 09/283,466, filed Apr. 2, 1999 (abandoned). U.S. application Ser. No. 09/333,535 is also a continuation-in-part of U.S. application Ser. No. 09/306,349, filed May 10, 1999 (abandoned). U.S. application Ser. No. 09/333,535 is also a continuation-in-part of U.S. application Ser. No. 09/199,129, filed Nov. 24, 1998, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/199,129 also claims the benefit of U.S. Provisional Appln.

Ser. No. 60/067,000, filed Nov. 24, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/089,524, filed Jun. 16, 1998; and to U.S. Provisional Appln. Ser. No. 60/089,793, filed Jun. 18, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,131, filed Sep. 21, 1998; and to U.S. Provisional Appln. Ser. No. 60/101,132, filed September 21, and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/333,535 also claims the benefit of U.S. Provisional Appln. Ser. No. 60/089,524, filed Jun. 16, 1998; and to U.S. Provisional Appln. Ser. No. 60/089,793, filed Jun. 18, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Serial No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,131, filed Sep. 21, 1998; and to U.S. Provisional Appln. Ser. No. 60/101,132, filed September 21, and to U.S. Provisional Appln. Ser. No. 60/108,996, filed Nov. 18, 1998; and to U.S. Provisional Appln. Ser. No. 60/109,018, filed Nov. 18, 1998; and to U.S. Provisional Appln. Ser. No. 60/111,981, filed Dec. 11, 1998; and to U.S. Provisional Appln. Ser. No. 60/112,221, filed Dec. 14, 1998; and to U.S. Provisional Appln. Ser. No. 60/112,229, filed Dec. 14, 1998; and to U.S. Provisional Appln. Ser. No. 60/112,808, filed Dec. 18, 1998; and to U.S. Provisional Appln. Ser. No. 60/113,224, filed Dec. 22, 1998; and to U.S. Provisional Appln. Ser. No. 60/125,816, filed Mar. 23, 1999; and to U.S. Provisional Appln. Ser. No. 60/125,817, filed Mar. 23, 1999; and to U.S. Provisional Appln. Ser. No. 60/125,818, filed Mar. 23, 1999; and to U.S. Provisional Appln. Ser. No. 60/130,174, filed Apr. 20, 1999; and to U.S. Provisional Appln. Ser. No. 60/130,464, filed Apr. 22, 1999; and to U.S. Provisional Appln. Ser. No. 60/133,690, filed May 10, 1999; and to U.S. Provisional Appln. Ser. No. 60/133,691, filed May 10, 1999; and to U.S. Provisional Appln. Ser. No. 60/133,692, filed May 10, 1999. U.S. application Ser. No. 09/371,146 also claims the benefit of U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/100,672, filed Sep. 16, 1998; and to U.S. Provisional Appln. Ser. No. 60/100,963, filed Sep. 17, 1998; and to U.S. Provisional Appln. Ser. No. 60/101,130, filed Sep. 21, 1998; and to U.S. Provisional Appln. Ser. No. 60/101,131, filed Sep. 21, 1998; and to U.S. Provisional Appln. Ser. No. 60/101,132, filed Sep. 21, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/101,708, filed Sep. 25, 1998; and to U.S. Provisional Appln. Ser. No. 60/101,709, filed Sep. 25, 1998; and to U.S. Provisional Appln. Ser. No. 60/104,119, filed Oct. 13, 1998; and to U.S. Provisional Appln. Ser. No. 60/104,121, filed Oct. 13, 1998; and to U.S. Provisional Appln. Ser. No. 60/104,122, filed Oct. 13, 1998; and to U.S. Provisional Appln. Ser. No. 60/104,123, filed Oct. 13, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/108,996, filed Nov. 18, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998; and to U.S. Provisional Appln. Ser. No. 60/112,221, filed Dec. 14, 1998; and to U.S. Provisional Appln. Ser. No. 60/112,229, filed Dec. 14, 1998; and to U.S. Provisional Appln. Ser. No. 60/112,807, filed Dec. 18, 1998; and to U.S. Provisional Appln. Ser. No. 60/113,224, filed Dec. 22, 1998; and to U.S.

Provisional Appln. Ser. No. 60/130,174, filed Apr. 20, 1999; and to U.S. Provisional Appln. Ser. No. 60/130,177, filed Apr. 20, 1999; and to U.S. Provisional Appln. Ser. No. 60/130,178, filed Apr. 20, 1999; and to U.S. Provisional Appln. Ser. No. 60/130,179, filed Apr. 20, 1999; and to U.S. Provisional Appln. Ser. No. 60/130,180, filed Apr. 20, 1999; and to U.S. Provisional Appln. Ser. No. 60/130,181, filed Apr. 20, 1999; and to U.S. Provisional Appln. Ser. No. 60/132,860, filed May 7, 1999; and to U.S. Provisional Appln. Ser. No. 60/133,691, filed May 10, 1999; and to U.S. Provisional Appln. Ser. No. 60/133,692, filed May 10, 1999; and to U.S. Provisional Appln. Ser. No. 60/141,128, filed Jun. 28, 1999; and to U.S. Provisional Appln. Ser. No. 60/141,134, filed Jun. 28, 1999; and to U.S. Provisional Appln. Ser. No. 60/144,084, filed Jul. 16, 1999; and to U.S. Provisional Appln. Ser. No. 60/145,146, filed Jul. 22, 1999; and to U.S. Provisional Appln. Ser. No. 60/145,147, filed Jul. 22, 1999; and to U.S. Provisional Appln. Ser. No. 60/145,148, filed Jul. 22, 1999; and to U.S. Provisional Appln. Ser. No. 60/145,485, filed Jul. 23, 1999. U.S. application Ser. No. 09/553,094 is also a continuation-in-part of U.S. application Ser. No. 09/394,745, filed Sep. 15, 1999, which is a continuation-in-part of U.S. application Ser. No. 09/237,183, filed Jan. 26, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Serial No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/237,183 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/237,183 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/237,183 is also a continuation-in-part of U.S. application Ser. No. 09/233,218, filed Jan. 20, 1999, which is a continuation-in-part of U.S. application Ser. No. 09/198,779, filed Nov. 24, 1998 (abandoned), which claims the benefit of U.S. Provisional Appln. Ser. No. 60/067,000, filed Nov. 24, 1997; and to U.S. Provisional Appln. Ser. No. 60/066,873, filed Nov. 25, 1997; and to U.S. Provisional Appln. Ser. No. 60/069,472, filed Dec. 9, 1997; and to U.S. Provisional Appln. Ser. No. 60/074,201, filed Feb. 10, 1998; and to U.S. Provisional Appln. Ser. No. 60/074,280, filed Feb. 10, 1998; and to U.S. Provisional Appln. Ser. No. 60/074,281, filed Feb. 10, 1998; and to U.S. Provisional Appln. Ser. No. 60/074,282, filed Feb. 10, 1998; and to U.S. Provisional Appln. Ser. No. 60/074,565, filed Feb. 12, 1998; and to U.S. Provisional Appln. Ser. No. 60/074,566, filed Feb. 12, 1998; and to U.S. Provisional Appln. Ser. No. 60/074,567, filed Feb. 12, 1998; and to U.S. Provisional Appln. Ser. No. 60/074,789, filed Feb. 19, 1998; and to U.S. Provisional Appln. Ser. No. 60/075,459, filed Feb. 19, 1998; and to U.S. Provisional Appln. Ser. No. 60/075,460, filed Feb. 19, 1998; and to U.S. Provisional Appln. Ser. No. 60/075,461, filed Feb. 19, 1998; and to U.S. Provisional Appln. Ser. No. 60/075,462, filed Feb. 19, 1998; and to U.S. Provisional Appln. Ser. No. 60/075,463, filed Feb. 19, 1998; and to U.S. Provisional Appln. Ser. No. 60/075,464, filed Feb. 19, 1998; and to U.S. Provisional Appln. Ser. No. 60/077,229, filed Mar. 9, 1998; and to U.S. Provisional Appln. Ser. No. 60/077,230, filed Mar. 9, 1998; and to U.S. Provisional Appln. Ser. No. 60/077,231, filed Mar. 9, 1998; and to U.S. Provisional Appln. Ser. No. 60/078,031, filed Mar. 16, 1998; and to U.S. Provisional Appln. Ser. No. 60/078,368, filed Mar. 18, 1998; and to U.S. Provisional Appln. Ser. No. 60/080,844, filed Apr. 7, 1998; and to U.S. Provisional Appln. Ser. No. 60/083,067, filed Apr. 27, 1998; and to U.S. Provisional Appln. Ser. No. 60/083,386, filed Apr. 29, 1998; and to U.S. Provisional Appln. Ser. No. 60/083,387, filed Apr. 29, 1998; and to U.S. Provisional Appln. Ser. No. 60/083,388, filed Apr. 29, 1998; and to U.S. Provisional Appln. Ser. No. 60/083,389, filed Apr. 29, 1998; and to U.S. Provisional Appln. Ser. No. 60/084,684, filed May 8, 1998; and to U.S. Provisional Appln. Ser. No. 60/085,222, filed May 13, 1998; and to U.S. Provisional Appln. Ser. No. 60/085,223, filed May 13, 1998; and to U.S. Provisional Appln. Ser. No. 60/085,224, filed May 13, 1998; and to U.S. Provisional Appln. Ser. No. 60/085,245, filed May 13, 1998; and to U.S. Provisional Appln. Ser. No. 60/086,183, filed May 21, 1998; and to U.S. Provisional Appln. Ser. No. 60/086,184, filed May 21, 1998; and to U.S. Provisional Appln. Ser. No. 60/086,185, filed May 21, 1998; and to U.S. Provisional Appln. Ser. No. 60/086,186, filed May 21, 1998; and to U.S. Provisional Appln. Ser. No. 60/086,187, filed May 21, 1998; and to U.S. Provisional Appln. Ser. No. 60/086,188, filed May 21, 1998; and to U.S. Provisional Appln. Ser. No. 60/086,339, filed May 21, 1998; and to U.S. Provisional Appln. Ser. No. 60/089,524, filed Jun. 16, 1998; and to U.S. Provisional Appln. Ser. No. 60/089,810, filed Jun. 18, 1998; and to U.S. Provisional Appln. Ser. No. 60/089,814, filed Jun. 18, 1998; and to U.S. Provisional Appln. Ser. No. 60/091,247, filed Jun. 30, 1998; and to U.S. Provisional Appln. Ser. No. 60/092,036, filed Jul. 8, 1998; and to U.S. Provisional Appln. Ser. No. 60/099,667, filed Sep. 9, 1998; and to U.S. Provisional Appln. Ser. No. 60/099,668, filed Sep. 9, 1998; and to U.S. Provisional Appln. Ser. No. 60/099,670, filed Sep. 9, 1998; and to U.S. Provisional Appln. Ser. No. 60/099,697, filed Sep. 9, 1998; and to U.S. Provisional Appln. Ser. No. 60/100,672, filed Sep. 16, 1998; and to U.S. Provisional Appln. Ser. No. 60/100,673, filed Sep. 16, 1998; and to U.S. Provisional Appln. Ser. No. 60/100,674, filed Sep. 16, 1998; and to U.S. Provisional Appln. Ser. No. 60/101,130, filed Sep. 21, 1998; and to U.S. Provisional Appln. Ser. No. 60/101,132, filed Sep. 21, 1998; and to U.S. Provisional Appln. Ser. No. 60/108,996, filed Nov. 18, 1998; and to U.S. Provisional Appln. Ser. No. 60/109,018, filed Nov. 18, 1998. U.S. application Ser. No. 09/233,218 is also a continuation-in-part of U.S. application Ser. No. 09/227,586, filed Jan. 8, 1999 (abandoned), which claims the benefit of U.S. Provisional Appln. Ser. No. 60/071,064, filed Jan. 9, 1998; and to U.S. Provisional Appln. Ser. No. 60/090,170, filed Jun. 22, 1998; and to U.S. Provisional Appln. Ser. No. 60/092,036, filed Jul. 8, 1998. U.S. application Ser. No. 09/233,218 is also a continuation-in-part of U.S. application Ser. No. 09/229,413, filed Jan. 12, 1999 (abandoned), which claims the benefit of U.S. Appln. Ser. No. 60/071,479, filed Jan. 13, 1998; and to U.S. Provisional Appln. Ser. No. 60/085,533, filed May 15, 1998; and to U.S. Provisional Appln. Ser. No. 60/089,806, filed Jun. 18, 1998; and to U.S. Provisional Appln. Ser. No. 60/089,807, filed Jun. 18, 1998; and to U.S. Provisional Appln. Ser. No. 60/089,808, filed Jun. 18, 1998; and to U.S. Provisional Appln. Ser. No. 60/089,811, filed Jun. 18, 1998; and to U.S. Provisional Appln. Ser. No. 60/089,812, filed Jun. 18, 1998; and to U.S. Provisional Appln. Ser. No. 60/089,813, filed Jun. 18, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/099,697, filed Sep. 9, 1998; and to U.S. Provisional Appln. Ser. No. 60/100,963, filed Sep. 17, 1998; and to U.S. Provisional Appln. Ser. No. 60/101,343, filed Sep. 22, 1998; and to U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,508, filed Sep. 22, 1998; and to U.S. Provisional Appln. Ser. No. 60/101,707, filed Sep. 25, 1998; and to U.S. Provisional Appln. Ser. No. 60/104,124, filed Oct. 13, 1998; and to U.S. Provisional Appln. Ser. No. 60/104,126, filed Oct. 13, 1998; and to U.S. Provisional Appln. Ser. No. 60/104,127, filed Oct. 13, 1998; and to U.S. Provisional Appln. Ser. No. 60/104,128, filed Oct. 13, 1998; and to U.S. Provisional Appln. Ser. No. 60/111,981, filed Dec. 11, 1998. U.S. application Ser. No. 09/233,218 also claims the benefit of U.S. Provisional Appln. Ser. No. 60/072,027, filed Jan. 21, 1998; and to U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/237,183 also claims the benefit of U.S. Provisional Appln. Ser. No. 60/072,888, filed Jan. 27, 1998; and to U.S. Provisional Appln. Ser. No. 60/076,709, filed Mar. 4, 1998; and to U.S. Provisional Appln. Ser. No. 60/076,912, filed Mar. 6, 1998; and to U.S. Provisional Appln. Ser. No. 60/078,031, filed Mar. 16, 1998; and to U.S. Provisional Appln. Ser. No. 60/083,390, filed Apr. 29, 1998; and to U.S. Provisional Appln. Ser. No. 60/084,684, filed May 8, 1998; and to U.S. Provisional Appln. Ser. No. 60/085,057, filed May 8, 1998; and to U.S. Provisional Appln. Ser. No. 60/085,429, filed May 8, 1998; and to U.S. Provisional Appln. Ser. No. 60/085,245, filed May 13, 1998; and to U.S. Provisional Appln. Ser. No. 60/085,533, filed May 15, 1998; and to U.S. Provisional Appln. Ser. No. 60/085,940, filed May 19, 1998; and to U.S. Provisional Appln. Ser. No. 60/086,339, filed May 21, 1998; and to U.S. Provisional Appln. Ser. No. 60/086,594, filed May 22, 1998; and to U.S. Provisional Appln. Ser. No. 60/086,608, filed May 22, 1998; and to U.S. Provisional Appln. Ser. No. 60/087,422, filed Jun. 1, 1998; and to U.S. Provisional Appln. Ser. No. 60/087,631, filed Jun. 2, 1998; and to U.S. Provisional Appln. Ser. No. 60/087,762, filed Jun. 2, 1998; and to U.S. Provisional Appln. Ser. No. 60/087,972 filed Jun. 4, 1998; and to U.S. Provisional Appln. Ser. No. 60/087,973 filed Jun. 4, 1998; and to U.S. Provisional Appln. Ser. No. 60/088,441, filed Jun. 8, 1998; and to U.S. Provisional Appln. Ser. No. 60/089,627, filed Jun. 16, 1998; and to U.S. Provisional Appln. Ser. No. 60/089,789, filed Jun. 18, 1998; and to U.S. Provisional Appln. Ser. No. 60/090,170, filed Jun. 22, 1998; and to U.S. Provisional Appln. Ser. No. 60/090,856, filed Jun. 26, 1998; and to U.S. Provisional Appln. Ser. No. 60/090,928, filed Jun. 26, 1998; and to U.S. Provisional Appln. Ser. No. 60/091,035, filed Jun. 29, 1998; and to U.S. Provisional Appln. Ser. No. 60/091,247, filed Jun. 30, 1998; and to U.S. Provisional Appln. Ser. No. 60/091,405, filed Jun. 30, 1998; and to U.S. Provisional Appln. Ser. No. 60/092,036, filed Jul. 8, 1998; and to U.S. Provisional Appln. Ser. No. 60/100,963, filed Sep. 17, 1998; and to U.S. Provisional Appln. Ser. No. 60/110,108, filed Nov. 25, 1998; and to U.S. Provisional Appln. Ser. No. 60/110,109, filed Nov. 25, 1998; and to U.S. Provisional Appln. Ser. No. 60/111,033, filed Dec. 4, 1998; and to U.S. Provisional Appln. Ser. No. 60/111,742, filed Dec. 10, 1998. U.S. application Ser. No. 09/394,745 also claims the benefit of U.S. Provisional Appln. Ser. No. 60/101,344, filed Sep. 22, 1998; and to U.S. Provisional Appln. Ser. No. 60/101,347, filed Sep. 22, 1998; and to U.S. Provisional Appln. Ser. No. 60/101,707, filed Sep. 25, 1998; and to U.S. Provisional Appln. Ser. No. 60/104,119, filed Oct. 13, 1998; and to U.S. Provisional Appln. Ser. No. 60/104,121, filed Oct. 13, 1998; and to U.S. Provisional Appln. Ser. No. 60/104,123, filed Oct. 13, 1998; and to U.S. Provisional Appln. Ser. No. 60/104,124, filed Oct. 13, 1998; and to U.S. Provisional Appln. Ser. No. 60/104,127, filed Oct. 13, 1998; and to U.S. Provisional Appln. Ser. No. 60/111,033, filed Dec. 4, 1998; and to U.S. Provisional Appln. Ser. No. 60/130,180, filed Apr. 20, 1999; and to U.S. Provisional Appln. Ser. No. 60/145,146, filed Jul. 22, 1999; and to U.S. Provisional Appln. Ser. No. 60/145,147, filed Jul. 22, 1999; and to U.S. Provisional Appln. Ser. No. 60/145,148, filed Jul. 22, 1999; and to U.S. Provisional Appln. Ser. No. 60/145,485, filed Jul. 23, 1999; and to U.S. Provisional Appln. Ser. No. 60/146,904, filed Aug. 2, 1999; and to U.S. Provisional Appln. Ser. No. 60/146,907, filed Aug. 2, 1999. U.S. application Ser. No. 09/533,094 also claims the benefit of U.S. Provisional Appln. Ser. No. 60/130,178, filed Apr. 20, 1999; and to U.S. Provisional Appln. Ser. No. 60/130,180, filed Apr. 20, 1999; and to U.S. Provisional Appln. Ser. No. 60/132,860, filed May 7, 1999; and to U.S. Provisional Appln. Ser. No. 60/145,146, filed Jul. 22, 1999; and to U.S. Provisional Appln. Ser. No. 60/145,147, filed Jul. 22, 1999; and to U.S. Provisional Appln. Ser. No. 60/145,148, filed Jul. 22, 1999; and to U.S. Provisional Appln. Ser. No. 60/145,485, filed Jul. 23, 1999; and to U.S. Provisional Appln. Ser. No. 60/146,904, filed Aug. 2, 1999; and to U.S. Provisional Appln. Ser. No. 60/146,907, filed Aug. 2, 1999; and to U.S. Provisional Appln. Ser. No. 60/161,619, filed Oct. 26, 1999. U.S. application Ser. No. 09/565,306 also claims the benefit of U.S. Provisional Appln. Ser. No. 60/132,860, filed May 7, 1999; and to U.S. Provisional Appln. Ser. No. 60/146,904, filed Aug. 2, 1999; and to U.S. Provisional Appln. Ser. No. 60/146,907, filed Aug. 2, 1999; and to U.S. Provisional Appln. Ser. No. 60/161,619, filed Oct. 26, 1999; and to U.S. Provisional Appln. Ser. No. 60/179,730, filed Feb. 2, 2000. U.S. application Ser. No. 09/696,664 also claims the benefit of U.S. Provisional Appln. Ser. No. 60/161,619, filed Oct. 26, 1999; and to U.S. Provisional Appln. Ser. No. 60/207,458, filed May 30, 2000; and to U.S. Provisional Appln. Ser. No. 60/208,063, filed May 31, 2000; and to U.S. Provisional Appln. Ser. No. 60/209,830, filed Jun. 6, 2000. All of the above-listed applications are herein incorporated by reference in their entirety.

INCORPORATION OF SEQUENCE LISTING

This application contains an electronic equivalent paper copy of the sequence listing submitted herewith electronically via EFS web and a computer-readable form of the sequence listing submitted herewith electronically via EFS web which contains a file named "P01782US09_seq_list.txt", which is 13,170,715 bytes in size (measured in MS-DOS) and which was created on Jul. 9, 2009.

FIELD OF THE INVENTION

The present invention is in the field of plant biochemistry. More specifically the invention relates to nucleic acid molecules that encode proteins and fragments of proteins produced in plant cells, in particular, maize plants. The invention also relates to proteins and fragments of proteins so encoded and antibodies capable of binding the proteins. The invention also relates to methods of using the nucleic acid molecules, proteins and fragments of proteins.

BACKGROUND OF THE INVENTION

I. Expressed Sequence Tag Nucleic Acid Molecules

Expressed sequence tags, or ESTs, are short sequences of randomly selected clones from a cDNA (or complementary DNA) library which are representative of the cDNA inserts of these randomly selected clones. McCombie, et al., *Nature Genetics,* 1: 124-130 (1992); Kurata, et al., *Nature Genetics,* 8: 365-372 (1994); Okubo, et al., *Nature Genetics,* 2: 173-179 (1992), all of which references are incorporated herein in their entirety.

Using conventional methodologies, cDNA libraries can be constructed from the mRNA (messenger RNA) of a given tissue or organism using poly dT primers and reverse transcriptase (Efstratiadis, et al., *Cell* 7:279-288 (1976), the entirety of which is herein incorporated by reference; Higuchi, et al., *Proc. Natl. Acad. Sci.* (*U.S.A.*) 73:3146-3150 (1976), the entirety of which is herein incorporated by reference; Maniatis, et al., *Cell* 8:163 (1976) the entirety of which is herein incorporated by reference; Land, et al., *Nucleic Acids Res.* 9:2251-2266 (1981), the entirety of which is herein incorporated by reference; Okayama, et al., *Mol. Cell. Biol.* 2:161-170 (1982), the entirety of which is herein incorporated by reference; Gubler, et al., *Gene* 25:263 (1983), the entirety of which is herein incorporated by reference).

Several methods may be employed to obtain full-length cDNA constructs. For example, terminal transferase can be used to add homopolymeric tails of dC residues to the free 3' hydroxyl groups (Land, et al., *Nucleic Acids Res.* 9:2251-2266 (1981), the entirety of which is herein incorporated by reference). This tail can then be hybridized by a poly dG oligo which can act as a primer for the synthesis of full length second strand cDNA. Okayama and Berg, report a method for obtaining full length cDNA constructs. This method has been simplified by using synthetic primer-adapters that have both homopolymeric tails for priming the synthesis of the first and second strands and restriction sites for cloning into plasmids (Coleclough, et al., *Gene* 34:305-314 (1985), the entirety of which is herein incorporated by reference) and bacteriophage vectors (Krawinkel, et al., *Nucleic Acids Res.* 14:1913 (1986), the entirety of which is herein incorporated by reference; and Han, et al., *Nucleic Acids Res.* 15:6304 (1987), the entirety of which is herein incorporated by reference).

These strategies have been coupled with additional strategies for isolating rare mRNA populations. For example, a typical mammalian cell contains between 10,000 and 30,000 different mRNA sequences. Davidson, *Gene Activity in Early Development,* 2nd ed., Academic Press, New York (1976). The number of clones required to achieve a given probability that a low-abundance mRNA will be present in a cDNA library is $N=(\ln(1-P))/(\ln(1-1/n))$ where N is the number of clones required, P is the probability desired, and 1/n is the fractional proportion of the total mRNA that is represented by a single rare mRNA. (Sambrook, et al., *Molecular Cloning: A Laboratory Manual,* 2nd ed., Cold Spring Harbor Laboratory Press (1989), the entirety of which is herein incorporated by reference.).

A method to enrich preparations of mRNA for sequences of interest is to fractionate by size. One such method is to fractionate by electrophoresis through an agarose gel (Pennica, et al., *Nature* 301:214-221 (1983), the entirety of which is herein incorporated by reference). Another such method employs sucrose gradient centrifugation in the presence of an agent, such as methylmercuric hydroxide, that denatures secondary structure in RNA (Schweinfest, et al., *Proc. Natl. Acad. Sci.* (*U.S.A.*) 79:4997-5000 (1982), the entirety of which is herein incorporated by reference).

A frequently adopted method is to construct equalized or normalized cDNA libraries (Ko, *Nucleic Acids Res.* 18:5705-5711 (1990), the entirety of which is herein incorporated by reference; Patanjali, S. R. et al., *Proc. Natl. Acad. Sci.* (*U.S.A.*) 88:1943-1947 (1991), the entirety of which is herein incorporated by reference). Typically, the cDNA population is normalized by subtractive hybridization. Schmid, et al., *J. Neurochem.* 48:307-312 (1987) the entirety of which is herein incorporated by reference; Fargnoli, et al., *Anal. Biochem.* 187:364-373 (1990) the entirety of which is herein incorporated by reference; Travis, et al., *Proc. Natl. Acad. Sci.* (*U.S.A.*) 85:1696-1700 (1988) the entirety of which is herein incorporated by reference; Kato, *Eur. J. Neurosci.* 2:704 (1990); and Schweinfest, et al., *Genet. Anal. Tech. Appl.* 7:64 (1990), the entirety of which is herein incorporated by reference). Subtraction represents another method for reducing the population of certain sequences in the cDNA library. Swaroop, et al., *Nucleic Acids Res.* 19:1954 (1991), the entirety of which is herein incorporated by reference).

ESTs can be sequenced by a number of methods. Two basic methods may be used for DNA sequencing, the chain termination method of Sanger et al., *Proc. Natl. Acad. Sci.* (*U.S.A.*) 74: 5463-5467 (1977), the entirety of which is herein incorporated by reference and the chemical degradation method of Maxam and Gilbert, *Proc. Nat. Acad. Sci.* (*U.S.A.*) 74: 560-564 (1977), the entirety of which is herein incorporated by reference. Automation and advances in technology such as the replacement of radioisotopes with fluorescence-based sequencing have reduced the effort required to sequence DNA (Craxton, *Methods,* 2: 20-26 (1991), the entirety of which is herein incorporated by reference; Ju et al., *Proc. Natl. Acad. Sci.* (*U.S.A.*) 92: 4347-4351 (1995), the entirety of which is herein incorporated by reference; Tabor and Richardson, *Proc. Natl. Acad. Sci.* (*U.S.A.*) 92: 6339-6343 (1995), the entirety of which is herein incorporated by reference). Automated sequencers are available from, for example, Pharmacia Biotech, Inc., Piscataway, N.J. (Pharmacia ALF), LI-COR, Inc., Lincoln, Nebr. (LI-COR 4,000) and Millipore, Bedford, Mass. (Millipore BaseStation).

In addition, advances in capillary gel electrophoresis have also reduced the effort required to sequence DNA and such advances provide a rapid high resolution approach for sequencing DNA samples (Swerdlow and Gesteland, *Nucleic Acids Res.* 18:1415-1419 (1990); Smith, *Nature* 349:812-813 (1991); Luckey et al., *Methods Enzymol.* 218:154-172 (1993); Lu et al., *J. Chromatog. A.* 680:497-501 (1994); Carson et al., *Anal. Chem.* 65:3219-3226 (1993); Huang et al., *Anal. Chem.* 64:2149-2154 (1992); Kheterpal et al., *Electrophoresis* 17:1852-1859 (1996); Quesada and Zhang, *Electrophoresis* 17:1841-1851 (1996); Baba, *Yakugaku Zasshi* 117: 265-281 (1997), all of which are herein incorporated by reference in their entirety).

ESTs longer than 150 bases have been found to be useful for similarity searches and mapping. (Adams, et al., *Science* 252:1651-1656 (1991), herein incorporated by reference.) EST sequences normally range from 150-450 bases. This is the length of sequence information that is routinely and reliably generated using single run sequence data. Typically, only single run sequence data is obtained from the cDNA library, Adams, et al., *Science* 252:1651-1656 (1991). Automated single run sequencing typically results in an approximately 2-3% error or base ambiguity rate. (Boguski, et al., *Nature Genetics,* 4:332-333 (1993), the entirety of which is herein incorporated by reference).

EST databases have been constructed or partially constructed from, for example, *C. elegans* (McCombrie, et al., *Nature Genetics* 1: 124-131 (1992), human liver cell line HepG2 (Okubo, et al., *Nature Genetics* 2:173-179 (1992)), human brain RNA (Adams, et al., *Science* 252:1651-1656 (1991); Adams, et al., *Nature* 355:632-635 (1992)), *Arabidopsis*, (Newman, et al., *Plant Physiol.* 106:1241-1255 (1994)); and rice (Kurata, et al., *Nature Genetics* 8:365-372 (1994).

II. Sequence Comparisons

A characteristic feature of a protein or DNA sequence is that it can be compared with other known protein or DNA sequences. Sequence comparisons can be undertaken by determining the similarity of the test or query sequence with sequences in publicly available or propriety databases ("similarity analysis") or by searching for certain motifs ("intrinsic sequence analysis")(e.g. cis elements)(Coulson, *Trends in Biotechnology,* 12: 76-80 (1994), the entirety of which is herein incorporated by reference; Birren, et al., *Genome Analysis,* 1: 543-559 (1997), the entirety of which is herein incorporated by reference).

Similarity analysis includes database search and alignment. Examples of public databases include the DNA Database of Japan (DDBJ) (available on the Worldwide Web at ddbj.nig.ac jp/); Genebank (available on the Worldwide Web at ncbi.nlm.nih.gov/web/Genbank/Index.htlm); and the European Molecular Biology Laboratory Nucleic Acid Sequence Database (EMBL) (available on the Worldwide Web at ebi.ac.uk/ebi_docs/embl_db.html). A number of different search algorithms have been developed, one example of which are the suite of programs referred to as BLAST programs. There are five implementations of BLAST, three designed for nucleotide sequences queries (BLASTN, BLASTX, and TBLASTX) and two designed for protein sequence queries (BLASTP and TBLASTN) (Coulson, *Trends in Biotechnology,* 12: 76-80 (1994); Birren, et al., *Genome Analysis,* 1: 543-559 (1997)).

BLASTN takes a nucleotide sequence (the query sequence) and its reverse complement and searches them against a nucleotide sequence database. BLASTN was designed for speed, not maximum sensitivity, and may not find distantly related coding sequences. BLASTX takes a nucleotide sequence, translates it in three forward reading frames and three reverse complement reading frames, and then compares the six translations against a protein sequence database. BLASTX is useful for sensitive analysis of preliminary (single-pass) sequence data and is tolerant of sequencing errors (Gish and States, *Nature Genetics,* 3: 266-272 (1993), the entirety of which is herein incorporated by reference). BLASTN and BLASTX may be used in concert for analyzing EST data (Coulson, *Trends in Biotechnology,* 12: 76-80 (1994); Birren, et al., *Genome Analysis,* 1: 543-559 (1997).

Given a coding nucleotide sequence and the protein it encodes, it is often preferable to use the protein as the query sequence to search a database because of the greatly increased sensitivity to detect more subtle relationships. This is due to the larger alphabet of proteins (20 amino acids) compared with the alphabet of nucleic acid sequences (4 bases), where it is far easier to obtain a match by chance. In addition, with nucleotide alignments, only a match (positive score) or a mismatch (negative score) is obtained, but with proteins, the presence of conservative amino acid substitutions can be taken into account. Here, a mismatch may yield a positive score if the non-identical residue has physical/chemical properties similar to the one it replaced. Various scoring matrices are used to supply the substitution scores of all possible amino acid pairs. A general purpose scoring system is the BLOSUM62 matrix (Henikoff and Henikoff, *Proteins,* 17: 49-61 (1993), the entirety of which is herein incorporated by reference), which is currently the default choice for BLAST programs. BLOSUM62 is tailored for alignments of moderately diverged sequences and thus may not yield the best results under all conditions. Altschul, *J. Mol. Biol.* 36: 290-300 (1993), the entirety of which is herein incorporated by reference, uses a combination of three matrices to cover all contingencies. This may improve sensitivity, but at the expense of slower searches. In practice, a single BLOSUM62 matrix is often used but others (PAM40 and PAM250) may be attempted when additional analysis is necessary. Low PAM matrices are directed at detecting very strong but localized sequence similarities, whereas high PAM matrices are directed at detecting long but weak alignments between very distantly related sequences.

Homologues in other organisms are available that can be used for comparative sequence analysis. Multiple alignments are performed to study similarities and differences in a group of related sequences. CLUSTAL W is a multiple sequence alignment package available that performs progressive multiple sequence alignments based on the method of Feng and Doolittle, *J. Mol. Evol.* 25: 351-360 (1987), the entirety of which is herein incorporated by reference. Each pair of sequences is aligned and the distance between each pair is calculated; from this distance matrix, a guide tree is calculated, and all of the sequences are progressively aligned based on this tree. A feature of the program is its sensitivity to the effect of gaps on the alignment; gap penalties are varied to encourage the insertion of gaps in probable loop regions instead of in the middle of structured regions. Users can specify gap penalties, choose between a number of scoring matrices, or supply their own scoring matrix for both the pairwise alignments and the multiple alignments. CLUSTAL W for UNIX and VMS systems is available at: ftp.ebi.ac.uk. Another program is MACAW (Schuler et al., *Proteins, Struct. Func. Genet,* 9:180-190 (1991), the entirety of which is herein incorporated by reference, for which both Macintosh and Microsoft Windows versions are available. MACAW uses a graphical interface, provides a choice of several alignment algorithms, and is available by anonymous ftp at: ncbi.nlm.nih.gov (directory/pub/macaw).

Sequence motifs are derived from multiple alignments and can be used to examine individual sequences or an entire database for subtle patterns. With motifs, it is sometimes possible to detect distant relationships that may not be demonstrable based on comparisons of primary sequences alone. Currently, the largest collection of sequence motifs in the world is PROSITE (Bairoch and Bucher, *Nucleic Acid Research,* 22: 3583-3589 (1994), the entirety of which is herein incorporated by reference.) PROSITE may be accessed via either the ExPASy server on the World Wide Web or anonymous ftp site. Many commercial sequence analysis packages also provide search programs that use PROSITE data.

A resource for searching protein motifs is the BLOCKS E-mail server developed by S. Henikoff, *Trends Biochem Sci.,* 18:267-268 (1993), the entirety of which is herein incorporated by reference; Henikoff and Henikoff, *Nucleic Acid Research,* 19:6565-6572 (1991), the entirety of which is herein incorporated by reference; Henikoff and Henikoff, *Proteins,* 17: 49-61 (1993). BLOCKS searches a protein or nucleotide sequence against a database of protein motifs or "blocks." Blocks are defined as short, ungapped multiple alignments that represent highly conserved protein patterns. The blocks themselves are derived from entries in PROSITE as well as other sources. Either a protein or nucleotide query can be submitted to the BLOCKS server; if a nucleotide sequence is submitted, the sequence is translated in all six reading frames and motifs are sought in these conceptual translations. Once the search is completed, the server will return a ranked list of significant matches, along with an alignment of the query sequence to the matched BLOCKS entries.

Conserved protein domains can be represented by two-dimensional matrices, which measure either the frequency or probability of the occurrences of each amino acid residue and deletions or insertions in each position of the domain. This type of model, when used to search against protein databases, is sensitive and usually yields more accurate results than simple motif searches. Two popular implementations of this approach are profile searches (such as GCG program ProfileSearch) and Hidden Markov Models (HMMs) (Krough et al., *J. Mol. Biol.* 235:1501-1531 (1994); Eddy, *Current Opinion in Structural Biology* 6:361-365 (1996), both of which are herein incorporated by reference in their entirety). In both cases, a large number of common protein domains have been converted into profiles, as present in the PROSITE library, or HHM models, as in the Pfam protein domain library (Sonnhammer et al., *Proteins* 28:405-420 (1997), the entirety of which is herein incorporated by reference). Pfam contains more than 500 HMM models for enzymes, transcription factors, signal transduction molecules, and structural proteins. Protein databases can be queried with these profiles or HMM models, which will identify proteins containing the domain of interest. For example, HMMSW or HMMFS, two programs in a public domain package called HMMER (Sonnhammer et al., *Proteins* 28:405-420 (1997)) can be used.

PROSITE and BLOCKS represent collected families of protein motifs. Thus, searching these databases entails submitting a single sequence to determine whether or not that sequence is similar to the members of an established family. Programs working in the opposite direction compare a collection of sequences with individual entries in the protein databases. An example of such a program is the Motif Search Tool, or MoST (Tatusov et al. *Proc. Natl. Acad. Sci.* 91: 12091-12095 (1994), the entirety of which is herein incorporated by reference.) On the basis of an aligned set of input sequences, a weight matrix is calculated by using one of four methods (selected by the user); a weight matrix is simply a representation, position by position in an alignment, of how likely a particular amino acid will appear. The calculated weight matrix is then used to search the databases. To increase sensitivity, newly found sequences are added to the original data set, the weight matrix is recalculated, and the search is performed again. This procedure continues until no new sequences are found.

SUMMARY OF THE INVENTION

The present invention provides a substantially purified nucleic acid molecule that encodes a maize protein or fragment thereof comprising a nucleic acid sequence selected from the group consisting of SEQ ID NO: 1 through SEQ ID NO: 17472.

The present invention also provides one or more substantially purified nucleic acid molecules comprising a nucleic acid sequence selected from the group consisting of SEQ ID NO: 1 through SEQ ID NO:17472 or complements thereof.

The present invention also provides a substantially purified maize protein or fragment thereof, wherein said maize protein is encoded by a nucleic acid molecule that comprises a nucleic acid sequence selected from the group consisting of SEQ ID NO: 1 through SEQ ID NO: 17472.

The present invention further provides a substantially purified protein, peptide, or fragment thereof encoded by a nucleic acid sequence which specifically hybridizes to a nucleic acid molecule comprising a nucleic acid sequence selected from the group consisting of a complement of SEQ ID NO: 1 through SEQ ID NO:17472.

The present invention further provides a substantially purified antibody capable of specifically binding to a protein or fragment thereof encoded by a nucleic acid sequence which specifically hybridizes to a nucleic acid molecule having a nucleic acid sequence selected from the group consisting of a complement of SEQ ID NO:1 through SEQ ID NO:17472.

The present invention also provides a transformed plant transformed to contain a nucleic acid molecule which comprises: (A) an exogenous promoter region which functions in plant cells to cause the production of an mRNA molecule; which is linked to (B) a structural nucleic acid molecule, wherein said structural nucleic acid molecule comprises a nucleic acid molecule that encodes a protein, peptide, or fragment thereof which hybridizes to a nucleic acid sequence selected from the group consisting of a complement of SEQ ID NO:1 through SEQ ID NO:17472 expressed in an effective amount to produce a desirable agronomic effect; which is linked to (C) a 3' non-translated sequence that functions in plant cells to cause the termination of transcription and the addition of polyadenylated ribonucleotides to the 3' end of the mRNA sequence.

The present invention also provides a transformed plant cell containing a nucleic acid molecule whose non-transcribed strand encodes a protein or fragment thereof, wherein the transcribed strand of said nucleic acid is complementary to a nucleic acid molecule that encodes a protein or fragment thereof. The present invention also provides bacterial, viral, microbial, and plant cells comprising a nucleic acid molecule of the present invention The present invention also provides a method of producing a plant containing one or more proteins encoded by sequences comprising SEQ ID NO:1 or complement thereof through SEQ ID NO:17472 or complements thereof, expressed in a sufficient amount and/or fashion to produce a desirable agronomic effect.

In accomplishing the foregoing, there is provided, in accordance with one aspect of the present invention, methods of producing genetically transformed plants, comprising the steps of:

- (a) inserting into the genome of a plant cell a recombinant, double-stranded DNA molecule comprising
  - (i) a promoter which functions in plant cells to cause the production of an RNA sequence,
  - (ii) a structural DNA sequence that causes the production of an RNA sequence which encodes a desired protein.
  - (iii) a 3' non-translated DNA sequence which functions in plant cells to cause the addition of polyadenylated nucleotides to the 3' end of RNA sequence; where the promoter is homologous or heterologous with respect to the coding sequence and adapted to cause sufficient expression of a protein in desired plant tissues to enhance the agronomic utility of a plant transformed with said gene.
- (b) obtaining a transformed plant cell with said nucleic acid molecule that encodes one or more proteins, wherein said nucleic acid molecule is transcribed and results in expression of said protein(s); and
- (c) regenerating from the transformed plant cell a genetically transformed plant The present invention also encompasses differentiated plants, seeds, and progeny comprising said transformed plant cells and which exhibit novel properties of agronomic significance.

The present invention also provides a method of producing a plant containing reduced levels of a protein comprising: (A) transforming a plant cell with a nucleic acid molecule that encodes a protein, wherein said nucleic acid molecule is transcribed and results in co-suppression of endogenous protein synthesis activity, and (B) regenerating plants and producing subsequent progeny from the transformed plant.

The present invention also provides a method of determining an association between a polymorphism and a plant trait comprising: (A) hybridizing a nucleic acid molecule specific for a polymorphism to genetic material of a plant, wherein said nucleic acid molecule comprising a nucleic acid sequence selected from the group consisting of SEQ ID NO: 1 through SEQ ID NO:17472 or complements thereof; and (B) calculating the degree of association between the polymorphism and the plant trait.

The present invention also provides a method of isolating a genetic region, or nucleic acid that encodes a protein or fragment thereof comprising: (A) incubating under conditions permitting nucleic acid hybridization: a marker nucleic acid molecule, preferably an EST, with a complementary nucleic acid molecule obtained from a plant cell or plant tissue; (B) permitting hybridization between said marker nucleic acid molecule, preferably an EST, and said complementary nucleic acid molecule obtained from said plant cell or plant tissue; and (C) isolating said complementary nucleic acid molecule.

The present invention also provides a method for determining a level or pattern in a plant cell of a protein in a plant comprising: (A) incubating, under conditions permitting nucleic acid hybridization, a marker nucleic acid molecule, the marker nucleic acid molecule selected from the group of marker nucleic acid molecules which specifically hybridize to a nucleic acid molecule having the nucleic acid sequence selected from the group consisting of SEQ ID NO: 1 through SEQ ID NO: 17472 or complements thereof or fragments of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of an mRNA for the enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the protein.

The present invention also provides a method for determining the level or pattern of a protein in a plant cell or plant tissue comprising: (A) incubating under conditions permitting nucleic acid hybridization: a marker nucleic acid molecule, the marker nucleic acid molecule comprising a nucleotide sequence selected from the group consisting of SEQ ID NO: 1 through SEQ ID NO:17472 or complements thereof, with a complementary nucleic acid molecule obtained from a plant cell or plant tissue, wherein nucleic acid hybridization between the marker nucleic acid molecule, and the complementary nucleic acid molecule obtained from the plant cell or plant tissue permits the detection of said protein; (B) permitting hybridization between the marker nucleic acid molecule and the complementary nucleic acid molecule obtained from the plant cell or plant tissue; and (C) detecting the level or pattern of the complementary nucleic acid, wherein the detection of said complementary nucleic acid is predictive of the level or pattern of the protein synthesis.

The present invention also provides a method for determining a level or pattern of a protein in a plant cell or plant tissue which comprises assaying the concentration of a molecule, whose concentration is dependent upon the expression of a gene, the gene having a nucleic acid sequence which specifically hybridizes to a protein marker nucleic acid molecule, the molecule being present in a plant cell or plant tissue, in comparison to the concentration of that molecule present in a plant cell or plant tissue with a known level or pattern of said protein, wherein an assayed concentration of the molecule is compared to the assayed concentration of the molecule in a plant cell or plant tissue with a known level or pattern of said protein.

The present invention also provides a method of determining a mutation in a plant whose presence is predictive of a mutation affecting a level or pattern of a protein comprising the steps: (A) incubating, under conditions permitting nucleic acid hybridization, a marker nucleic acid, the marker nucleic acid selected from the group of marker nucleic acid molecules which specifically hybridize to a nucleic acid molecule consisting of the nucleic acid sequence selected from the group consisting of SEQ ID NO: 1 through SEQ ID NO: 17472 or complements thereof or fragments of either and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the protein in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method for determining a mutation in a plant whose presence is predictive of a mutation affecting the level or pattern of protein synthesis comprising the steps: (A) incubating under conditions permitting nucleic acid hybridization: a marker nucleic acid molecule, the marker nucleic acid molecule comprising a nucleic acid molecule that is linked to gene, the gene having a nucleic acid sequence which specifically hybridizes to a sequence selected from the group consisting of SEQ ID NO: 1 through SEQ ID NO:17472 and complements thereof, and a complementary nucleic acid molecule obtained from a plant tissue or plant cell of the plant, wherein nucleic acid hybridization between the marker nucleic acid molecule and the complementary nucleic acid molecule obtained from the plant permits the detection of a polymorphism whose presence is predictive of a mutation affecting said level or pattern of a protein synthesis in the plant; (B) permitting hybridization between said marker nucleic acid molecule and said complementary nucleic acid molecule obtained from said plant; and; (C) detecting the presence of the polymorphism, wherein the detection of the polymorphism is predictive of the mutation.

The present invention also provides a method for reducing expression of a protein in a plant cell, the method comprising: growing a transformed plant cell containing a nucleic acid molecule whose non-transcribed strand encodes a protein or fragment thereof, wherein the transcribed strand of said nucleic acid is complementary to a nucleic acid molecule that encodes the protein in said plant cell, and whereby the strand that is complementary to the nucleic acid molecule that encodes the protein reduces or depresses expression of the protein.

The present invention provides maize nucleic acid molecules for use as molecular tags to isolate genetic regions (i.e. promoters and flanking sequences), isolate genes, map genes, and determine gene function. The present invention further provides maize nucleic acid molecules for use in determining if genes are members of a particular gene family.

The present invention also provides a method of obtaining full length genes using maize ESTs or complements thereof or fragments of either.

The present invention also provides a method of isolating promoters and flanking sequences using maize ESTs or complements thereof or fragments of either.

The present invention also provides maize ESTs or complements thereof or fragments of either for use in marker-assisted breeding programs.

The present invention also provides a method of identifying tissues comprising hybridizing nucleic acids from the tissue with maize ESTs or complements thereof or fragments of either.

The present invention also provides a method for production of antibodies targeted against the proteins, peptides, or fragments produced by the disclosed or complements thereof or fragments of either.

The present invention also provides a method for the transformation and regeneration of plants comprising sequences hybridizable to the disclosed ESTs or complements thereof or fragments of either.

The present invention also provides a method of modifying plant protein expression by inserting in a chimeric gene sense or antisense constructs of the maize ESTs.

DETAILED DESCRIPTION OF THE INVENTION

Agents (a) Nucleic Acid Molecules

Agents of the present invention include nucleic acid molecules and more specifically EST nucleic acid molecules or nucleic acid fragment molecules thereof. Fragment EST nucleic acid molecules may encode significant portion(s) of, or indeed most of, the EST nucleic acid molecule. Alternatively, the fragments may comprise smaller oligonucleotides (having from about 15 to about 250 nucleotide residues, and more preferably, about 15 to about 30 nucleotide residues).

A subset of the nucleic acid molecules of the present invention includes nucleic acid molecules that are marker molecules. Another subset of the nucleic acid molecules of the present invention include nucleic acid molecules that encode a protein or fragment thereof. Another subset of the nucleic acid molecules of the present invention are EST molecules.

The term "substantially purified", as used herein, refers to a molecule separated from substantially all other molecules normally associated with it in its native state. More preferably a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "substantially purified" is not intended to encompass molecules present in their native state.

The agents of the present invention will preferably be "biologically active" with respect to either a structural attribute, such as the capacity of a nucleic acid to hybridize to another nucleic acid molecule, or the ability of a protein to be bound by antibody (or to compete with another molecule for such binding). Alternatively, such an attribute may be catalytic, and thus involve the capacity of the agent to mediate a chemical reaction or response.

The agents of the present invention may also be recombinant. As used herein, the term recombinant, refers to a) molecules that are constructed outside of living cells by joining natural or synthetic DNA segments to DNA molecules that can replicate in a living cell or b) molecules that result from the replication or expression of those molecules described above or c) amino acid molecules from different sources which are joined together.

It is understood that the agents of the present invention may be labeled with reagents that facilitate detection of the agent (e.g. fluorescent labels (Prober, et al., *Science* 238:336-340 (1987); Albarella et al., EP 144914, chemical labels (Sheldon et al., U.S. Pat. No. 4,582,789; Albarella et al., U.S. Pat. No. 4,563,417, modified bases (Miyoshi et al., EP 119448, all of which are hereby incorporated by reference in their entirety).

It is further understood, that the present invention provides bacterial, viral, microbial, and plant cells comprising the agents of the present invention.

Nucleic acid molecules or fragment thereof of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook, et al., In: *Molecular Cloning, A Laboratory Manual, 2nd Edition,* Cold Spring Harbor Press, Cold Spring Harbor, N.Y. (1989), and by Haymes, et al. In: *Nucleic Acid Hybridization, A Practical Approach*, IRL Press, Washington, D.C. (1985), the entirety of which is herein incorporated by reference. Departures from complete complementarity are therefore permissible, as long as such departures do not completely preclude the capacity of the molecules to form a double-stranded structure. Thus, in order for an nucleic acid molecule or fragment of the present invention to serve as a primer or probe it need only be sufficiently complementary in sequence to be able to form a stable double-stranded structure under the particular solvent and salt concentrations employed.

Appropriate stringency conditions which promote DNA hybridization are, for example, 6.0×sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the present invention will specifically hybridize to one or more of the nucleic acid molecules set forth in SEQ ID NO: 1 through SEQ ID NO: 17472 or complements thereof under moderately stringent conditions, for example, at about 2.0×SSC and about 65° C.

In a particularly preferred embodiment, a nucleic acid of the present invention will include those nucleic acid molecules that specifically hybridize to one or more of the nucleic acid molecules set forth in SEQ ID NO:1 through SEQ ID NO: 17472 or complements thereof under high stringency conditions.

In one aspect of the present invention, the nucleic acid molecules of the present invention have one or more of the nucleic acid sequences set forth in SEQ ID NO: 1 through SEQ ID NO:17472 or complements thereof. In another aspect of the present invention, one or more of the nucleic acid molecules of the present invention share between 100% and 90% sequence identity with one or more of the nucleic acid sequences set forth in SEQ ID NO: 1 through SEQ ID NO:17472 or complements thereof. In a further aspect of the present invention, one or more of the nucleic acid molecules of the present invention share between 100% and 95% sequence identity with one or more of the nucleic acid sequences set forth in SEQ ID NO: 1 through SEQ ID NO:17472 or complements thereof. In a more preferred aspect of the present invention, one or more of the nucleic acid molecules of the present invention share between 100% and 98% sequence identity with one or more of the nucleic acid sequences set forth in SEQ ID NO: 1 through SEQ ID NO:17472 or complements thereof. In an even more preferred aspect of the present invention, one or more of the nucleic acid molecules of the present invention share between 100% and 99% sequence identity with one or more of the sequences set forth in SEQ ID NO: 1 through SEQ ID NO:17472 or complements thereof. In a further, even more preferred aspect of the present invention, one or more of the nucleic acid molecules of the present invention exhibit 100% sequence identity with one or more nucleic acid molecules present within the cDNA libraries designated LIB3179, LIB3227, LIB3228, and LIB3279 (Monsanto Company, St. Louis, Mo., United States of America).

The term "sequence identity" refers to the extent to which two sequences, nucleotide or amino acid, are invariant throughout the portion at which they are aligned. While there exist a number of methods to measure identity between two polynucleotide or polypeptide sequences, the term "sequence identity" is well known to skilled artisans. Methods commonly employed to determine identity between two sequences include, but are not limited to, those disclosed in *Guide to Huge Computers*, Martin J. Bishop, ed., Academic Press, San Diego, 1994, and Carillo, H., and Lipton, D.; Siam, J *Applied Math* (1988) 48:1073. Methods to determine identity are codified in computer programs. Preferred computer program methods to determine identity between two sequences include, but are not limited to, the BLAST suite of programs publicly available from NCBI and other sources (*BLAST Manual*, Altschul et al., Natl. Cent. Biotechnol. Inf., Natl. Library Med. (NCBI NLM) NIH, Bethesda, Md. 20894; Altschul et al., *J. Mol. Biol.* 215:403-410 (1990), Pearson et al., Proc. Natl. Acad. Sci. U.S.A. 85:2444-2448 (1988), the FAST programs (Pearson et al., *Proc. Natl. Acad. Sci. U.S.A.* 85:2444-2448 (1988). the GAP and BESTFIT programs found in the GCG program package, (Madison, Wis.) and Cross_Match (Phi Green, University of Washington). Another preferred method to determine identity, is by the method of DNASTAR protein alignment protocol using the Jotun-Hein algorithm (Hein et al., *Methods Enzymol.* 183: 626-645 (1990)).

In a preferred embodiment of the present invention, a maize protein or fragment thereof of the present invention is a homologue of another plant protein. In another preferred embodiment of the present invention, a maize protein or fragment thereof of the present invention is a homologue of a fungal protein. In another preferred embodiment of the present invention, a maize protein or fragment thereof of the present invention is a homologue of a mammalian protein. In another preferred embodiment of the present invention, a maize protein or fragment thereof of the present invention is a homologue of an algal protein. In another preferred embodiment of the present invention, a maize protein or fragment thereof of the present invention is a homologue of a bacterial protein. In another preferred embodiment of the present invention, a maize protein or fragment thereof of the present invention is a homologue of a soybean protein. In another preferred embodiment of the present invention, a maize protein or fragment thereof of the present invention is a homologue of a cotton protein. In another preferred embodiment of the present invention, a maize protein or fragment thereof of the present invention is a homologue of a wheat protein.

In a preferred embodiment of the present invention, the nucleic molecule of the present invention encodes a maize protein or fragment thereof where a maize protein or fragment thereof exhibits a BLAST probability score of greater than 1E-12, preferably a BLAST probability score of between about 1E-30 and about 1E-12, even more preferably a BLAST probability score of greater than 1E-30 with its homologue.

In another preferred embodiment of the present invention, the nucleic acid molecule encoding a maize protein or fragment thereof exhibits a % identity with its homologue of between about 25% and about 40%, more preferably of between about 40% and about 70%, even more preferably of between about 70% and about 90% and even more preferably between about 90% and 99%. In another preferred embodiment, of the present invention, a maize protein or fragment thereof exhibits a % identity with its homologue of 100%.

In a preferred embodiment of the present invention, the nucleic acid molecule of the present invention encodes a maize protein or fragment thereof where the maize protein exhibits a BLAST score of greater than 120, preferably a BLAST score of between about 1450 and about 120, even more preferably a BLAST score of greater than 1450 with its homologue.

Nucleic acid molecules of the present invention also include non-maize homologues. Preferred non-maize homologues are selected from the group consisting of alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, soybean, strawberry, sugarcane, sugarbeet, tomato, wheat, poplar, pine, fir, eucalyptus, apple, lettuce, lentils, grape, banana, tea, turf grasses, sunflower, oil palm and *Phaseolus*.

The degeneracy of the genetic code, which allows different nucleic acid sequences to code for the same protein or peptide, is known in the literature. (U.S. Pat. No. 4,757,006, the entirety of which is herein incorporated by reference).

In an aspect of the present invention, one or more of the nucleic acid molecules of the present invention differ in nucleic acid sequence from those encoding a maize protein or fragment thereof in SEQ ID NO: 1 through SEQ ID NO: 17472 due to the degeneracy in the genetic code in that they encode the same protein but differ in nucleic acid sequence.

In another further aspect of the present invention, nucleic acid molecules of the present invention can comprise sequences, which differ from those encoding a protein or fragment thereof in SEQ ID NO: 1 through SEQ ID NO: 17472 due to fact that the different nucleic acid sequence encodes a protein having one or more conservative amino acid changes. It is understood that codons capable of coding for such conservative amino acid substitutions are known in the art.

It is well known in the art that one or more amino acids in a native sequence can be substituted with another amino acid(s), the charge and polarity of which are similar to that of the native amino acid, i.e., a conservative amino acid substitution, resulting in a silent change. Conserved substitutes for an amino acid within the native polypeptide sequence can be selected from other members of the class to which the naturally occurring amino acid belongs. Amino acids can be divided into the following four groups: (1) acidic amino acids, (2) basic amino acids, (3) neutral polar amino acids, and (4) neutral nonpolar amino acids. Representative amino acids within these various groups include, but are not limited to, (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, cystine, tyrosine, asparagine, and glutamine; and (4) neutral nonpolar (hydrophobic) amino acids such as alanine, leucine, isoleucine, valine, proline, phenylalanine, tryptophan, and methionine.

Conservative amino acid changes within the native polypeptides sequence can be made by substituting one amino acid within one of these groups with another amino acid within the same group. Biologically functional equivalents of the proteins or fragments thereof of the present invention can have 10 or fewer conservative amino acid changes, more preferably seven or fewer conservative amino acid changes, and most preferably five or fewer conservative amino acid changes. The encoding nucleotide sequence will thus have corresponding base substitutions, permitting it to encode biologically functional equivalent forms of the proteins or fragments of the present invention.

It is understood that certain amino acids may be substituted for other amino acids in a protein structure without appreciable loss of interactive binding capacity with structures such as, for example, antigent-binding regions of antibodies or binding sites on substrate molecules. Because it is the interactive capacity and nature of a protein that defines that protein's biological functional activity, certain amino acid sequence substitutions can be made in a protein sequence and, of course, its underlying DNA coding sequence and, nevertheless, obtain a protein with like properties. It is thus contemplated by the inventors that various changes may be made in the peptide sequences of the proteins or fragments of the present invention, or corresponding DNA sequences that encode said peptides, without appreciable loss of their biological utility or activity. It is understood that codons capable of coding for such amino acid changes are known in the art.

In making such changes, the hydropathic index of amino acids may be considered. The importance of the hydropathic amino acid index in conferring interactive biological function on a protein is generally understood in the art (Kyte and Doolittle, *J. Mol. Biol.* 157, 105-132 (1982), herein incorporated by reference in its entirety). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

Each amino acid has been assigned a hydropathic index on the basis of its hydrophobicity and charge characteristics (Kyte and Doolittle, 1982); these are isoleucine (+4.5), valine (+4.2), leucine (+3.8), phenylalanine (+2.8), cysteine/cystine (+2.5), methionine (+1.9), alanine (+1.8), glycine (−0.4), threonine (−0.7), serine (−0.8), tryptophan (−0.9), tyrosine (−1.3), proline (−1.6), histidine (−3.2), glutamate (−3.5), glutamine (−3.5), aspartate (−3.5), asparagine (−3.5), lysine (−3.9), and arginine (−4.5).

In making such changes, the substitution of amino acids whose hydropathic indices are within ±2 is preferred, those which are within ±1 are particularly preferred, and those within ±0.5 are even more particularly preferred.

It is also understood in the art that the substitution of like amino acids can be made effectively on the basis of hydrophilicity. U.S. Pat. No. 4,554,101, incorporated herein by reference in its entirety, states that the greatest local average hydrophilicity of a protein, as govern by the hydrophilicity of its adjacent amino acids, correlates with a biological property of the protein.

As detailed in U.S. Pat. No. 4,554,101, the following hydrophilicity values have been assigned to amino acid residues: arginine (+3.0), lysine (+3.0), aspartate (+3.0±1), glutamate (+3.0±1), serine (+0.3), asparagine (+0.2), glutamine (+0.2), glycine (0), threonine (−0.4), proline (−0.5±1), alanine (−0.5), histidine (−0.5), cysteine (−1.0), methionine (−1.3), valine (−1.5), leucine (−1.8), isoleucine (−1.8), tyrosine (−2.3), phenylalanine (−2.5), and tryptophan (−3.4).

In making such changes, the substitution of amino acids whose hydrophilicity values are within ±2 is preferred, those which are within ±1 are particularly preferred, and those within ±0.5 are even more particularly preferred.

In a further aspect of the present invention, one or more of the nucleic acid molecules of the present invention differ in nucleic acid sequence from those encoding a maize protein or fragment thereof set forth in SEQ ID NO: 1 through SEQ ID NO: 17472 or fragment thereof due to the fact that one or more codons encoding an amino acid has been substituted for a codon that encodes a nonessential substitution of the amino acid originally encoded.

One aspect of the present invention concerns markers that include nucleic acid molecules SEQ ID NO: 1 through SEQ ID NO: 17472 or complements thereof or fragments of either that can act as markers or other nucleic acid molecules of the present invention that can act as markers. Genetic markers of the present invention include "dominant" or "codominant" markers "Codominant markers" reveal the presence of two or more alleles (two per diploid individual) at a locus. "Dominant markers" reveal the presence of only a single allele per locus. The presence of the dominant marker phenotype (e.g., a band of DNA) is an indication that one allele is present in either the homozygous or heterozygous condition. The absence of the dominant marker phenotype (e.g. absence of a DNA band) is merely evidence that "some other" undefined allele is present. In the case of populations where individuals are predominantly homozygous and loci are predominately dimorphic, dominant and codominant markers can be equally valuable. As populations become more heterozygous and multi-allelic, codominant markers often become more informative of the genotype than dominant markers. Marker molecules can be, for example, capable of detecting polymorphisms such as single nucleotide polymorphisms (SNPs).

SNPs are single base changes in genomic DNA sequence. They occur at greater frequency and are spaced with a greater uniformity throughout a genome than other reported forms of polymorphism. The greater frequency and uniformity of SNPs means that there is greater probability that such a polymorphism will be found near or in a genetic locus of interest than would be the case for other polymorphisms. SNPs are located in protein-coding regions and noncoding regions of a genome. Some of these SNPs may result in defective or variant protein expression (e.g., as a results of mutations or defective splicing). Analysis (genotyping) of characterized SNPs can require only a plus/minus assay rather than a lengthy measurement, permitting easier automation.

SNPs can be characterized using any of a variety of methods. Such methods include the direct or indirect sequencing of the site, the use of restriction enzymes (Botstein et al., *Am. J. Hum. Genet.* 32:314-331 (1980), the entirety of which is herein incorporated reference; Konieczny and Ausubel, *Plant J.* 4:403-410 (1993), the entirety of which is herein incorporated by reference), enzymatic and chemical mismatch assays (Myers et al., *Nature* 313:495-498(1985), the entirety of which is herein incorporated by reference), allele-specific PCR (Newton et al., *Nucl. Acids Res.* 17:2503-2516 (1989), the entirety of which is herein incorporated by reference; Wu et al., *Proc. Natl. Acad. Sci.* (*U.S.A.*) 86:2757-2760 (1989), the entirety of which is herein incorporated by reference), ligase chain reaction (Barany, *Proc. Natl. Acad. Sci.* (*U.S.A.*) 88:189-193 (1991), the entirety of which is herein incorporated by reference), single-strand conformation polymorphism analysis (Labrune et al., *Am. J. Hum. Genet.* 48: 1115-1120(1991), the entirety of which is herein incorporated by reference), primer-directed nucleotide incorporation assays (Kuppuswami et al., *Proc. Natl. Acad. Sci. USA* 88:1143-1147 (1991), the entirety of which is herein incorporated by reference), dideoxy fingerprinting (Sarkar et al., *Genomics* 13:441-443 (1992), the entirety of which is herein incorporated by reference), solid-phase ELISA-based oligonucleotide ligation assays (Nikiforov et al., *Nucl. Acids Res.* 22:4167-4175 (1994), the entirety of which is herein incorporated by reference), oligonucleotide fluorescence-quenching assays (Livak et al., *PCR Methods Appl.* 4:357-362 (1995), the entirety of which is herein incorporated by reference), 5'-nuclease allele-specific hybridization TAQMAN® assay (Livak et al., *Nature Genet.* 9:341-342 (1995), the entirety of which is herein incorporated by reference), template-directed dye-terminator incorporation (TDI) assay (Chen and Kwok, *Nucl. Acids Res.* 25:347-353 (1997), the entirety of which is herein incorporated by reference), allele-specific molecular beacon assay (Tyagi et al., *Nature Biotech.* 16: 49-53 (1998), the entirety of which is herein incorporated by reference), PinPoint assay (Haff and Smirnov, *Genome Res.* 7: 378-388 (1997), the entirety of which is herein incorporated by reference) and dCAPS analysis (Neff et al., *Plant J.* 14:387-392 (1998), the entirety of which is herein incorporated by reference).

Additional markers, such as AFLP markers, RFLP markers and RAPD markers, can be utilized (Walton, *Seed World* 22-29 (July, 1993), the entirety of which is herein incorporated by reference; Burow and Blake, *Molecular Dissection of Complex Traits,* 13-29, Paterson (ed.), CRC Press, New York (1988), the entirety of which is herein incorporated by reference). DNA markers can be developed from nucleic acid molecules using restriction endonucleases, the PCR and/or DNA sequence information. RFLP markers result from single base changes or insertions/deletions. These codominant markers are highly abundant in plant genomes, have a medium level of polymorphism and are developed by a combination of restriction endonuclease digestion and Southern blotting hybridization. CAPS are similarly developed from restriction nuclease digestion but only of specific PCR products. These markers are also codominant, have a medium level of polymorphism and are highly abundant in the genome. The CAPS result from single base changes and insertions/deletions.

Another marker type, RAPDs, are developed from DNA amplification with random primers and result from single base changes and insertions/deletions in plant genomes. They are dominant markers with a medium level of polymorphisms and are highly abundant. AFLP markers require using the PCR on a subset of restriction fragments from extended adapter primers. These markers are both dominant and codominant are highly abundant in genomes and exhibit a medium level of polymorphism.

SSRs require DNA sequence information. These codominant markers result from repeat length changes, are highly polymorphic and do not exhibit as high a degree of abundance in the genome as CAPS, AFLPs and RAPDs, SNPs also require DNA sequence information. These codominant markers result from single base substitutions. They are highly abundant and exhibit a medium of polymorphism (Rafalski et al., In: *Nonmammalian Genomic Analysis*, Birren and Lai (ed.), Academic Press, San Diego, Calif., pp. 75-134 (1996), the entirety of which is herein incorporated by reference). It is understood that a nucleic acid molecule of the present invention may be used as a marker.

A PCR probe is a nucleic acid molecule capable of initiating a polymerase activity while in a double-stranded structure with another nucleic acid. Various methods for determining the structure of PCR probes and PCR techniques exist in the art. Computer generated searches using programs such as Primer3 (available on the Worldwide Web at genome.wi.mit.edu/cgi-bin/primer/primer3.cgi), STSPipeline (available on the Worldwide Web at genome.wi.mit.edu/cgi-bin/www-STS_Pipeline), or GeneUp (Pesole et al., *BioTechniques* 25:112-123 (1998) the entirety of which is herein incorporated by reference), for example, can be used to identify potential PCR primers.

It is understood that a fragment of one or more of the nucleic acid molecules of the present invention may be a probe and specifically a PCR probe.

(b) Protein and Peptide Molecules

A class of agents comprises one or more of the protein or peptide molecules encoded by SEQ ID NO: 1 through SEQ ID NO:17472 or one or more of the protein or fragment thereof or peptide molecules encoded by other nucleic acid agents of the present invention. As used herein, the term "protein molecule" or "peptide molecule" includes any molecule that comprises five or more amino acids. It is well know in the art that proteins may undergo modification, including post-translational modifications, such as, but not limited to, disulfide bond formation, glycosylation, phosphorylation, or oligomerization. Thus, as used herein, the term "protein molecule" or "peptide molecule" includes any protein molecule that is modified by any biological or non-biological process. The terms "amino acid" and "amino acids" refer to all naturally occurring L-amino acids. This definition is meant to include norleucine, ornithine, homocysteine, and homoserine.

One or more of the protein or fragment of peptide molecules may be produced via chemical synthesis, or more preferably, by expression in a suitable bacterial or eukaryotic host. Suitable methods for expression are described by Sambrook, et al., (In: *Molecular Cloning, A Laboratory Manual, 2nd Edition,* Cold Spring Harbor Press, Cold Spring Harbor, N.Y. (1989)), or similar texts.

A "protein fragment" is a peptide or polypeptide molecule whose amino acid sequence comprises a subset of the amino acid sequence of that protein. A protein or fragment thereof that comprises one or more additional peptide regions not derived from that protein is a "fusion" protein. Such molecules may be derivatized to contain carbohydrate or other moieties (such as keyhole limpet hemocyanin, etc.). Fusion protein or peptide molecule of the present invention are preferably produced via recombinant means.

Another class of agents comprise protein or peptide molecules encoded by SEQ ID NO: 1 through SEQ ID NO:17472 or complements thereof or, fragments or fusions thereof in which non-essential, or not relevant, amino acid residues have been added, replaced, or deleted. An example of such a homologue is the homologue protein of all non-maize plant species, including but not limited to alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, soybean, strawberry, sugarcane, sugarbeet, tomato, wheat, poplar, pine, fir, eukalyptus, apple, lettuce, peas, lentils, grape, banana, tea, turf grasses, etc. Particularly preferred non-maize plants to utilize for the isolation of homologues would include alfalfa, *Arabidopsis*, barley, cotton, oat, oilseed rape, rice, canola, ornamentals, soybean, sugarcane, sugarbeet, tomato, potato, wheat, and turf grasses. Such a homologue can be obtained by any of a variety of methods. Most preferably, as indicated above, one or more of the disclosed sequences (SEQ ID NO: 1 through SEQ ID NO:17472 or complements thereof) will be used to define a pair of primers that may be used to isolate the homologue-encoding nucleic acid molecules from any desired species. Such molecules can be expressed to yield homologues by recombinant means.

(c) Antibodies

One aspect of the present invention concerns antibodies, single-chain antigen binding molecules, or other proteins that specifically bind to one or more of the protein or peptide molecules of the present invention and their homologues, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules.

Nucleic acid molecules that encode all or part of the protein of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal, and may comprise intact immunoglobulins, or antigen binding portions of immunoglobulins (such as (F(ab'), $F(ab')_2$) fragments, or single-chain immunoglobulins producible, for example, via recombinant means). It is understood that practitioners are familiar with the standard resource materials which describe specific conditions and procedures for the construction, manipulation and isolation of antibodies (see, for example, Harlow and Lane, In *Antibodies: A Laboratory Manual*, Cold Spring Harbor Press, Cold Spring Harbor, N.Y. (1988), the entirety of which is herein incorporated by reference).

Murine monoclonal antibodies are particularly preferred. BALB/c mice are preferred for this purpose, however, equivalent strains may also be used. The animals are preferably immunized with approximately 25 μg of purified protein (or fragment thereof) that has been emulsified a suitable adjuvant (such as TiterMax adjuvant (Vaxcel, Norcross, Ga.)). Immunization is preferably conducted at two intramuscular sites, one intraperitoneal site, and one subcutaneous site at the base of the tail. An additional i.v. injection of approximately 25 μg of antigen is preferably given in normal saline three weeks later. After approximately 11 days following the second injection, the mice may be bled and the blood screened for the presence of anti-protein or peptide antibodies. Preferably, a direct binding Enzyme-Linked Immunoassay (ELISA) is employed for this purpose.

More preferably, the mouse having the highest antibody titer is given a third i.v. injection of approximately 25 μg of the same protein or fragment. The splenic leukocytes from this animal may be recovered 3 days later, and are then permitted to fuse, most preferably, using polyethylene glycol, with cells of a suitable myeloma cell line (such as, for example, the P3X63Ag8.653 myeloma cell line). Hybridoma cells are selected by culturing the cells under "HAT" (hypoxanthine-aminopterin-thymine) selection for about one week. The resulting clones may then be screened for their capacity to produce monoclonal antibodies ("mAbs), preferably by direct ELISA.

In one embodiment, anti-protein or peptide monoclonal antibodies are isolated using a fusion of a protein, protein fragment, or peptide of the present invention, or conjugate of a protein, protein fragment, or peptide of the present invention, as immunogens. Thus, for example, a group of mice can be immunized using a fusion protein emulsified in Freund's complete adjuvant (e.g. approximately 50 μg of antigen per immunization). At three week intervals, an identical amount of antigen is emulsified in Freund's incomplete adjuvant and used to immunize the animals. Ten days following the third immunization, serum samples are taken and evaluated for the presence of antibody. If antibody titers are too low, a fourth booster can be employed. Polysera capable of binding the protein or peptide can also be obtained using this method.

In a preferred procedure for obtaining monoclonal antibodies, the spleens of the above-described immunized mice are removed, disrupted, and immune splenocytes are isolated over a ficoll gradient. The isolated splenocytes are fused, using polyethylene glycol with BALB/c-derived HGPRT (hypoxanthine guanine phosphoribosyl transferase) deficient P3×63×Ag8.653 plasmacytoma cells. The fused cells are plated into 96-well microtiter plates and screened for hybridoma fusion cells by their capacity to grow in culture medium supplemented with hypothanthine, aminopterin and thymidine for approximately 2-3 weeks.

Hybridoma cells that arise from such incubation are preferably screened for their capacity to produce an immunoglobulin that binds to a protein of interest. An indirect ELISA may be used for this purpose. In brief, the supernatants of hybridomas are incubated in microtiter wells that contain immobilized protein. After washing, the titer of bound immunoglobulin can be determined using, for example, a goat anti-mouse antibody conjugated to horseradish peroxidase. After additional washing, the amount of immobilized enzyme is determined (for example through the use of a chromogenic substrate). Such screening is performed as quickly as possible after the identification of the hybridoma in order to ensure that a desired clone is not overgrown by non-secreting neighbors. Desirably, the fusion plates are screened several times since the rates of hybridoma growth vary. In a preferred sub-embodiment, a different antigenic form of immunogen may be used to screen the hybridoma. Thus, for example, the splenocytes may be immunized with one immunogen, but the resulting hybridomas can be screened using a different immunogen. It is understood that any of the protein or peptide molecules of the present invention may be used to raise antibodies.

As discussed below, such antibody molecules or their fragments may be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or peptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

It is understood that any of the agents of the present invention can be substantially purified and/or be biologically active and/or recombinant.

Uses of the Agents of the Invention

The nucleic acid molecules and fragments thereof of the present invention from the cDNA library LIB3179 are isolated from jasmonic acid treated maize leaf tissue. Jasmonic acid plays a role in the response of plants to wounding and other stresses. It is one of signal compounds responsible for induction of pathogenesis-related (PR) proteins which show strong antifungal and antimicrobial activities. Therefore, the cDNA library of the present invention can enable acquisition of, including but not limited to, stress response genes and genes that regulate PR proteins. The ESTs of the present invention can also be used in isolating genes which would be involved in pathways, including but not limited to, of light and dark respiration, of $CO_2$ assimilation, and of nitrogen metabolism linked to fruiting and mobilization and distribution of nitrogen. Leaves are the main photosynthetic organs of crop plants, therefore, the ESTs of the present invention will find great use in the isolation of a variety of agronomically significant genes, including but not limited to, genes that regulate photosynthesis and respiration. Such genes are associated with plant growth, quality and yield, and could also serve as links in important developmental, metabolic, and catabolic pathways. Libraries from this tissue can enable the acquisition of a variety of agronomically significant genes involved in the synthesis and catabolism of commercially important traits. The ESTs of the present invention also can enable the acquisition of promoters and cis-regulatory elements which will be useful to express agronomically significant genes in these tissues and/or other tissues. The ESTs of the present invention also can enable the acquisition of molecular markers, which can be used in, including but not limited to, breeding schemes, genetic and molecular mapping, and cloning of agronomically significant genes.

The nucleic acid molecules and fragments thereof of the present invention from the subtractive cDNA library LIB3227 is generated from maize immature ear tissue, which is harvested from eight week old plants grown in a greenhouse. Libraries from this tissue can enable the acquisition of a variety of agronomically significant genes involved in the synthesis and catabolism of commercially important traits. The ESTs of the present invention can enable the acquisition of, including but are not limited to, non-regulatory genes and genes that regulate protein, oils, amino acids, sterols, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways. The ESTs of the present invention also can enable the acquisition of promoters and cis-regulatory elements which will be useful to express agronomically significant genes in these tissues and/or other tissues. The ESTs of the present invention also can enable the acquisition of molecular markers, which can be used in, including but not limited to, breeding schemes, genetic and molecular mapping, and cloning of agronomically significant genes.

The nucleic acid molecules and fragments thereof of the present invention from the subtractive cDNA library LIB3228 is generated from maize microspore tissue. Libraries from this tissue can enable the acquisition of a variety of agronomically significant genes involved in the synthesis and catabolism of commercially important traits. The ESTs of the present invention can enable the acquisition of, but are not limited to genes involved in reproduction, meiosis, and cell division. Such genes are associated with plant growth, quality and yield, and could also serve as links in important developmental, metabolic, and catabolic pathways. The ESTs of the present invention also can enable the acquisition of promoters and cis-regulatory elements which will be useful to express agronomically significant genes in these tissues and/or other tissues. The ESTs of the present invention also can enable the acquisition of molecular markers, which can be used in, including but not limited to, breeding schemes, genetic and molecular mapping, and cloning of agronomically significant genes.

The nucleic acid molecules and fragments thereof of the present invention from the cDNA library LIB3279 is generated from maize anthers (about 1 to 2 cm), which are harvested from greenhouse-grown plants 37 days after germination. The ESTs of the present invention can enable the acquisition of, but are not limited to genes involved in reproduction, pollen production and development, and seed production, therefore, the ESTs of the present invention will find great use in the isolation of a variety of agronomically significant genes, including but not limited to, genes that regulate microsporogenesis, meiosis, cell division, carotenoids, floral biogenesis, embryogenesis, protein, amino acids, sterols, oils, minerals, isoflavones, saponins, vitamins, tocopherols, antinutrient components, carbohydrates, starch metabolism and seed regulatory elements. Such genes are associated with plant growth, quality and yield, and could also serve as links in important developmental, metabolic, and catabolic pathways. Libraries from this tissue can enable the acquisition of a variety of agronomically significant genes involved in the synthesis and catabolism of commercially important traits. The ESTs of the present invention also can enable the acquisition of promoters and cis-regulatory elements which will be useful to express agronomically significant genes in these tissues and/or other tissues. The ESTs of the present invention also can enable the acquisition of molecular markers, which can be used in, including but not limited to, breeding schemes, genetic and molecular mapping, and cloning of agronomically significant genes.

Nucleic acid molecules and fragments thereof of the present invention may be employed to obtain other nucleic acid molecules. Such molecules include the nucleic acid molecules of other plants or other organisms (e.g., alfalfa, rice, potato, cotton, oat, rye, barley, soybean, wheat, *Arabidopsis, Brassica*, etc.) including the nucleic acid molecules that encode, in whole or in part, protein homologues of other plant species or other organisms, and sequences of genetic elements such as promoters and transcriptional regulatory elements. Such molecules can be readily obtained by using the above-described nucleic acid molecules or fragments thereof to screen cDNA or genomic libraries obtained from such plant species. Methods for forming such libraries are well known in the art. Such homologue molecules may differ in their nucleotide sequences from those found in one or more of SEQ ID NO:1 through SEQ ID NO:17472 or complements thereof because complete complementarity is not needed for stable hybridization. The nucleic acid molecules of the present invention therefore also include molecules that, although capable of specifically hybridizing with the nucleic acid molecules may lack "complete complementarity."

Any of a variety of methods may be used to obtain one or more of the above-described nucleic acid molecules (Zamechik et al., *Proc. Natl. Acad. Sci.* (*U.S.A.*) 83:4143-4146 (1986), the entirety of which is herein incorporated by reference; Goodchild et al., *Proc. Natl. Acad. Sci.* (*U.S.A.*) 85:5507-5511 (1988), the entirety of which is herein incorporated by reference; Wickstrom et al., *Proc. Natl. Acad. Sci.* (*U.S.A.*) 85:1028-1032 (1988), the entirety of which is herein incorporated by reference; Holt, et al., *Molec. Cell. Biol.* 8:963-973 (1988), the entirety of which is herein incorporated by reference; Gerwirtz, et al., *Science* 242:1303-1306 (1988), the entirety of which is herein incorporated by reference; Anfossi, et al., *Proc. Natl. Acad. Sci.* (*U.S.A.*) 86:3379-3383 (1989), the entirety of which is herein incorporated by reference; Becker, et al., *EMBO J.* 8:3685-3691 (1989); the entirety of which is herein incorporated by reference). Automated nucleic acid synthesizers may be employed for this purpose. In lieu of such synthesis, the disclosed nucleic acid molecules may be used to define a pair of primers that can be used with the polymerase chain reaction (Mullis, et al., *Cold Spring Harbor Symp. Quant. Biol.* 51:263-273 (1986); Erlich et al., EP 50,424; EP 84,796, EP 258,017, EP 237,362; Mullis, EP 201,184; Mullis et al., U.S. Pat. No. 4,683,202; Erlich, U.S. Pat. No. 4,582,788; and Saiki, R. et al., U.S. Pat. No. 4,683,194, all of which are hereby incorporated by reference in their entirety) to amplify and obtain any desired nucleic acid molecule or fragment.

Promoter sequence(s) and other genetic elements including but not limited to transcriptional regulatory elements associated with one or more of the disclosed nucleic acid sequences can also be obtained using the disclosed nucleic acid sequences provided herein.

In one embodiment, such sequences are obtained by incubating EST nucleic acid molecules or preferably fragments thereof with members of genomic libraries (e.g. maize and soybean) and recovering clones that hybridize to the EST nucleic acid molecule or fragment thereof. In a second embodiment, methods of "chromosome walking," or inverse PCR may be used to obtain such sequences (Frohman, et al., *Proc. Natl. Acad. Sci.* (*U.S.A.*) 85:8998-9002 (1988); Ohara, et al., *Proc. Natl. Acad. Sci.* (*U.S.A.*) 86: 5673-5677 (1989); Pang et al., *Biotechniques,* 22(6); 1046-1048 (1977); Huang et al., *Methods Mol. Biol.* 69: 89-96 (1977); Hartl et al., *Methods Mol. Biol.* 58: 293-301 (1996), all of which are hereby incorporated by reference in their entirety). In one embodiment, the disclosed nucleic acid molecules are used to identify cDNAs whose analogous genes contain promoters with desirable expression patterns. The nucleic acid molecules isolated from the library of the present invention are used to isolate promoters of tissue-enhanced, tissue-specific, developmentally- or environmentally-regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See for example Birren et al., *Genome Analysis: Analyzing DNA,* 1, (1997), Cold Spring Harbor Laboratory Press, Cold Spring Harbor, N.Y., the entirety of which is herein incorporated by reference).

Promoters obtained utilizing the nucleic acid molecules of the present invention could also be modified to affect their control characteristics. Examples of such modifications would include but are not limited to enhancer sequences as reported by Kay et al., *Science* 236:1299 (1987), herein incorporated by reference in its entirety. Such genetic elements could be used to enhance gene expression of new and existing traits for crop improvements.

The nucleic acid molecules of the present invention may be used to isolate promoters of tissue enhanced, tissue specific, cell-specific, cell-type, developmentally or environmentally regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See, for example, Birren et. al., *Genome Analysis: Analyzing DNA,* 1, Cold Spring Harbor Laboratory Press, Cold Spring Harbor, N.Y. (1997), the entirety of which is herein incorporated by reference). Promoters obtained utilizing the nucleic acid molecules of the present invention could also be modified to affect their control characteristics. Examples of such modifications would include but are not limited to enhancer sequences as reported by Kay, et al *Science* 236:1299 (1987), herein incorporated reference in its entirety. Such genetic elements could be used to enhance gene expression of new and existing traits for crop improvements.

In an aspect of the present invention, one or more of the nucleic molecules of the present invention are used to determine whether a plant (preferably maize) has a mutation affecting the level (i.e., the concentration of mRNA in a sample, etc.) or pattern (i.e., the kinetics of expression, rate of decomposition, stability profile, etc.) of the expression encoded in part or whole by one or more of the nucleic acid molecules of the present invention (collectively, the "Expression Response" of a cell or tissue). As used herein, the Expression Response manifested by a cell or tissue is said to be "altered" if it differs from the Expression Response of cells or tissues of plants not exhibiting the phenotype. To determine whether a Expression Response is altered, the Expression Response manifested by the cell or tissue of the plant exhibiting the phenotype is compared with that of a similar cell or tissue sample of a plant not exhibiting the phenotype. As will be appreciated, it is not necessary to re-determine the Expression Response of the cell or tissue sample of plants not exhibiting the phenotype each time such a comparison is made; rather, the Expression Response of a particular plant may be compared with previously obtained values of normal plants. As used herein, the phenotype of the organism is any of one or more characteristics of an organism (e.g. disease resistance, pest tolerance, environmental tolerance, male sterility, yield, quality improvements, etc.). A change in genotype or phenotype may be transient or permanent. Also as used herein, a tissue sample is any sample that comprises more than one cell. In a preferred aspect, a tissue sample comprises cells that share a common characteristic (e.g. derived from leaf, root, or pollen etc).

In one sub-aspect, such an analysis is conducted by determining the presence and/or identity of polymorphism(s) by one or more of the nucleic acid molecules of the present invention and more specifically, one or more of the EST nucleic acid molecules or fragments thereof which are associated with phenotype, or a predisposition to phenotype.

Any of a variety of molecules can be used to identify such polymorphism(s). In one embodiment, one or more of the EST nucleic acid molecules (or a sub-fragment thereof) may be employed as a marker nucleic acid molecule to identify such polymorphism(s). Alternatively, such polymorphisms can be detected through the use of a marker nucleic acid molecule or a marker protein that is genetically linked to (i.e., a polynucleotide that co-segregates with) such polymorphism(s).

In an alternative embodiment, such polymorphisms can be detected through the use of a marker nucleic acid molecule that is physically linked to such polymorphism(s). For this purpose, marker nucleic acid molecules comprising a nucleotide sequence of a polynucleotide located within 1 mb of the polymorphism(s), and more preferably within 100 kb of the polymorphism(s), and most preferably within 10 kb of the polymorphism(s) can be employed.

The genomes of animals and plants naturally undergo spontaneous mutation in the course of their continuing evolution (Gusella, *Ann. Rev. Biochem.* 55:831-854 (1986)). A "polymorphism" is a variation or difference in the sequence of the gene or its flanking regions that arises in some of the members of a species. The variant sequence and the "original" sequence co-exist in the species' population. In some instances, such co-existence is in stable or quasi-stable equilibrium.

A polymorphism is thus said to be "allelic," in that, due to the existence of the polymorphism, some members of a species may have the original sequence (i.e., the original "allele") whereas other members may have the variant sequence (i.e., the variant "allele"). In the simplest case, only one variant sequence may exist, and the polymorphism is thus said to be di-allelic. In other cases, the species' population may contain multiple alleles, and the polymorphism is termed tri-allelic, etc. A single gene may have multiple different unrelated polymorphisms. For example, it may have a di-allelic polymorphism at one site, and a multi-allelic polymorphism at another site.

The variation that defines the polymorphism may range from a single nucleotide variation to the insertion or deletion of extended regions within a gene. In some cases, the DNA sequence variations are in regions of the genome that are characterized by short tandem repeats (STRs) that include tandem di- or tri-nucleotide repeated motifs of nucleotides. Polymorphisms characterized by such tandem repeats are referred to as "variable number tandem repeat" ("VNTR") polymorphisms. VNTRs have been used in identity analysis (Weber, U.S. Pat. No. 5,075,217; Armour, et al., *FEBS Lett.* 307:113-115 (1992); Jones, et al., *Eur. J. Haematol.* 39:144-147 (1987); Horn, et al., PCT Application WO91/14003; Jeffreys, European Patent Application 370,719; Jeffreys, U.S. Pat. No. 5,699,082; Jeffreys. et al., *Amer. J. Hum. Genet.* 39:11-24 (1986); Jeffreys. et al., *Nature* 316:76-79 (1985); Gray, et al., *Proc. R. Acad. Soc. Lond.* 243:241-253 (1991); Moore, et al., *Genomics* 10:654-660 (1991); Jeffreys, et al., *Anim. Genet.* 18:1-15 (1987); Hillel, et al., *Anim. Genet.* 20:145-155 (1989); Hillel, et al., *Genet.* 124:783-789 (1990), all of which are herein incorporated by reference in their entirety).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

The most preferred method of achieving such amplification employs the polymerase chain reaction ("PCR") (Mullis, et al., *Cold Spring Harbor Symp. Quant. Biol.* 51:263-273 (1986); Erlich, et al., European Patent Appln. 50,424; European Patent Appln. 84,796, European Patent Application 258,017, European Patent Appln. 237,362; Mullis, European Patent Appln. 201,184; Mullis, et al., U.S. Pat. No. 4,683,202; Erlich., U.S. Pat. No. 4,582,788; and Saiki, et al., U.S. Pat. No. 4,683,194, all of which are herein incorporated by reference), using primer pairs that are capable of hybridizing to the proximal sequences that define a polymorphism in its double-stranded form.

In lieu of PCR, alternative methods, such as the "Ligase Chain Reaction" ("LCR") may be used (Barany, *Proc. Natl. Acad. Sci.* (*U.S.A.*) 88:189-193 (1991), the entirety of which is herein incorporated by reference). LCR uses two pairs of oligonucleotide probes to exponentially amplify a specific target. The sequences of each pair of oligonucleotides is selected to permit the pair to hybridize to abutting sequences of the same strand of the target. Such hybridization forms a substrate for a template-dependent ligase. As with PCR, the resulting products thus serve as a template in subsequent cycles and an exponential amplification of the desired sequence is obtained.

LCR can be performed with oligonucleotides having the proximal and distal sequences of the same strand of a polymorphic site. In one embodiment, either oligonucleotide will be designed to include the actual polymorphic site of the polymorphism. In such an embodiment, the reaction conditions are selected such that the oligonucleotides can be ligated together only if the target molecule either contains or lacks the specific nucleotide that is complementary to the polymorphic site present on the oligonucleotide. Alternatively, the oligonucleotides may be selected such that they do not include the polymorphic site (see, Segev, PCT Application WO 90/01069, the entirety of which is herein incorporated by reference).

The "Oligonucleotide Ligation Assay" ("OLA") may alternatively be employed (Landegren, et al., *Science* 241:1077-1080 (1988), the entirety of which is herein incorporated by reference). The OLA protocol uses two oligonucleotides which are designed to be capable of hybridizing to abutting sequences of a single strand of a target. OLA, like LCR, is particularly suited for the detection of point mutations. Unlike LCR, however, OLA results in "linear" rather than exponential amplification of the target sequence.

Nickerson, et al. have described a nucleic acid detection assay that combines attributes of PCR and OLA (Nickerson, et al., *Proc. Natl. Acad. Sci.* (*U.S.A.*) 87:8923-8927 (1990), the entirety of which is herein incorporated by reference). In this method, PCR is used to achieve the exponential amplification of target DNA, which is then detected using OLA. In addition to requiring multiple, and separate, processing steps, one problem associated with such combinations is that they inherit all of the problems associated with PCR and OLA.

Schemes based on ligation of two (or more) oligonucleotides in the presence of nucleic acid having the sequence of the resulting "di-oligonucleotide", thereby amplifying the di-oligonucleotide, are also known (Wu, et al., *Genomics* 4:560 (1989), the entirety of which is herein incorporated by reference), and may be readily adapted to the purposes of the present invention.

Other known nucleic acid amplification procedures, such as allele-specific oligomers, branched DNA technology, transcription-based amplification systems, or isothermal amplification methods may also be used to amplify and analyze such polymorphisms (Malek, et al., U.S. Pat. No. 5,130,238; Davey, et al., European Patent Application 329,822; Schuster et al., U.S. Pat. No. 5,169,766; Miller, et al., PCT Application WO 89/06700; Kwoh, et al., *Proc. Natl. Acad. Sci.* (U.S.A.) 86:1173-1177 (1989); Gingeras, et al., PCT Application WO 88/10315; Walker, et al., *Proc. Natl. Acad. Sci.* (U.S.A.) 89:392-396 (1992), all of which are herein incorporated by reference in their entirety).

The identification of a polymorphism can be determined in a variety of ways. By correlating the presence or absence of it in a plant with the presence or absence of a phenotype, it is possible to predict the phenotype of that plant. If a polymorphism creates or destroys a restriction endonuclease cleavage site, or if it results in the loss or insertion of DNA (e.g., a VNTR polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms" ("RFLPs"). RFLPs have been widely used in human and plant genetic analyses (Glassberg, UK Patent Application 2135774; Skolnick, et al., *Cytogen. Cell Genet.* 32:58-67 (1982); Botstein, et al., *Ann. J. Hum. Genet.* 32:314-331 (1980); Fischer, et al. (PCT Application WO90/13668); Uhlen, PCT Application WO90/11369).

Polymorphisms can also be identified by Single Strand Conformation Polymorphism (SSCP) analysis. The SSCP technique is a method capable of identifying most sequence variations in a single strand of DNA, typically between 150 and 250 nucleotides in length (Elles, *Methods in Molecular Medicine: Molecular Diagnosis of Genetic Diseases*, Humana Press (1996), the entirety of which is herein incorporated by reference); Orita et al., *Genomics* 5: 874-879 (1989), the entirety of which is herein incorporated by reference). Under denaturing conditions a single strand of DNA will adopt a conformation that is uniquely dependent on its sequence conformation. This conformation usually will be different, even if only a single base is changed. Most conformations have been reported to alter the physical configuration or size sufficiently to be detectable by electrophoresis. A number of protocols have been described for SSCP including, but not limited to Lee et al., *Anal. Biochem.* 205: 289-293 (1992), the entirety of which is herein incorporated by reference; Suzuki et al., *Anal. Biochem.* 192: 82-84 (1991), the entirety of which is herein incorporated by reference; Lo et al., *Nucleic Acids Research* 20: 1005-1009 (1992), the entirety of which is herein incorporated by reference; Sarkar et al., *Genomics* 13: 441-443 (1992), the entirety of which is herein incorporated by reference). It is understood that one or more of the nucleic acids of the present invention, may be utilized as markers or probes to detect polymorphisms by SSCP analysis.

Polymorphisms may also be found using a DNA fingerprinting technique called amplified fragment length polymorphism (AFLP), which is based on the selective PCR amplification of restriction fragments from a total digest of genomic DNA to profile that DNA. Vos, et al., *Nucleic Acids Res.* 23:4407-4414 (1995), the entirety of which is herein incorporated by reference. This method allows for the specific co-amplification of high numbers of restriction fragments, which can be visualized by PCR without knowledge of the nucleic acid sequence.

AFLP employs basically three steps. Initially, a sample of genomic DNA is cut with restriction enzymes and oligonucleotide adapters are ligated to the restriction fragments of the DNA. The restriction fragments are then amplified using PCR by using the adapter and restriction sequence as target sites for primer annealing. The selective amplification is achieved by the use of primers that extend into the restriction fragments, amplifying only those fragments in which the primer extensions match the nucleotide flanking the restriction sites. These amplified fragments are then visualized on a denaturing polyacrylamide gel.

AFLP analysis has been performed on *Salix* (Beismann, et al., *Mol. Ecol.* 6:989-993 (1997), the entirety of which is herein incorporated by reference); *Acinetobacter* (Janssen, et al., *Int. J. Syst. Bacteriol* 47:1179-1187 (1997), the entirety of which is herein incorporated by reference), *Aeromonas popoffi* (Huys, et al., *Int. J. Syst. Bacteriol.* 47:1165-1171 (1997), the entirety of which is herein incorporated by reference), rice (McCouch, et al., *Plant Mol. Biol.* 35:89-99 (1997), the entirety of which is herein incorporated by reference); Nandi, et al., *Mol. Gen. Genet.* 255:1-8 (1997); Cho, et al., *Genome* 39:373-378 (1996), herein incorporated by reference), barley (*Hordeum vulgare*) (Simons, et al., *Genomics* 44:61-70 (1997), the entirety of which is herein incorporated by reference; Waugh, et al., *Mol. Gen. Genet.* 255:311-321 (1997), the entirety of which is herein incorporated by reference; Qi, et al., *Mol. Gen. Genet.* 254:330-336 (1997), the entirety of which is herein incorporated by reference; Becker, et al., *Mol. Gen. Genet.* 249:65-73 (1995), the entirety of which is herein incorporated by reference), potato (Van der Voort, et al., *Mol. Gen. Genet.* 255:438-447 (1997), the entirety of which is herein incorporated by reference; Meksem, et al., *Mol. Gen. Genet.* 249:74-81 (1995), the entirety of which is herein incorporated by reference), *Phytophthora infestans* (Van der Lee, et al., *Fungal Genet. Biol.* 21:278-291 (1997), the entirety of which is herein incorporated by reference), *Bacillus anthracis* (Keim, et al., *J. Bacteriol.* 179:818-824 (1997)), *Astragalus cremnophylax* (Travis, et al., *Mol. Ecol.* 5:735-745 (1996), the entirety of which is herein incorporated by reference), *Arabidopsis* (Cnops, et al., *Mol. Gen. Genet.* 253:32-41 (1996), the entirety of which is herein incorporated by reference), *Escherichia coli* (Lin, et al., *Nucleic Acids Res.* 24:3649-3650 (1996), the entirety of which is herein incorporated by reference), *Aeromonas* (Huys, et al., *Int. J. Syst. Bacteriol.* 46:572-580 (1996), the entirety of which is herein incorporated by reference), nematode (Folkertsma, et al., *Mol. Plant. Microbe Interact.* 9:47-54 (1996), the entirety of which is herein incorporated by reference), tomato (Thomas, et al., *Plant J.* 8:785-794 (1995), the entirety of which is herein incorporated by reference), and human (Latorra, et al., *PCR Methods Appl.* 3:351-358 (1994)). AFLP analysis has also been used for fingerprinting mRNA (Money, et al., *Nucleic Acids Res.* 24:2616-2617 (1996), the entirety of which is herein incorporated by reference; Bachem, et al., *Plant J.* 9:745-753 (1996), the entirety of which is herein incorporated by reference). It is understood that one or more of the nucleic acids of the present invention, may be utilized as markers or probes to detect polymorphisms by AFLP analysis for fingerprinting mRNA.

Polymorphisms may also be found using random amplified polymorphic DNA (RAPD) (Williams et al., *Nucl. Acids Res.* 18: 6531-6535 (1990), the entirety of which is herein incorporated by reference) and cleaveable amplified polymorphic sequences (CAPS) (Lyamichev et al., *Science* 260: 778-783 (1993), the entirety of which is herein incorporated by reference). It is understood that one or more of the nucleic acids of the present invention, may be utilized as markers or probes to detect polymorphisms by RAPD or CAPS analysis.

Polymorphisms are useful, through linkage analysis, to define the genetic distances or physical distances between polymorphic traits. A physical map or ordered array of genomic DNA fragments in the desired region containing the gene may be used to characterize and isolate genes corresponding to desirable traits. For this purpose, yeast artificial chromosomes (YACs), bacterial artificial chromosomes (BACs), and cosmids are appropriate vectors for cloning large segments of DNA molecules. Although fewer clones are needed to make a contig for a specific genomic region by using YACs (Agyare et al., *Genome Res.* 7: 1-9 (1997), the entirety of which is herein incorporated by reference; James et al., *Genomics* 32: 425-430 (1996), the entirety of which is herein incorporated by reference), chimerism in the inserted DNA fragment can arise. Cosmids are convenient for handling smaller-size DNA molecules and may be used for transformation in developing transgenic plants. BACs also carry DNA fragments and are less prone to chimerism.

Through genetic mapping, a fine scale linkage map can be developed using DNA markers and, then, a genomic DNA library of large-sized fragments can be screened with molecular markers linked to the desired trait. Molecular markers are advantageous for agronomic traits that are otherwise difficult to tag, such as resistance to pathogens, insects and nematodes, tolerance to abiotic stress, quality parameters and quantitative traits such as high yield potential.

The essential requirements for marker-assisted selection in a plant breeding program are: (1) the marker(s) should co-segregate or be closely linked with the desired trait; (2) an efficient means of screening large populations for the molecular marker(s) should be available; and (3) the screening technique should have high reproducibility across laboratories and preferably be economical to use and be user-friendly.

The genetic linkage of marker molecules can be established by a gene mapping model such as, without limitation, the flanking marker model reported by Lander and Botstein, *Genetics* 121:185-199 (1989) and the interval mapping, based on maximum likelihood methods described by Lander and Botstein, *Genetics* 121:185-199 (1989) and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990). Additional software includes Qgene, Version 2.23 (1996), Department of Plant Breeding and Biometry, 266 Emerson Hall, Cornell University, Ithaca, N.Y., the manual of which is herein incorporated by reference in its entirety). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics* 121:185-199 (1989) the entirety of which is herein incorporated by reference and further described by Arús and Moreno-González, *Plant Breeding*, Hayward et al., (eds.) Chapman & Hall, London, pp. 314-331 (1993), the entirety of which is herein incorporated by reference.

Additional models can be used. Many modifications and alternative approaches to interval mapping have been reported, including the use of non-parametric methods (Kruglyak and Lander, *Genetics* 139:1421-1428 (1995), the entirety of which is herein incorporated by reference). Multiple regression methods or models can be also be used, in which the trait is regressed on a large number of markers (Jansen, *Biometrics in Plant Breeding*, van Oijen and Jansen (eds.), Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994), both of which are herein incorporated by reference in their entirety). Procedures combining interval mapping with regression analysis, whereby the phenotype is regressed onto a single putative QTL at a given marker interval and at the same time onto a number of markers that serve as 'cofactors,' have been reported by Jansen and Stam, *Genetics* 136:1447-1455 (1994), the entirety of which is herein incorporated by reference and Zeng, *Genetics* 136:1457-1468 (1994) the entirety of which is herein incorporated by reference. Generally, the use of cofactors reduces the bias and sampling error of the estimated QTL positions (Utz and Melchinger, *Biometrics in Plant Breeding*, van Oijen and Jansen (eds.) Proceedings of the Ninth Meeting of the Eucarpia Section Biometrics in Plant Breeding, The Netherlands, pp. 195-204 (1994), the entirety of which is herein incorporated by reference, thereby improving the precision and efficiency of QTL mapping (Zeng, *Genetics* 136:1457-1468 (1994)). These models can be extended to multi-environment experiments to analyze genotype-environment interactions (Jansen et al., *Theo. Appl. Genet.* 91:33-37 (1995), the entirety of which is herein incorporated by reference).

Selection of an appropriate mapping population is important to map construction. The choice of an appropriate mapping population depends on the type of marker systems employed (Tanksley et al., *Molecular mapping plant chromosomes. Chromosome structure and function: Impact of new concepts*, Gustafson and Appels (eds.), Plenum Press, New York, pp 157-173 (1988), the entirety of which is herein incorporated by reference). Consideration must be given to the source of parents (adapted vs. exotic) used in the mapping population. Chromosome pairing and recombination rates can be severely disturbed (suppressed) in wide crosses (adapted×exotic) and generally yield greatly reduced linkage distances. Wide crosses will usually provide segregating populations with a relatively large array of polymorphisms when compared to progeny in a narrow cross (adapted×adapted).

An $F_2$ population is the first generation of selfing after the hybrid seed is produced. Usually a single $F_1$ plant is selfed to generate a population segregating for all the genes in Mendelian (1:2:1) fashion. Maximum genetic information is obtained from a completely classified $F_2$ population using a codominant marker system (Mather, *Measurement of Linkage in Heredity*, Methuen and Co., (1938), the entirety of which is herein incorporated by reference). In the case of dominant markers, progeny tests (e.g. $F_3$, $BCF_2$) are required to identify the heterozygotes, thus making it equivalent to a completely classified $F_2$ population. However, this procedure is often prohibitive because of the cost and time involved in progeny testing. Progeny testing of $F_2$ individuals is often used in map construction where phenotypes do not consistently reflect genotype (e.g. disease resistance) or where trait expression is controlled by a QTL. Segregation data from progeny test populations (e.g. $F_3$ or $BCF_2$) can be used in map construction. Marker-assisted selection can then be applied to cross progeny based on marker-trait map associations ($F_2$, $F_3$), where linkage groups have not been completely disassociated by recombination events (i.e., maximum disequilibrium).

Recombinant inbred lines (RIL) (genetically related lines; usually $>F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter et al., *Proc. Natl. Acad. Sci.* (*U.S.A.*) 89:1477-1481 (1992), the entirety of which is herein incorporated by reference). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., *Proc. Natl. Acad. Sci.* (*U.S.A.*) 89:1477-1481 (1992)). Information obtained from backcross populations using either codominant or dominant markers is less than that obtained from $F_2$ populations because one, rather than two, recombinant gametes are sampled per plant. Backcross populations, however, are more informative (at low marker saturation) when compared to RILs as the distance between linked loci increases in RIL populations (i.e. about 15% recombination). Increased recombination can be beneficial for resolution of tight linkages, but may be undesirable in the construction of maps with low marker saturation.

Near-isogenic lines (NIL) created by many backcrosses to produce an array of individuals that are nearly identical in genetic composition except for the trait or genomic region under interrogation can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore et al., *Proc. Natl. Acad. Sci.* (*U.S.A.*) 88:9828-9832 (1991), the entirety of which is herein incorporated by reference). In BSA, two bulked DNA samples are drawn from a segregating population originating from a single cross. These bulks contain individuals that are identical for a particular trait (resistant or susceptible to particular disease) or genomic region but arbitrary at unlinked regions (i.e. heterozygous). Regions unlinked to the target region will not differ between the bulked samples of many individuals in BSA.

It is understood that one or more of the nucleic acid molecules of the present invention may be used as molecular markers. It is also understood that one or more of the protein molecules of the present invention may be used as molecular markers.

In accordance with this aspect of the present invention, a sample nucleic acid is obtained from plants cells or tissues. Any source of nucleic acid may be used. Preferably, the nucleic acid is genomic DNA. The nucleic acid is subjected to restriction endonuclease digestion. For example, one or more EST nucleic acid molecule or fragment thereof can be used as a probe in accordance with the above-described polymorphic methods. The polymorphism obtained in this approach can then be cloned to identify the mutation at the coding region which alters the protein's structure or regulatory region of the gene which affects its expression level.

In one aspect of the present invention, an evaluation can be conducted to determine whether a particular mRNA molecule is present. One or more of the nucleic acid molecules of the present invention, preferably one or more of the EST nucleic acid molecules of the present invention are utilized to detect the presence or quantity of the mRNA species. Such molecules are then incubated with cell or tissue extracts of a plant under conditions sufficient to permit nucleic acid hybridization. The detection of double-stranded probe-mRNA hybrid molecules is indicative of the presence of the mRNA; the amount of such hybrid formed is proportional to the amount of mRNA. Thus, such probes may be used to ascertain the level and extent of the mRNA production in a plant's cells or tissues. Such nucleic acid hybridization may be conducted under quantitative conditions (thereby providing a numerical value of the amount of the mRNA present). Alternatively, the assay may be conducted as a qualitative assay that indicates either that the mRNA is present, or that its level exceeds a user set, predefined value.

A principle of in situ hybridization is that a labeled, single-stranded nucleic acid probe will hybridize to a complementary strand of cellular DNA or RNA and, under the appropriate conditions, these molecules will form a stable hybrid. When nucleic acid hybridization is combined with histological techniques, specific DNA or RNA sequences can be identified within a single cell. An advantage of in situ hybridization over more conventional techniques for the detection of nucleic acids is that it allows an investigator to determine the precise spatial population (Angerer et al., *Dev. Biol.* 101: 477-484 (1984), the entirety of which is herein incorporated by reference; Angerer et al., *Dev. Biol.* 112: 157-166 (1985), the entirety of which is herein incorporated by reference; Dixon et al., *EMBO J.* 10: 1317-1324 (1991), the entirety of which is herein incorporated by reference). In situ hybridization may be used to measure the steady-state level of RNA accumulation. It is a sensitive technique and RNA sequences present in as few as 5-10 copies per cell can be detected (Hardin et al., *J. Mol. Biol.* 202: 417-431. (1989), the entirety of which is herein incorporated by reference). A number of protocols have been devised for in situ hybridization, each with tissue preparation, hybridization, and washing conditions (Meyerowitz, *Plant Mol. Biol. Rep.* 5: 242-250 (1987), the entirety of which is herein incorporated by reference; Cox and Goldberg, In: *Plant Molecular Biology: A Practical Approach* (ed. C. H. Shaw), pp. 1-35. IRL Press, Oxford (1988), the entirety of which is herein incorporated by reference; Raikhel et al., *In situ RNA hybridization in plant tissues*. In *Plant Molecular Biology Manual*, vol. B9: 1-32. Kluwer Academic Publisher, Dordrecht, Belgium (1989), the entirety of which is herein incorporated by reference).

In situ hybridization also allows for the localization of proteins within a tissue or cell (Wilkinson, *In Situ Hybridization*, Oxford University Press, Oxford (1992), the entirety of which is herein incorporated by reference; Langdale, *In Situ Hybridization* 165-179 In: *The Maize Handbook*, eds. Freeling and Walbot, Springer-Verlag, New York (1994), the entirety of which is herein incorporated by reference). It is understood that one or more of the molecules of the present invention, preferably one or more of the EST nucleic acid molecules of the present invention or one or more of the antibodies of the present invention may be utilized to detect the level or pattern of a protein or fragment thereof by in situ hybridization.

Fluorescent in situ hybridization also enables the localization of a particular DNA sequence along a chromosome which is useful, among other uses, for gene mapping, following chromosomes in hybrid lines or detecting chromosomes with translocations, transversions or deletions. In situ hybridization has been used to identify chromosomes in several plant species (Griffor et al., *Plant Mol. Biol.* 17: 101-109 (1991), the entirety of which is herein incorporated by reference; Gustafson et al., *Proc. Nat'l. Acad. Sci.* (*U.S.A*). 87: 1899-1902 (1990), herein incorporated by reference; Mukai and Gill, *Genome* 34: 448-452. (1991); Schwarzacher and Heslop-Harrison, *Genome* 34: 317-323 (1991); Wang et al., *Jpn. J. Genet.* 66: 313-316 (1991), the entirety of which is herein incorporated by reference; Parra and Windle, *Nature Genetics,* 5: 17-21 (1993), the entirety of which is herein incorporated by reference). It is understood that the nucleic acid molecules of the present invention may be used as probes or markers to localize sequences along a chromosome.

It is also understood that one or more of the molecules of the present invention, preferably one or more of the EST nucleic acid molecules of the present invention or one or more of the antibodies of the present invention may be utilized to detect the expression level or pattern of a protein or mRNA thereof by in situ hybridization.

Another method to localize the expression of a molecule is tissue printing. Tissue printing provides a way to screen, at the same time on the same membrane many tissue sections from different plants or different developmental stages. Tissue-printing procedures utilize films designed to immobilize proteins and nucleic acids. In essence, a freshly cut section of an organ is pressed gently onto nitrocellulose paper, nylon membrane or polyvinylidene difluoride membrane. Such membranes are commercially available (e.g. Millipore, Bedford, Mass.). The contents of the cut cell transfer onto the membrane, and the molecules are immobilized to the membrane. The immobilized molecules form a latent print that can be visualized with appropriate probes. When a plant tissue print is made on nitrocellulose paper, the cell walls leave a physical print that makes the anatomy visible without further treatment (Varner and Taylor, *Plant Physiol.* 91: 31-33 (1989), the entirety of which is herein incorporated by reference).

Tissue printing on substrate films is described by Daoust, *Exp. Cell Res.* 12: 203-211 (1957), the entirety of which is herein incorporated by reference, who detected amylase, protease, ribonuclease, and deoxyribonuclease in animal tissues using starch, gelatin, and agar films. These techniques can be applied to plant tissues (Yomo and Taylor, *Planta* 112:35-43 (1973); Harris and Chrispeels, *Plant Physiol.* 56: 292-299 (1975). Advances in membrane technology have increased the range of applications of Daoust's tissue-printing techniques allowing (Cassab and Vamer, *J. Cell. Biol.* 105: 2581-2588 (1987), the entirety of which is herein incorporated by reference; the histochemical localization of various plant enzymes and deoxyribonuclease on nitrocellulose paper and nylon (Spruce et al., *Phytochemistry,* 26: 2901-2903 (1987), the entirety of which is herein incorporated by reference; Barres et al. *Neuron* 5: 527-544 (1990), the entirety of which is herein incorporated by reference; the entirety of which is herein incorporated by reference; Reid and Pont-Lezica, *Tissue Printing: Tools for the Study of Anatomy, Histochemistry, and Gene Expression*, Academic Press, New York, N.Y. (1992), the entirety of which is herein incorporated by reference; Reid et al. *Plant Physiol.* 93: 160-165 (1990), herein incorporate by reference; Ye et al. *Plant J.* 1: 175-183 (1991), the entirety of which is herein incorporated by reference).

It is understood that one or more of the molecules of the present invention, preferably one or more of the EST nucleic acid molecules of the present invention or one or more of the antibodies of the present invention may be utilized to detect the presence or quantity of a protein by tissue printing.

Further, it is also understood that any of the nucleic acid molecules of the present invention may be used as marker nucleic acids and or probes in connection with methods that require probes or marker nucleic acids. As used herein, a probe is an agent that is utilized to determine an attribute or feature (e.g. presence or absence, location, correlation, etc.) or a molecule, cell, tissue or plant. As used herein, a marker nucleic acid is a nucleic acid molecule that is utilized to determine an attribute or feature (e.g., presence or absence, location, correlation, etc.) or a molecule, cell, tissue or plant.

A microarray-based method for high-throughput monitoring of gene expression may be utilized to measure expression response Schena et al., *Science* 270:467-470 (1995); http://cmgm.stanford.edu/pbrown/array.html; Shalon, Ph.D. Thesis, Stanford University (1996). This approach is based on using arrays of DNA targets (e.g. cDNA inserts, colonies, or polymerase chain reaction products) for hybridization to a "complex probe" prepared with RNA extracted from a given cell line or tissue. The probe may be produced by reverse transcription of mRNA or total RNA and labeled with radioactive or fluorescent labeling. The probe is complex in that it contains many different sequences in various amounts, corresponding to the numbers of copies of the original mRNA species extracted from the sample.

The initial RNA source will typically be derived from a physiological source. The physiological source may be derived from a variety of eukaryotic sources, with physiological sources of interest including sources derived from single celled organisms such as yeast and multicellular organisms, including plants and animals, particularly plants, where the physiological sources from multicellular organisms may be derived from particular organs or tissues of the multicellular organism, or from isolated cells derived therefrom. The physiological sources may be derived from multicellular organisms at different developmental stages (e.g., 10-day-old seedlings), grown under different environmental conditions (e.g., drought-stressed plants) or treated with chemicals.

In obtaining the sample of RNAs to be analyzed from the physiological source from which it is derived, the physiological source may be subjected to a number of different processing steps, where such processing steps might include tissue homogenation, cell isolation and cytoplasmic extraction, nucleic acid extraction and the like, where such processing steps are known to the those of skill in the art. Methods of isolating RNA from cells, tissues, organs or whole organisms are known to those of skill in the art and are described in Maniatis et al., *Molecular Cloning: A Laboratory Manual* (Cold Spring Harbor Press) (1989).

The DNA may be placed on nylon or glass "microarrays" regularly arranged with a spot spacing of 1 mm or less. Expression levels can be measured for hundreds or thousands of genes, by using less than 2 micrograms of polyA+RNA and determining the relative mRNA abundances down to one in ten thousand or less (Granjeaud et. al., *BioEssays* 21:781-790 (1999)).

In addition to arrays of cDNA clones or inserts, arrays of oligonucleotides are also used to study differential gene expression. In an oligonucleotide array, the genes of interest are represented by a series of approximately 20 nucleotide oligomers that are unique to each gene. Labeled mRNA is prepared and hybridization signals are detected from specific sets of oligos that represent different genes supplemented by a set of control oligonucleotides. Potential advantages of the oligonucleotide array include enhanced specificity and sensitivity through the parallel analysis of "perfect match" oligos and "mismatch" oligos for each gene. The hybridization conditions can be adjusted to distinguish a perfect heteroduplex from a single base mismatch, thus allowing subtraction of nonspecific hybridization signals from specific hybridization signals. A disadvantage of oligonucleotide arrays relative to cDNA arrays is the limitation of the technology to genes of known sequence (Granjeaud et. al., *BioEssays* 21:781-790 (1991); Carulli et al., *Journal of Cellular Biochemistry Supplements* 30/31:286-296 (1998)).

These techniques have been successfully used to characterize patterns of gene expression associated with, for example, various important physiological changes in yeast, including the mitotic cell cycle, the heat shock response, and comparison between mating types. Once a set of comparable expression profiles is obtained, e.g. for cells at different time points or at different cellular states, a clustering algorithm generally is used to group sets of genes which share similar expression patterns. The clusters obtained can then be analyzed in the light of available functional annotations, often leading to associations of poorly characterized genes with genes whose function and regulation are better understood.

Regulatory networks that control gene expression can be characterized using microarray technology (DeRisi et al., *Science* 278: 680-686 (1997); Winzler et al. *Science* 28: 1194-1197 (1998); Cho et al. *Mol Cell* 2: 65-73 (1998); Spellman et al. *Mol Biol Cell* 95: 14863-14868 (1998). For example, it is has been reported that both cDNA and oligonucleotide arrays have been used to monitor gene expression in synchronized cell cultures. Analysis of the corresponding temporal patterns of gene expression resulted in the identification of over 400 cell cycle-regulated genes. In order to identify possible common regulatory mechanisms accounting for co-expression, consensus motifs in putative regulatory sequences upstream of the corresponding ORFs were examined. This resulted in the identification of several new potential binding sites for known factors or complexes involved in the coordinated transcription of genes during specific phases of the cell cycle (Thieffry, D. *BioEssays* 21: 895-899 (1999)).

The microarray approach may be used with polypeptide targets (U.S. Pat. No. 5,445,934; U.S. Pat. No. 5,143,854; U.S. Pat. No. 5,079,600; U.S. Pat. No. 4,923,901) synthesized on a substrate (microarray) and these polypeptides can be screened with either (Fodor et al., *Science* 251:767-773 (1991)).

As disclosed in U.S. Pat. No. 5,445,934 arrays with nucleic acid molecules can comprise a substrate with a surface comprising $10^3$ or more groups of oligonucleotides with different, known sequences covalently attached to the surface in discrete known regions, e.g. $10^4$ or $10^5$ or $10^6$ or more different groups of known sequences in discrete known regions. In preferred arrays $10^3$ or more groups of oligonucleotides occupy a total area of less than 1 $cm^2$. In preferred embodiments the groups of oligonucleotides are at least 50% pure within the discrete known regions.

It is understood that one or more of the nucleic acid molecules or protein or fragments thereof of the invention may be utilized in a microarray-based method.

In a preferred embodiment of the present invention microarrays may be prepared that comprise nucleic acid molecules where preferably at least 10%, preferably at least 25%, more preferably at least 50% and even more preferably at least 75%, 80%, 85%, 90% or 95% of the nucleic acid molecules located on that array are selected from the group of nucleic acid molecules that specifically hybridize to one or more nucleic acid molecule having a nucleic acid sequence selected from the group of SEQ ID NO: 1 through SEQ ID NO: 17472 or complement thereof or fragments of either.

A particular preferred microarray embodiment of the present invention is a microarray comprising nucleic acid molecules encoding genes or fragments thereof that are homologues of known genes or nucleic acid molecules that comprise genes or fragment thereof that elicit only limited or no matches to known genes. A further preferred microarray embodiment of the present invention is a microarray comprising nucleic acid molecules having genes or fragments thereof that are homologues of known genes and nucleic acid molecules that comprise genes or fragment thereof that elicit only limited or no matches to known genes. Site-directed mutagenesis may be utilized to modify nucleic acid sequences, particularly as it is a technique that allows one or more of the amino acids encoded by a nucleic acid molecule to be altered (e.g. a threonine to be replaced by a methionine). Three basic methods for site-directed mutagenesis are often employed. These are cassette mutagenesis (Wells et al., *Gene* 34:315-23 (1985), the entirety of which is herein incorporated by reference), primer extension (Gilliam et al., *Gene* 12:129-137 (1980), the entirety of which is herein incorporated by reference); Zoller and Smith, *Methods Enzymol.* 100:468-500 (1983), the entirety of which is herein incorporated by reference; and Dalbadie-McFarland et al., *Proc. Natl. Acad. Sci.* (*U.S.A.*) 79:6409-6413 (1982), the entirety of which is herein incorporated by reference) and methods based upon PCR (Scharf et al., *Science* 233:1076-1078 (1986), the entirety of which is herein incorporated by reference; Higuchi et al., *Nucleic Acids Res.* 16:7351-7367 (1988), the entirety of which is herein incorporated by reference). Site-directed mutagenesis approaches are also described in European Patent 0 385 962, the entirety of which is herein incorporated by reference, European Patent 0 359 472, the entirety of which is herein incorporated by reference, and PCT Patent Application WO 93/07278, the entirety of which is herein incorporated by reference.

Site-directed mutagenesis strategies have been applied to plants for both in vitro as well as in vivo site-directed mutagenesis (Lanz et al., *J. Biol. Chem.* 266:9971-6 (1991), the entirety of which is herein incorporated by reference; Kovgan and Zhdanov, *Biotekhnologiya* 5:148-154; No. 207160n, Chemical Abstracts 110:225 (1989), the entirety of which is herein incorporated by reference; Ge et al., *Proc. Natl. Acad. Sci.* (*U.S.A.*) 86:4037-4041 (1989), the entirety of which is herein incorporated by reference, Zhu et al., *J. Biol. Chem.* 271:18494-18498 (1996), Chu et al., *Biochemistry* 33:6150-6157 (1994), the entirety of which is herein incorporated by reference, Small et al., *EMBO J.* 11:1291-1296 (1992), the entirety of which is herein incorporated by reference, Cho et al., *Mol. Biotechnol.* 8:13-16 (1997), Kita et al., *J. Biol. Chem.* 271:26529-26535 (1996), the entirety of which is herein incorporated by reference, Jin et al., *Mol. Microbiol.* 7:555-562 (1993), the entirety of which is herein incorporated by reference, Hatfield and Vierstra, *J. Biol. Chem.* 267:14799-14803 (1992), the entirety of which is herein incorporated by reference, Zhao et al., *Biochemistry* 31:5093-5099 (1992), the entirety of which is herein incorporated by reference).

Any of the nucleic acid molecules of the present invention may either be modified by site-directed mutagenesis or used as, for example, nucleic acid molecules that are used to target other nucleic acid molecules for modification. It is understood that mutants with more than one altered nucleotide can be constructed using techniques that practitioners skilled in the art are familiar with such as isolating restriction fragments and ligating such fragments into an expression vector (see, for example, Sambrook et al., *Molecular Cloning: A Laboratory Manual*, Cold Spring Harbor Press (1989)).

Sequence-specific DNA-binding proteins play a role in the regulation of transcription. The isolation of recombinant cDNAs encoding these proteins facilitates the biochemical analysis of their structural and functional properties. Genes encoding such DNA-binding proteins have been isolated using classical genetics (Vollbrecht et al., *Nature* 350: 241-243 (1991), the entirety of which is herein incorporated by reference) and molecular biochemical approaches, including the screening of recombinant cDNA libraries with antibodies (Landschulz et al., *Genes Dev.* 2: 786-800 (1988), the entirety of which is herein incorporated by reference) or DNA probes (Bodner et al., *Cell* 55: 505-518 (1988), the entirety of which is herein incorporated by reference). In addition, an in situ screening procedure has been used and has facilitated the isolation of sequence-specific DNA-binding proteins from various plant species (Gilmartin et al., *Plant Cell* 4: 839-849 (1992), the entirety of which is herein incorporated by reference; Schindler et al., *EMBO J.* 11: 1261-1273 (1992) the entirety of which is herein incorporated by reference). An in situ screening protocol does not require the purification of the protein of interest (Vinson et al., *Genes Dev.* 2: 801-806 (1988), the entirety of which is herein incorporated by reference; Singh et al., *Cell* 52: 415-423 (1988), the entirety of which is herein incorporated by reference).

Steps may be employed to characterize DNA-protein interactions. The first is to identify promoter fragments that interact with DNA-binding proteins, to titrate binding activity, to determine the specificity of binding, and to determine whether a given DNA-binding activity can interact with related DNA sequences (Sambrook et al., *Molecular Cloning: A Laboratory Manual,* 2$^{nd}$ edition. Cold Spring Harbor Laboratory Press, Cold Spring Harbor, N.Y. (1989). Electrophoretic mobility-shift assay is a widely used assay. The assay provides a simple, rapid, and sensitive method for detecting DNA-binding proteins based on the observation that the mobility of a DNA fragment through a nondenaturing, low-ionic strength polyacrylamide gel is retarded upon association with a DNA-binding protein (Fried and Crother, *Nucleic Acids Res.* 9: 6505-6525 (1981), the entirety of which is herein incorporated by reference). When one or more specific binding activities have been identified, the exact sequence of the DNA bound by the protein may be determined. Several procedures for characterizing protein/DNA-binding sites are used, including methylation and ethylation interference assays (Maxam and Gilbert, *Methods Enzymol.* 65: 499-560 (1980), the entirety of which is herein incorporated by reference; Wissman and Hillen, *Methods Enzymol.* 208: 365-379 (1991), the entirety of which is herein incorporated by reference) and footprinting techniques employing DNase I (Galas and Schmitz, *Nucleic Acids Res.* 5: 3157-3170 (1978), the entirety of which is herein incorporated by reference), 1,10-phenanthroline-copper ion methods (Sigman et al., *Methods Enzymol.* 208: 365-379 (1991), the entirety of which is herein incorporated by reference) or hydroxyl radical methods (Dixon et al., *Methods Enzymol.* 208: 380-413 (1991), the entirety of which is herein incorporated by reference). It is understood that one or more of the nucleic acid molecules of the present invention, preferably one or more of the EST nucleic acid molecules of the present invention may be utilized to identify a protein or fragment thereof that specifically binds to a nucleic acid molecule of the present invention. It is also understood that one or more of the protein molecules or fragments thereof of the present invention may be utilized to identify a nucleic acid molecule that specifically binds to it.

The two-hybrid system is based on the fact that many cellular functions are carried out by proteins that interact (physically) with one another. Two-hybrid systems have been used to probe the function of new proteins (Chien et al., *Proc. Natl. Acad. Sci.* (*U.S.A.*) 88: 9578-9582 (1991) the entirety of which is herein incorporated by reference; Durfee et al., *Genes Dev.* 7: 555-569 (1993) the entirety of which is herein incorporated by reference; Choi et al., *Cell* 78: 499-512 (1994), the entirety of which is herein incorporated by reference; Kranz et al., *Genes Dev.* 8: 313-327 (1994), the entirety of which is herein incorporated by reference).

Interaction mating techniques have facilitated a number of two-hybrid studies of protein-protein interaction. Interaction mating has been used to examine interactions between small sets of tens of proteins (Finley and Brent, *Proc. Natl. Acad. Sci.* (*U.S.A.*) 91: 12098-12984 (1994), the entirety of which is herein incorporated by reference), larger sets of hundreds of proteins, (Bendixen et al., *Nucl. Acids Res.* 22: 1778-1779 (1994), the entirety of which is herein incorporated by reference) and to comprehensively map proteins encoded by a small genome (Bartel et al., *Nature Genetics* 12: 72-77 (1996), the entirety of which is herein incorporated by reference). This technique utilizes proteins fused to the DNA-binding domain and proteins fused to the activation domain. They are expressed in two different haploid yeast strains of opposite mating type, and the strains are mated to determine if the two proteins interact. Mating occurs when haploid yeast strains come into contact and result in the fusion of the two haploids into a diploid yeast strain. An interaction can be determined by the activation of a two-hybrid reporter gene in the diploid strain. The primary advantage of this technique is that it reduces the number of yeast transformations needed to test individual interactions. It is understood that the protein-protein interactions of protein or fragments thereof of the present invention may be investigated using the two-hybrid system and that any of the nucleic acid molecules of the present invention that encode such proteins or fragments thereof may be used to transform yeast in the two-hybrid system.

*Synechocystis* 6803 is a photosynthetic Cyanobacterium capable of oxygenic photosynthesis as well as heterotrophic growth in the absence of light. The entire genome has been sequenced, and it is reported to have a circular genome size of 3.57 Mbp containing 3168 potential open reading frames. Open reading frames (ORFs) were identified based upon their homology to other reported ORFs and by using ORF identification computer programs. Sixteen hundred potential ORFs were assigned based on their homology to previously identified ORFs. Of these 1600 ORFs, 145 were identical to reported ORFs (Kaneko et al., *DNA Research* 3:109-36 (1996), herein incorporated by reference in its entirety).

Several prokaryote promoters have been used in *Synechocystis* to express heterologous genes including the tac, lac, and lambda phage promoters (Bryant (ed.), *The Molecular Biology of Cyanobacteria*, Kluwer Academic Publishers, (1994); Ferino and Chauvat, *Gene* 84:257-266 (1989), both of which are herein incorporated by reference in their entirety). Several bacterial origins of replication such as RSF1010 and ACYC are reported to replicate in *Synechocystis* (Mermet-Bouvier and Chauvat, *Current Microbiology* 28:145-148 (1994); Kuhlemeier et al., *Mol. Gen. Genet.* 184:249-254 (1981), both of which are herein incorporated by reference in their entirety).

*Synechocystis* has been used to study gene regulation by gene replacement through homologous recombination or by gene disruption using antibiotic resistance markers (Pakrasi et al., *EMBO* 7:325-332 (1988), herein incorporated by reference in its entirety). In such gene regulation studies, double reciprocal homologous regions of the host genome flanking the gene of interest recombine to stably integrate the gene of interest into the genome. The gene of interest can be expressed once that gene has been stably integrated into the genome. Biochemical analysis can be performed to study the effect of the replaced or deleted gene.

It is understood that the agents of the present invention may be employed in a *Synechocystis* system.

Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. Such genetic material may be transferred into either monocotyledons and dicotyledons including but not limited to the crops, maize and soybean (See specifically, Chistou, *Particle Bombardment for Genetic Engineering of Plants*, pp 63-69 (maize), pp 50-60 (soybean), Biotechnology Intelligence Unit. Academic Press, San Diego, Calif. (1996), the entirety of which is herein incorporated by reference and generally Chistou, *Particle Bombardment for Genetic Engineering of Plants*, Biotechnology Intelligence Unit. Academic Press, San Diego, Calif. (1996), the entirety of which is herein incorporated by reference).

Transfer of a nucleic acid that encodes for a protein can result in overexpression of that protein in a transformed cell or transgenic plant. One or more of the proteins or fragments thereof encoded by nucleic acid molecules of the present invention may be overexpressed in a transformed cell or transformed plant. Such overexpression may be the result of transient or stable transfer of the exogenous material.

Exogenous genetic material may be transferred into a plant cell by the use of a DNA vector or construct designed for such a purpose. Design of such a vector is generally within the skill of the art (See, Plant Molecular Biology: A Laboratory Manual eds. Clark, Springer, New York (1997), the entirety of which is herein incorporated by reference).

A construct or vector may include a plant promoter to express the protein or protein fragment of choice. A number of promoters which are active in plant cells have been described in the literature. These include the nopaline synthase (NOS) promoter (Ebert et al., *Proc. Natl. Acad. Sci.* (*U.S.A.*) 84:5745-5749 (1987), the entirety of which is herein incorporated by reference), the octopine synthase (OCS) promoter (which are carried on tumor-inducing plasmids of *Agrobacterium tumefaciens*), the caulimovirus promoters such as the cauliflower mosaic virus (CaMV) 19S promoter (Lawton et al., *Plant Mol. Biol.* 9:315-324 (1987), the entirety of which is herein incorporated by reference) and the CAMV 35S promoter (Odell et al., *Nature* 313:810-812 (1985), the entirety of which is herein incorporated by reference), the figwort mosaic virus 35S-promoter, the light-inducible promoter from the small subunit of ribulose-1,5-bis-phosphate carboxylase (ssRUBISCO), the Adh promoter (Walker et al., *Proc. Natl. Acad. Sci.* (*U.S.A.*) 84:6624-6628 (1987), the entirety of which is herein incorporated by reference), the sucrose synthase promoter (Yang et al., *Proc. Natl. Acad. Sci.* (*U.S.A.*) 87:4144-4148 (1990), the entirety of which is herein incorporated by reference), the R gene complex promoter (Chandler et al., *The Plant Cell* 1:1175-1183 (1989), the entirety of which is herein incorporated by reference), and the chlorophyll a/b binding protein gene promoter, etc. These promoters have been used to create DNA constructs which have been expressed in plants; see, e.g., PCT publication WO 84/02913, herein incorporated by reference in its entirety.

Promoters which are known or are found to cause transcription of DNA in plant cells can be used in the present invention. Such promoters may be obtained from a variety of sources such as plants and plant viruses. It is preferred that the particular promoter selected should be capable of causing sufficient expression to result in the production of an effective amount of a protein to cause the desired phenotype. In addition to promoters which are known to cause transcription of DNA in plant cells, other promoters may be identified for use in the current invention by screening a plant cDNA library for genes which are selectively or preferably expressed in the target tissues or cells.

For the purpose of expression in source tissues of the plant, such as the leaf, seed, root or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea (Edwards et al., *Proc. Natl. Acad. Sci.* (*U.S.A.*) 87:3459-3463 (1990), herein incorporated by reference in its entirety), the chloroplast fructose-1,6-biphosphatase (FBPase) promoter from wheat (Lloyd et al., *Mol. Gen. Genet.* 225:209-216 (1991), herein incorporated by reference in its entirety), the nuclear photosynthetic ST-LS1 promoter from potato (Stockhaus et al., *EMBO J.* 8:2445-2451 (1989), herein incorporated by reference in its entirety), the phenylalanine ammonia-lyase (PAL) promoter and the chalcone synthase (CHS) promoter from *Arabidopsis thaliana*. Also reported to be active in photosynthetically active tissues are the ribulose-1,5-bisphosphate carboxylase (RbcS) promoter from eastern larch (*Larix laricina*), the promoter for the cab gene, cab6, from pine (Yamamoto et al., *Plant Cell Physiol.* 35:773-778 (1994), herein incorporated by reference in its entirety), the promoter for the Cab-1 gene from wheat (Fejes et al., *Plant Mol. Biol.* 15:921-932 (1990), herein incorporated by reference in its entirety), the promoter for the CAB-1 gene from spinach (Lubberstedt et al., *Plant Physiol.* 104:997-1006 (1994), herein incorporated by reference in its entirety), the promoter for the cab1R gene from rice (Luan et al., *Plant Cell.* 4:971-981 (1992), the entirety of which is herein incorporated by reference), the pyruvate, orthophosphate dikinase (PPDK) promoter from maize (Matsuoka et al., *Proc. Natl. Acad. Sci.* (*U.S.A.*) 90: 9586-9590 (1993), herein incorporated by reference in its entirety), the promoter for the tobacco Lhcb1*2 gene (Cerdan et al., *Plant Mol. Biol.* 33: 245-255. (1997), herein incorporated by reference in its entirety), the *Arabidopsis thaliana* SUC2 sucrose-H+ symporter promoter (Truernit et al., *Planta.* 196: 564-570 (1995), herein incorporated by reference in its entirety), and the promoter for the thylacoid membrane proteins from spinach (psaD, psaF, psaE, PC, FNR, atpC, atpD, cab, rbcS). Other promoters for the chlorophyl a/b-binding proteins may also be utilized in the present invention, such as the promoters for LhcB gene and PsbP gene from white mustard (*Sinapis alba*; Kretsch et al., *Plant Mol. Biol.* 28: 219-229 (1995), the entirety of which is herein incorporated by reference).

For the purpose of expression in sink tissues of the plant, such as the tuber of the potato plant, the fruit of tomato, or the seed of maize, wheat, rice, and barley, it is preferred that the promoters utilized in the present invention have relatively high expression in these specific tissues. A number of promoters for genes with tuber-specific or -enhanced expression are known, including the class I patatin promoter (Bevan et al., *EMBO J.* 8: 1899-1906 (1986); Jefferson et al., *Plant Mol. Biol.* 14: 995-1006 (1990), both of which are herein incorporated by reference in their entirety), the promoter for the potato tuber ADPGPP genes, both the large and small subunits, the sucrose synthase promoter (Salanoubat and Belliard, *Gene.* 60: 47-56 (1987), Salanoubat and Belliard, *Gene.* 84: 181-185 (1989), both of which are incorporated by reference in their entirety), the promoter for the major tuber proteins including the 22 kd protein complexes and proteinase inhibitors (Hannapel, *Plant Physiol.* 101: 703-704 (1993), herein incorporated by reference in its entirety), the promoter for the granule bound starch synthase gene (GBSS) (Visser et al., *Plant Mol. Biol.* 17: 691-699 (1991), herein incorporated by reference in its entirety), and other class I and II patatins promoters (Koster-Topfer et al., *Mol Gen Genet.* 219: 390-396 (1989); Mignery et al., *Gene.* 62: 27-44 (1988), both of which are herein incorporated by reference in their entirety).

Other promoters can also be used to express a fructose 1,6 bisphosphate aldolase gene in specific tissues, such as seeds or fruits. The promoter for β-conglycinin (Chen et al., *Dev. Genet.* 10: 112-122 (1989), herein incorporated by reference in its entirety) or other seed-specific promoters such as the napin and phaseolin promoters, can be used. The zeins are a group of storage proteins found in maize endosperm. Genomic clones for zein genes have been isolated (Pedersen et al., *Cell* 29: 1015-1026 (1982), herein incorporated by reference in its entirety), and the promoters from these clones, including the 15 kD, 16 kD, 19 kD, 22 kD, 27 kD, and gamma genes, could also be used. Other promoters known to function, for example, in maize, include the promoters for the following genes: waxy, Brittle, Shrunken 2, Branching enzymes I and II, starch synthases, debranching enzymes, oleosins, glutelins, and sucrose synthases. A particularly preferred promoter for maize endosperm expression is the promoter for the glutelin gene from rice, more particularly the Osgt-1 promoter (Zheng et al., *Mol. Cell. Biol.* 13: 5829-5842 (1993), herein incorporated by reference in its entirety). Examples of promoters suitable for expression in wheat include those promoters for the ADPglucose pyrophosphorylase (ADPGPP) subunits, the granule bound and other starch synthases, the branching and debranching enzymes, the embryogenesis-abundant proteins, the gliadins, and the glutenins. Examples of such promoters in rice include those promoters for the ADPGPP subunits, the granule bound and other starch synthases, the branching enzymes, the debranching enzymes, sucrose synthases, and the glutelins. A particularly preferred promoter is the promoter for rice glutelin, Osgt-1. Examples of such promoters for barley include those for the ADPGPP subunits, the granule bound and other starch synthases, the branching enzymes, the debranching enzymes, sucrose synthases, the hordeins, the embryo globulins, and the aleurone specific proteins.

Root specific promoters may also be used. An example of such a promoter is the promoter for the acid chitinase gene (Samac et al., *Plant Mol. Biol.* 25: 587-596 (1994), the entirety of which is herein incorporated by reference). Expression in root tissue could also be accomplished by utilizing the root specific subdomains of the CaMV35S promoter that have been identified (Lam et al., *Proc. Natl. Acad. Sci.* (*U.S.A.*) 86:7890-7894 (1989), herein incorporated by reference in its entirety). Other root cell specific promoters include those reported by Conkling et al. (Conkling et al., *Plant Physiol.* 93:1203-1211 (1990), the entirety of which is herein incorporated by reference).

Additional promoters that may be utilized are described, for example, in U.S. Pat. Nos. 5,378,619, 5,391,725, 5,428,147, 5,447,858, 5,608,144, 5,608,144, 5,614,399, 5,633,441, 5,633,435, and 4,633,436, all of which are herein incorporated in their entirety. In addition, a tissue specific enhancer may be used (Fromm et al., *The Plant Cell* 1:977-984 (1989), the entirety of which is herein incorporated by reference).

Constructs or vectors may also include, with the coding region of interest, a nucleic acid sequence that acts, in whole or in part, to terminate transcription of that region. For example, such sequences have been isolated including the Tr7 3' sequence and the nos 3' sequence (Ingelbrecht et al., *The Plant Cell* 1:671-680 (1989), the entirety of which is herein incorporated by reference; Bevan et al., *Nucleic Acids Res.* 11:369-385 (1983), the entirety of which is herein incorporated by reference), or the like.

A vector or construct may also include regulatory elements. Examples of such include the Adh intron 1 (Callis et al., *Genes and Develop.* 1:1183-1200 (1987), the entirety of which is herein incorporated by reference), the sucrose synthase intron (Vasil et al., *Plant Physiol.* 91:1575-1579 (1989), the entirety of which is herein incorporated by reference) and the TMV omega element (Gallie et al., *The Plant Cell* 1:301-311 (1989), the entirety of which is herein incorporated by reference). These and other regulatory elements may be included when appropriate.

A vector or construct may also include a selectable marker. Selectable markers may also be used to select for plants or plant cells that contain the exogenous genetic material. Examples of such include, but are not limited to, a neo gene (Potrykus et al., *Mol. Gen. Genet.* 199:183-188 (1985), the entirety of which is herein incorporated by reference) which codes for kanamycin resistance and can be selected for using kanamycin, G418, etc.; a bar gene which codes for bialaphos resistance; a mutant EPSP synthase gene (Hinchee et al., *Bio/Technology* 6:915-922 (1988), the entirety of which is herein incorporated by reference) which encodes glyphosate resistance; a nitrilase gene which confers resistance to bromoxynil (Stalker et al., *J. Biol. Chem.* 263:6310-6314 (1988), the entirety of which is herein incorporated by reference); a mutant acetolactate synthase gene (ALS) which confers imidazolinone or sulphonylurea resistance (European Patent Application 154,204 (Sep. 11, 1985), the entirety of which is herein incorporated by reference); and a methotrexate resistant DHFR gene (Thillet et al., *J. Biol. Chem.* 263:12500-12508 (1988), the entirety of which is herein incorporated by reference).

A vector or construct may also include a transit peptide. Incorporation of a suitable chloroplast transit peptide may also be employed (European Patent Application Publication Number 0218571, the entirety of which is herein incorporated by reference). Translational enhancers may also be incorporated as part of the vector DNA. DNA constructs could contain one or more 5' non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., *Plant Mol. Biol.* 32:393-405 (1996), the entirety of which is herein incorporated by reference.

A vector or construct may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5: 387-405 (1987), the entirety of which is herein incorporated by reference; Jefferson et al., *EMBO J.* 6: 3901-3907 (1987), the entirety of which is herein incorporated by reference); an R-locus gene, which encodes a product that regulates the production of anthocyanin pigments (red color) in plant tissues ((Dellaporta et al., Stadler Symposium 11:263-282 (1988), the entirety of which is herein incorporated by reference); a β-lactamase gene (Sutcliffe et al., *Proc. Natl. Acad. Sci.* (*U.S.A.*) 75: 3737-3741 (1978), the entirety of which is herein incorporated by reference), a gene which encodes an enzyme for which various chromogenic substrates are known (e.g., PADAC, a chromogenic cephalosporin); a luciferase gene (Ow et al., *Science* 234: 856-859 (1986), the entirety of which is herein incorporated by reference) a xylE gene (Zukowsky et al., *Proc. Natl. Acad. Sci.* (*U.S.A.*) 80:1101-1105 (1983), the entirety of which is herein incorporated by reference) which encodes a catechol diozygenase that can convert chromogenic catechols; an α-amylase gene (Ikatu et al., *Bio/Technol.* 8:241-242 (1990), the entirety of which is herein incorporated by reference); a tyrosinase gene (Katz et al., *J. Gen. Microbiol.* 129:2703-2714 (1983), the entirety of which is herein incorporated by reference) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a scriptable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins detectable, e.g., by ELISA, small active enzymes detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

Methods and compositions for transforming a bacteria and other microorganisms are known in the art (see for example Sambrook et al., *Molecular Cloning: A Laboratory Manual*, Second Edition, Cold Spring Harbor Laboratory Press, Cold Spring Harbor, N.Y., (1989), the entirety of which is herein incorporated by reference).

There are many methods for introducing transforming nucleic acid molecules into plant cells. Suitable methods are believed to include virtually any method by which nucleic acid molecules may be introduced into a cell, such as by *Agrobacterium* infection or direct delivery of nucleic acid molecules such as, for example, by PEG-mediated transformation, by electroporation or by acceleration of DNA coated particles, etc. (Pottykus, *Ann. Rev. Plant Physiol. Plant Mol. Biol.* 42:205-225 (1991), the entirety of which is herein incorporated by reference; Vasil, *Plant Mol. Biol.* 25: 925-937 (1994), the entirety of which is herein incorporated by reference. For example, electroporation has been used to transform maize protoplasts (Fromm et al., *Nature* 312:791-793 (1986), the entirety of which is herein incorporated by reference).

Other vector systems suitable for introducing transforming DNA into a host plant cell includes but is not limited to binary artificial chromosome (BIBAC) vectors (Hamilton et al., *Gene* 200:107-116, (1997), the entirety of which is herein incorporated by reference, and transfection with RNA viral vectors (Della-Cioppa et al., *Ann. N.Y. Acad. Sci*. (1996), 792 (Engineering Plants for Commercial Products and Applications), 57-61, the entirety of which is herein incorporated by reference.

Technology for introduction of DNA into cells is well known to those of skill in the art. Four general methods for delivering a gene into cells have been described: (1) chemical methods (Graham and van der Eb, *Virology,* 54:536-539 (1973), the entirety of which is herein incorporated by reference); (2) physical methods such as microinjection (Capecchi, *Cell* 22:479-488 (1980), electroporation (Wong and Neumann, *Biochem. Biophys. Res. Commun.,* 107:584-587 (1982); Fromm et al., *Proc. Natl. Acad. Sci. USA,* 82:5824-5828 (1985); U.S. Pat. No. 5,384,253; and the gene gun (Johnston and Tang, *Methods Cell Biol.* 43:353-365 (1994), all of which the entirety is herein incorporated by reference; (3) viral vectors (Clapp, *Clin. Perinatol.,* 20:155-168 (1993); Lu et al., *J. Exp. Med.,* 178:2089-2096 (1993); Eglitis and Anderson, *Biotechniques,* 6:608-614 (1988), all of which the entirety is herein incorporated by reference); and (4) receptor-mediated mechanisms (Curiel et al., *Hum. Gen. Ther.,* 3:147-154 (1992); Wagner et al., *Proc. Natl. Acad. Sci. USA,* 89:6099-6103 (1992), all of which the entirety is herein incorporated by reference).

Acceleration methods that may be used include, for example, microprojectile bombardment and the like. One example of a method for delivering transforming nucleic acid molecules to plant cells is microprojectile bombardment. This method has been reviewed by Yang and Christou, eds., *Particle Bombardment Technology for Gene Transfer*, Oxford Press, Oxford, England (1994), the entirety of which is herein incorporated by reference). Non-biological particles (microprojectiles) that may be coated with nucleic acids and delivered into cells by a propelling force. Exemplary particles include those comprised of tungsten, gold, platinum, and the like.

A particular advantage of microprojectile bombardment, in addition to it being an effective means of reproducibly, and stably transforming monocotyledons, is that neither the isolation of protoplasts (Cristou et al., *Plant Physiol.* 87:671-674 (1988), the entirety of which is herein incorporated by reference) nor the susceptibility of *Agrobacterium* infection is required. An illustrative embodiment of a method for delivering DNA into maize cells by acceleration is a biolistics g-particle delivery system, which can be used to propel particles coated with DNA through a screen, such as a stainless steel or Nytex screen, onto a filter surface covered with corn cells cultured in suspension. Gordon-Kamm et al., describes the basic procedure for coating tungsten particles with DNA (Gordon-Kamm et al., *Plant Cell* 2: 603-618 (1990), the entirety of which is herein incorporated by reference). The screen disperses the tungsten nucleic acid particles so that they are not delivered to the recipient cells in large aggregates. A particle delivery system suitable for use with the present invention is the helium acceleration PDS-1000/He gun which is available from Bio-Rad Laboratories (Bio-Rad, Hercules, Calif.) (Sanford et al., *Technique* 3:3-16 (1991), the entirety of which is herein incorporated by reference).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the macroprojectile stopping plate. If desired, one or more screens are also positioned between the acceleration device and the cells to be bombarded. Through the use of techniques set forth herein one may obtain up to 1000 or more foci of cells transiently expressing a marker gene. The number of cells in a focus which express the exogenous gene product 48 hours post-bombardment often range from one to ten and average one to three.

In bombardment transformation, one may optimize the prebombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment, and also the nature of the transforming DNA, such as linearized DNA or intact supercoiled plasmids. It is believed that pre-bombardment manipulations are especially important for successful transformation of immature embryos. In another alternative embodiment, plastids can be stably transformed. Methods disclosed for plastid transformation in higher plants include the particle gun delivery of DNA containing a selectable marker and targeting of the DNA to the plastid genome through homologous recombination (Svab et al., *Proc. Natl. Acad. Sci.* (*U.S.A.*) 87:8526-8530 (1990); Svab and Maliga, *Proc. Natl. Acad. Sci.* (*U.S.A.*) 90:913-917 (1993); Staub and Maliga, *EMBO J.* 12:601-606 (1993); U.S. Pat. Nos. 5,451,513 and 5,545,818, all of which are herein incorporated by reference in their entirety).

Accordingly, it is contemplated that one may wish to adjust various aspects of the bombardment parameters in small scale studies to fully optimize the conditions. One may particularly wish to adjust physical parameters such as gap distance, flight distance, tissue distance, and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the art in light of the present disclosure.

*Agrobacterium*-mediated transfer is a widely applicable system for introducing genes into plant cells because the DNA can be introduced into whole plant tissues, thereby bypassing the need for regeneration of an intact plant from a protoplast. The use of *Agrobacterium*-mediated plant integrating vectors to introduce DNA into plant cells is well known in the art. See, for example the methods described (Fraley et al., *Biotechnology* 3:629-635 (1985); Rogers et al., *Meth. In Enzymol,* 153:253-277 (1987), both of which are herein incorporated by reference in their entirety. Further, the integration of the Ti-DNA is a relatively precise process resulting in few rearrangements. The region of DNA to be transferred is defined by the border sequences, and intervening DNA is usually inserted into the plant genome as described (Spielmann et al., *Mol. Gen. Genet.,* 205:34 (1986), the entirety of which is herein incorporated by reference).

Modern *Agrobacterium* transformation vectors are capable of replication in *E. coli* as well as *Agrobacterium*, allowing for convenient manipulations as described (Klee et al., In: *Plant DNA Infectious Agents*, T. Hohn and J. Schell, eds., Springer-Verlag, New York, pp. 179-203 (1985), the entirety of which is herein incorporated by reference. Moreover, recent technological advances in vectors for *Agrobacterium*-mediated gene transfer have improved the arrangement of genes and restriction sites in the vectors to facilitate construction of vectors capable of expressing various polypeptide coding genes. The vectors described have convenient multi-linker regions flanked by a promoter and a polyadenylation site for direct expression of inserted polypeptide coding genes and are suitable for present purposes (Rogers et al., *Meth. In Enzymol.,* 153:253-277 (1987), the entirety of which is herein incorporated by reference). In addition, *Agrobacterium* containing both armed and disarmed Ti genes can be used for the transformations. In those plant strains where *Agrobacterium*-mediated transformation is efficient, it is the method of choice because of the facile and defined nature of the gene transfer.

A transgenic plant formed using *Agrobacterium* transformation methods typically contains a single gene on one chromosome. Such transgenic plants can be referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and out-crossing with a non-transgenic plant are also contemplated, as is vegetative propagation.

Transformation of plant protoplasts can be achieved using methods based on calcium phosphate precipitation, polyethylene glycol treatment, electroporation, and combinations of these treatments. See for example (Potrykus et al., *Mol. Gen. Genet.,* 205:193-200 (1986); Lorz et al., *Mol. Gen. Genet.,* 199:178, (1985); Fromm et al., *Nature,* 319:791, (1986); Uchimiya et al., *Mol. Gen. Genet.:* 204:204, (1986); Callis et al., *Genes and Development,* 1183, (1987); Marcotte et al., *Nature,* 335:454, (1988), all of which the entirety is herein incorporated by reference).

Application of these systems to different plant strains depends upon the ability to regenerate that particular plant strain from protoplasts. Illustrative methods for the regeneration of cereals from protoplasts are described (Fujimura et al., *Plant Tissue Culture Letters,* 2:74, (1985); Toriyama et al., *Theor Appl. Genet.* 205:34. (1986); Yamada et al., *Plant Cell Rep.,* 4:85, (1986); Abdullah et al., *Biotechnology,* 4:1087, (1986), all of which the entirety is herein incorporated by reference).

To transform plant strains that cannot be successfully regenerated from protoplasts, other ways to introduce DNA into intact cells or tissues can be utilized. For example, regeneration of cereals from immature embryos or explants can be effected as described (Vasil, *Biotechnology,* 6:397, (1988), the entirety of which is herein incorporated by reference). In addition, “particle gun” or high-velocity microprojectile technology can be utilized (Vasil et al., *Bio/Technology* 10:667, (1992), the entirety of which is herein incorporated by reference).

Using the latter technology, DNA is carried through the cell wall and into the cytoplasm on the surface of small metal particles as described (Klein et al., *Nature,* 328:70, (1987); Klein et al., *Proc. Natl. Acad. Sci. USA,* 85:8502-8505, (1988); McCabe et al., *Biotechnology,* 6:923, (1988), all of which the entirety is herein incorporated by reference). The metal particles penetrate through several layers of cells and thus allow the transformation of cells within tissue explants.

Other methods of cell transformation can also be used and include but are not limited to introduction of DNA into plants by direct DNA transfer into pollen (Hess et al., *Intern Rev. Cytol.,* 107:367, (1987); Luo et al., *Plant Mol. Biol. Reporter,* 6:165, (1988), all of which the entirety is herein incorporated by reference), by direct injection of DNA into reproductive organs of a plant (Pena et al., *Nature,* 325:274, (1987), the entirety of which is herein incorporated by reference), or by direct injection of DNA into the cells of immature embryos followed by the rehydration of desiccated embryos (Neuhaus et al., *Theor. Appl. Genet.,* 75:30, (1987), the entirety of which is herein incorporated by reference).

The regeneration, development, and cultivation of plants from single plant protoplast transformants or from various transformed explants is well known in the art (Weissbach and Weissbach, *In: Methods for Plant Molecular Biology*, (Eds.), Academic Press, Inc. San Diego, Calif., (1988), the entirety of which is herein incorporated by reference). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants, as discussed before. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of *Agrobacterium tumefaciens*, and obtaining transgenic plants have been published for cotton (U.S. Pat. No. 5,004,863, U.S. Pat. No. 5,159,135, U.S. Pat. No. 5,518,908, all of which the entirety is herein incorporated by reference); soybean (U.S. Pat. No. 5,569,834, U.S. Pat. No. 5,416,011, McCabe et al., *Biotechnology* 6:923, (1988), Christou et al., *Plant Physiol.,* 87:671-674 (1988), all of which the entirety is herein incorporated by reference); *Brassica* (U.S. Pat. No. 5,463,174, the entirety of which is herein incorporated by reference); peanut (Cheng et al., *Plant Cell Rep.* 15: 653-657 (1996), McKently et al., *Plant Cell Rep.* 14:699-703 (1995), all of which the entirety is herein incorporated by reference); papaya (Yang et al., (1996), the entirety of which is herein incorporated by reference); pea (Grant et al., *Plant Cell Rep.* 15:254-258, (1995), the entirety of which is herein incorporated by reference).

Transformation of monocotyledons using electroporation, particle bombardment, and *Agrobacterium* have also been reported. Transformation and plant regeneration have been achieved in asparagus (Bytebier et al., *Proc. Natl. Acad. Sci. USA* 84:5345, (1987), the entirety of which is herein incorporated by reference); barley (Wan and Lemaux, Plant Physiol 104:37, (1994), the entirety of which is herein incorporated by reference); maize (Rhodes et al., *Science* 240: 204, (1988), Gordon-Kamm et al., *Plant Cell,* 2:603, (1990), Fromm et al., *Bio/Technology* 8:833, (1990), Koziel et al., *Bio/Technology* 11:194, (1993), Armstrong et al., *Crop Science* 35:550-557, (1995), all of which the entirety is herein incorporated by reference); oat (Somers et al., *Bio/Technology,* 10:1589, (1992), the entirety of which is herein incorporated by reference); orchardgrass (Horn et al., *Plant Cell Rep.* 7:469, (1988), the entirety of which is herein incorporated by reference); rice (Toriyama et al., *Theor Appl. Genet.* 205:34, (1986); Park et al., *Plant Mol. Biol.,* 32: 1135-1148, (1996); Abedinia et al., *Aust. J. Plant Physiol.* 24:133-141, (1997); Zhang and Wu, *Theor. Appl. Genet.* 76:835, (1988); Zhang et al. *Plant Cell Rep.* 7:379, (1988); Battraw and Hall, *Plant Sci.* 86:191-202, (1992); Christou et al., *Bio/Technology* 9:957, (1991), all of which the entirety is herein incorporated by reference); sugarcane (Bower and Birch, Plant J. 2:409, (1992), the entirety of which is herein incorporated by reference); tall fescue (Wang et al., Bio/Technology 10:691, (1992), the entirety of which is herein incorporated by reference), and wheat (Vasil et al., Bio/Technology 10:667, (1992), the entirety of which is herein incorporated by reference; U.S. Pat. No. 5,631,152, the entirety of which is herein incorporated by reference.

Assays for gene expression based on the transient expression of cloned nucleic acid constructs have been developed by introducing the nucleic acid molecules into plant cells by polyethylene glycol treatment, electroporation, or particle bombardment (Marcotte, et al., *Nature,* 335: 454-457 (1988), the entirety of which is herein incorporated by reference; Marcotte, et al., *Plant Cell,* 1: 523-532 (1989), the entirety of which is herein incorporated by reference; McCarty, et al., *Cell* 66: 895-905 (1991), the entirety of which is herein incorporated by reference; Hattori, et al., *Genes Dev.* 6: 609-618 (1992), the entirety of which is herein incorporated by reference; Goff, et al., *EMBO J.* 9: 2517-2522 (1990), the entirety of which is herein incorporated by reference). Transient expression systems may be used to functionally dissect gene constructs (See generally, Mailga et al., *Methods in Plant Molecular Biology*, Cold Spring Harbor Press (1995)).

Any of the nucleic acid molecules of the present invention may be introduced into a plant cell in a permanent or transient manner in combination with other genetic elements such as vectors, promoters enhancers etc. Further any of the nucleic acid molecules of the present invention may be introduced into a plant cell in a manner that allows for over expression of the protein or fragment thereof encoded by the nucleic acid molecule.

Cosuppression is the reduction in expression levels, usually at the level of RNA, of a particular endogenous gene or gene family by the expression of a homologous sense construct that is capable of transcribing mRNA of the same strandedness as the transcript of the endogenous gene (Napoli et al., *Plant Cell* 2: 279-289 (1990), the entirety of which is herein incorporated by reference; van der Krol et al., *Plant Cell* 2: 291-299 (1990), the entirety of which is herein incorporated by reference). Cosuppression may result from stable transformation with a single copy nucleic acid molecule that is homologous to a nucleic acid sequence found with the cell (Prolls and Meyer, *Plant J.* 2:465-475 (1992), the entirety of which is herein incorporated by reference) or with multiple copies of a nucleic acid molecule that is homologous to a nucleic acid sequence found with the cell (Mittlesten et al., *Mol. Gen. Genet.* 244: 325-330 (1994), the entirety of which is herein incorporated by reference). Genes, even though different, linked to homologous promoters may result in the cosuppression of the linked genes (Vaucheret, C. R. *Acad. Sci. III* 316: 1471-1483 (1993), the entirety of which is herein incorporated by reference).

This technique has, for example been applied to generate white flowers from red petunia and tomatoes that do not ripen on the vine. Up to 50% of petunia transformants that contained a sense copy of the chalcone synthase (CHS) gene produced white flowers or floral sectors; this was as a result of the post-transcriptional loss of mRNA encoding CHS (Flavell, *Proc. Natl. Acad. Sci.* (*U.S.A.*) 91:3490-3496 (1994)), the entirety of which is herein incorporated by reference). Cosuppression may require the coordinate transcription of the transgene and the endogenous gene, and can be reset by a developmental control mechanism (Jorgensen, *Trends Biotechnol,* 8:340344 (1990), the entirety of which is herein incorporated by reference; Meins and Kunz, In: *Gene Inactivation and Homologous Recombination in Plants* (Paszkowski, J., ed.), pp. 335-348. Kluwer Academic, Netherlands (1994), the entirety of which is herein incorporated by reference).

It is understood that one or more of the nucleic acids of the present invention including those comprising SEQ ID NO:1 through SEQ ID NO:17472 or complement thereof or fragments of either or other nucleic acid molecules of the present invention may be introduced into a plant cell and transcribed using an appropriate promoter with such transcription resulting in the co-suppression of an endogenous protein.

Antisense approaches are a way of preventing or reducing gene function by targeting the genetic material (Mol et al., *FEBS Lett.* 268: 427-430 (1990), the entirety of which is herein incorporated by reference). The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes (Hiatt et al., *In Genetic Engineering*, Setlow (ed.), Vol. 11, New York: Plenum 49-63 (1989), the entirety of which is herein incorporated by reference).

The principle of regulation by antisense RNA is that RNA that is complementary to the target mRNA is introduced into cells, resulting in specific RNA:RNA duplexes being formed by base pairing between the antisense substrate and the target mRNA (Green et al., *Annu. Rev. Biochem.* 55: 569-597 (1986), the entirety of which is herein incorporated by reference). Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression (Takayama and Inouye, *Crit. Rev. Biochem. Mol. Biol.* 25: 155-184 (1990), the entirety of which is herein incorporated by reference). An antisense vector is constructed by standard procedures and introduced into cells by transformation, transfection, electroporation, microinjection, or by infection, etc. The type of transformation and choice of vector will determine whether expression is transient or stable. The promoter used for the antisense gene may influence the level, timing, tissue, specificity, or inducibility of the antisense inhibition.

It is understood that protein synthesis activity in a plant cell may be reduced or depressed by growing a transformed plant cell containing a nucleic acid molecule whose non-transcribed strand encodes a protein or fragment thereof.

Antibodies have been expressed in plants (Hiatt et al., *Nature* 342:76-78 (1989), the entirety of which is herein incorporated by reference; Conrad and Fielder, *Plant Mol. Biol.* 26: 1023-1030 (1994), the entirety of which is herein incorporated by reference). Cytoplasmic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16: 4489-4496 (1997), the entirety of which is herein incorporated by reference; Marion-Poll, *Trends in Plant Science* 2: 447-448 (1997), the entirety of which is herein incorporated by reference). For example, expressed anti-abscisic antibodies reportedly result in a general perturbation of seed development (Philips et al., *EMBO J.* 16: 4489-4496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313-1315 (1997), the entirety of which is herein incorporated by reference; Baca et al., *Ann. Rev. Biophys. Biomol. Struct.* 26:461-493 (1997), the entirety of which is herein incorporated by reference). The catalytic abilities of abzymes may be enhanced by site directed mutagensis. Examples of abzymes are, for example, set forth in U.S. Pat. No. 5,658,753; U.S. Pat. No. 5,632,990; U.S. Pat. No. 5,631,137; U.S. Pat. No. 5,602,015; U.S. Pat. No. 5,559,538; U.S. Pat. No. 5,576,174; U.S. Pat. No. 5,500,358; U.S. Pat. No. 5,318,897; U.S. Pat. No. 5,298,409; U.S. Pat. No. 5,258,289 and U.S. Pat. No. 5,194,585, all of which are herein incorporated in their entirety.

It is understood that any of the antibodies of the present invention may be expressed in plants and that such expression can result in a physiological effect. It is also understood that any of the expressed antibodies may be catalytic.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995), the entirety of which is herein incorporated by reference; Birren et al., *Genome Analysis: Analyzing DNA,* 1, Cold Spring Harbor, N.Y., the entirety of which is herein incorporated by reference).

The nucleotide sequence provided in SEQ ID NO:1, through SEQ ID NO:17472 or fragment thereof, or complement thereof, or a nucleotide sequence at least 90% identical, preferably 95%, identical even more preferably 99% or 100% identical to the sequence provided in SEQ ID NO:1 through SEQ ID NO:17472 or fragment thereof, or complement thereof, can be "provided" in a variety of mediums to facilitate use fragment thereof. Such a medium can also provide a subset thereof in a form that allows a skilled artisan to examine the sequences.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium, and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410 (1990)) and BLAZE (Brutlag et al., *Comp. Chem.* 17:203-207 (1993), the entirety of which is herein incorporated by reference) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means, and data storage means used to analyze the nucleotide sequence information of the present invention. The minimum hardware means of the computer-based systems of the present invention comprises a central processing unit (CPU), input means, output means, and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available and can be used in the computer-based systems of the present invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the present invention, such as sequence fragments involved in gene expression and protein processing, may be of shorter length.

As used herein, "a target structural motif," or "target motif," refers to any rationally selected sequence or combination of sequences in which the sequences or sequence(s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention sequence identified using a search means as described above, and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the nucleic acid molecules of the present invention. A skilled artisan can readily recognize that any one of the publicly available homology search programs can be used as the search means for the computer-based systems of the present invention. Having now generally described the invention, the same will be more readily understood through reference to the following examples which are provided by way of illustration, and are not intended to be limiting of the present invention, unless specified.

EXAMPLE 1

The cDNA library LIB3179 is generated from maize (DK604, Dekalb Genetics, Dekalb, Ill. U.S.A.) jasmonic acid treated leaf tissue from plants at the V4 to V6 plant development stage. Seeds are planted in 4 inch pots containing Metro 200 growing medium on greenhouse tables. Plants are watered when found to be dry (about every 48 hours). NPK 2199 fertilizer is applied once per week. The plants are grown in a greenhouse in 15 hr day/9 hr night cycles. The daytime temperature is approximately 85° F. and the nighttime temperature is approximately 65° F. The light intensity is about 600 microEinsteins. At the V4 to V6 plant development stage, plant leaves are sprayed with a jasmonic acid (Sigma J-2500, Sigma, St. Louis, Mo. U.S.A.) solution (1 mg/ml) in 0.1% Tween-20. Plants are sprayed until runoff. Jasmonic acid treated leaf tissues are collected from plants at 18, 24, and 48 hours after jasmonic acid treatment. Equal weight of leaf tissues from the three timepoints is pooled and frozen immediately in liquid nitrogen. The harvested leaf tissue is stored at −80° C. until RNA preparation. The RNA is purified from the stored tissue and the cDNA library is constructed as described in Example 2.

The subtractive cDNA library LIB3227 is generated by subtracting driver cDNA, which is prepared from leaf and root tissues harvested from maize (H99, USDA Maize Genetic Stock Center, Urbana, Ill. U.S.A.) plants, from target cDNA, which is prepared from maize (H99) immature ear tissue from 8 weeks old plants. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Ears are harvested from 8 week old plants and are approximately 3.5-4.5 cm long. Kernels are dissected away from the cob, frozen in liquid nitrogen and stored at −80 C. until preparation of RNA. The RNA is purified from the stored tissue and the subtractive cDNA library is constructed as described in Example 2.

The subtractive cDNA library LIB3228 is generated by subtracting driver cDNA, which is prepared from leaf and root tissues harvested from maize (H99, USDA Maize Genetic Stock Center, Urbana, Ill. U.S.A.) plants, from target cDNA, which is prepared from maize (H99) microspore tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from immature anthers from 7 week old tassels. The immature anthers are first dissected from the 7 week old tassel with a scalpel on a glass slide covered with water. The microspores (immature pollen) are released into the water and are recovered by centrifugation. The microspore suspension is immediately frozen in liquid nitrogen. The harvested tissue is then stored at −80° C. until RNA preparation. The RNA is purified from the stored tissue and the subtractive cDNA library is constructed as described in Example 2.

The cDNA library LIB3279 is generated from maize (H99, USDA Maize Genetic Stock Center, Urbana, Ill. U.S.A.) anther tissue from 1-2 cm tassels harvested from plants 37 days after germination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected at about 37 days after germination. At this stage, the anthers are green, 1 to 2 cm long, and enclosed in staminate spikelets. The developing anthers are dissected away from the plants and immediately frozen in liquid nitrogen. The harvested tissue is then stored at −80° C. until RNA preparation. The RNA is purified from the stored tissue and the cDNA library is constructed as described in Example 2.

EXAMPLE 2

The total RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. cDNA libraries are prepared using the SUPERSCRIPT™ Plasmid System for cDNA synthesis and Plasmid Cloning (Gibco BRL, Life Technologies, Gaithersburg, Md. U.S.A.), as described in the Superscript II cDNA library synthesis protocol. The cDNA libraries are quality controlled for a good insert:vector ratio.

Target cDNA library is generated as described above from the target tissues described in Example 1. Once a library of satisfactory construction has been made, $10^6$ colony forming units are grown in a large culture and then plasmid target cDNA is isolated for library subtraction. The poly A region of the target plasmid cDNA is blocked with poly T, which is generated using Not I-oligo dT primer following standard PCR procedures.

Driver cDNA is prepared from mRNA isolated from leaf and root tissues and driver first strand cDNA is covalently linked to Dynabeads, following a protocol similar to that described in the Dynal literature. The single strand driver cDNA is then stored on ice until subtraction.

For subtraction, the mixture of the target plasmid cDNA and poly T is heat denatured for 4 minutes at 94° C., immediately placed on ice for 2 minutes, and then mixed with driver cDNA-dynabeads in about 400 μl of 4×SSPE solution. The hybridization solution is heated for 1 minute at 94° C. prior to hybridization at 68° C. for 20 hours. The driver is trapped with a magnetic holder and the hybridization solution is removed from the system for the next round of hybridization with the refreshed driver cDNA-Dynabeads. The driver cDNA-Dynabeads is refreshed by heat denaturation at 94° C. in distilled water for 4 minutes, followed by trapping with a magnetic holder. The water containing the eluted plasmids is removed. The driver cDNA-Dynabeads is then resuspended in the previously removed hybridization solution for a second round of hybridization. This process is repeated a third time. After the third hybridization, the remaining unsubtracted plasmid is concentrated from the hybridization solution by filtration and used to transform *E. coli.*

EXAMPLE 3

The cDNA libraries are plated on LB agar containing the appropriate antibiotics for selection and incubated at 37° for a sufficient time to allow the growth of individual colonies. Single colonies are individually placed in each well of a 96-well microtiter plates containing LB liquid including the selective antibiotics. The plates are incubated overnight at approximately 37° C. with gentle shaking to promote growth of the cultures. The plasmid DNA is isolated from each clone using Qiaprep plasmid isolation kits, using the conditions recommended by the manufacturer (Qiagen Inc., Santa Clara, Calif. U.S.A.).

The template plasmid DNA clones are used for subsequent sequencing. For sequencing the cDNA libraries LIB3179, LIB3227, LIB3228, and LIB3279, a commercially available sequencing kit, such as the ABI PRISM dRhodamine Terminator Cycle Sequencing Ready Reaction Kit with AMPLITAQ® DNA Polymerase (Taq DNA polymerase), FS, is used under the conditions recommended by the manufacturer (PE Applied Biosystems, Foster City, Calif.). The ESTs of the present invention are generated by sequencing initiated from the 5' end of each cDNA clone.

A number of sequencing techniques are known in the art, including fluorescence-based sequencing methodologies. These methods have the detection, automation and instrumentation capability necessary for the analysis of large volumes of sequence data. Currently, the 377 DNA Sequencer (Perkin-Elmer Corp., Applied Biosystems Div., Foster City, Calif.) allows the most rapid electrophoresis and data collection. With these types of automated systems, fluorescent dye-labeled sequence reaction products are detected and data entered directly into the computer, producing a chromatogram that is subsequently viewed, stored, and analyzed using the corresponding software programs. These methods are known to those of skill in the art and have been described and reviewed (Birren et al., *Genome Analysis: Analyzing DNA,* 1, Cold Spring Harbor, N.Y., the entirety of which is herein incorporated by reference).

SEQUENCE LISTING (17472 sequences)

SEQ ID NO: 1 - DNA, 416 bp, Zea mays
  Clone ID: LIB3179-001-P1-K1-A11
attaccataggctcattcatcgaaacgcaaatcagagagacaggaaaagaaaaaagaattttgatcaaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaagaaagagtaaataataaaacaggatattctgtttcataattctgaaatagagttcttttttttagtattactcctcattaggatgtatatattaatcatcctattttaatatatattaatcatcctattttaatta

SEQ ID NO: 2 - DNA, 157 bp, Zea mays
  Clone ID: LIB3179-001-P1-K1-A12
gtttgcagtatcaaagagtttaaactgatgttgtaaccatgcaaaggctgaaaattttaaagagtatgggagaaaccttaatctaaagaaaaaaaaaaaaaaaaaaaaaaaaaaaaaaaaaaaaaaaaaaaaaaaaaaaaataaaaataaattataa

SEQ ID NO: 3 - DNA, 420 bp, Zea mays
  Clone ID: LIB3179-001-P1-K1-A2
gcgcgttgtgagaattcttaattcatgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttcttgtactaacatgtttactttcattgtgggtaacgtattt

SEQ ID NO: 4 - DNA, 256 bp, Zea mays
  Clone ID: LIB3179-001-P1-K1-A3
caacccttccggtttgtgtttaaagtttgcattttttttgcagagctggcggatacggagtcgtaggtgggcttggtacgttgatgatcacagacaggacacgatcggatcggggtagataaagagggataaaagtggaggacggctgtacagacacgtacggagatgccactgctgtgatgagacacgctatttgcagggcgaaccctgttactatcatgtgcttcttgtcaggtaccatatgctactcgatggt

SEQ ID NO: 5 - DNA, 364 bp, Zea mays
  Clone ID: LIB3179-001-P1-K1-A4
gtcttcacactcctcgccgacgaccctgaggccttcgcggagctcaaggtgaaggagctcaagaacggccgcctcgccatgttctccatgttcgggttcttcgtccaggccatcgtcaccggcaagggcccgctcgagaacctcgccgaccacctcgccgaccccgtcaacaacaacgcatgggcctatgccaccaactttgtgcccggcaagtgagggggtggaggcgccaccgcccaccggccaccgctgcggatatctaggtgttcggatgcacgtgagcgcgcactggttccagtttgtaccatgatgtaaattacttaccgtaccagggttcaatcggcaaggaagaattgttgtgttc

SEQ ID NO: 6 - DNA, 361 bp, Zea mays
  Clone ID: LIB3179-001-P1-K1-A5
ggcaaagagattgagaagtctacctccagcatcttcccacttcaaaacgtcttcatccgcaaggtgaagatactcaaggcccccaagtttgatctcgggaagttgatggaggttcatggcgactacaaagaggacgttggtgtgaagcttgagaggcctgtcgagggtgatgaggctatgcaggaggttgctgctgccgagtagtttatttgctacttctttatctagacgaatctggacaggaggtcccttatgacgcgaacttcataaaattgtctggcgacatgttttcttctgtccctgccctaaactctaaacccaaaggttattcgtaacaagtgttttaagattatttttgttt

SEQ ID NO: 7 - DNA, 317 bp, Zea mays
  unsure (1)..(317): unsure at all n locations; Clone ID: LIB3179-001-P1-K1-A6
ctttatccaagctccattttctctgaggaagcgaaccttccctttccccaggcacagatccggctctccgccgccgctatggccgctcgccgcctcctccttctcctcgccgttgtcgccgcgtccctcctggctgccgacgcgcggccgtgccacggcttcctcgtcgccatcccgtccgatcccaaccccgaccccagcagaggcgacggcgccgtcaaccgccacctcggcgctccccacgtcgccacggtcatcaccgtcttccgcgtccgccgcctcggtccacacgtnccccacggtccaccgaaccacca

SEQ ID NO: 8 - DNA, 342 bp, Zea mays
  Clone ID: LIB3179-001-P1-K1-A8
aacggtctgtacctgagtgctcgaacggttgaaggccattcctacctgcagtttgcatcggaagacattggtgacccaagtgtgaggttcatcacctacaaccacaaggtgaacggcaaacgggtggtgcgcttcaagtcgaaccatctcggcaagttctggaggcggagccccaactggatctgggccgacaccgacgacaccagcaccaagaactccgacaccctgttcgaggtcatcaagatcgacgaggacggtgtgtacgcgctccggaacctcggcaacaaccacttctgccacaggctgacctacgacggcaaggagagctgcctgaatgccaca

SEQ ID NO: 9 - DNA, 388 bp, Zea mays
  Clone ID: LIB3179-001-P1-K1-A9
tgcatgatgagattattcaactggagttcagtcattatgatgtcaaatcgtctaaaacaataccagcaaaggattttgcattgtccatggttgcttctgctgacatgaaccatatcaacaagctgcttgatagagttgatagtttggtcaaggagccagatctgaaggacatacgcatcacctttgaggagtttaaggcatttgctgatttgcgacgaagattggagccactgtcgatggctatctttgcttacggtaaattgaatgggttattgacgaaagaggatctaaaacgtgcagcgcaacatgtttgcggggtcgacttaacagatagagtagtagacatcattttccatgtgttcgacacaaatcaagatgggaacttgag

SEQ ID NO: 10 - DNA, 409 bp, Zea mays
  Clone ID: LIB3179-001-P1-K1-B1
cggttggtgtacgagggcgccaatgtgggagatgagttcgtggagacggagtactacaaggacctcggcggcgtcggcgagcagcaccacacgaccggaacgggcttcatcaagatggacaaagctaaaggcgcccccttcaaactgtctgaagatcccaatgcagaggagcgacatgcttcttgcaggggaaaccctgctaccaacgagtggatcccgtcagctgacacggtgtacccggcgtcagacaagccaagcagaagcgacagctgagggactgtatatctccagccatgagaattcagacgagtgctttccaccattagaataagaaaccacactggttgtccaccatatctttactgttctgcgtcgagattcttgtgattcttacgtggaacaaattaag

SEQ ID NO: 11 - DNA, 336 bp, Zea mays
  Clone ID: LIB3179-001-P1-K1-B11
gctgcgttgactcgggtttggtcgacaatattgggttctgtgcgggtaatgccggttgcatcattatggaagacagatgtggaggccgttggccggtgcctgctcgtgatgcgctttccctggatgtcatttgattaattataagcaagtacgtgaagaaacgagggccagacgactgtcgtccagcgattggttatttgtgaacttgtcgtttgtcttcttatttcaactttccaataagccccttcgtgaagtgtcatccgcttcaaagtctgtcgactgttacgtatacaaatctatatatcaaattaagacggcgcccgtaccgtgtgtatt

SEQ ID NO: 12 - DNA, 373 bp, Zea mays
  Clone ID: LIB3179-001-P1-K1-B12
gttccgacatggttgacatccatgcgtcgatcctctttcaggccctgcactgcgagaagaagtaccttcgcatccaggatgatactttgactgggaacgcatcgtccgtggacatcgccaccaaggagaacatggagtctctgatatcgatcggccaggagctgctcaacaagccagtggcgagagtgaacatcgacacagggctgtacgagtcctgcgagggtgagggcacaaatgcacagtcgctagctgacttcgccaagcagctctctgacgagcgcaagctacgcaagagcaatctcaacttcaactaataaataccttttggtcacagcatgtgctcttttttgtggatcaccggttcttattttta

SEQ ID NO: 13 - DNA, 145 bp, Zea mays
  Clone ID: LIB3179-001-P1-K1-B2
ggttggtgtacgaggactccaatgttttttatgagttcgcggagacggtgttcggggaggtttttagaggtcttagccagctccactatacgaccggtacgggtactaaaaagactgacatagctaaaggcgcccgttttaaact

SEQ ID NO: 14 - DNA, 409 bp, Zea mays
  Clone ID: LIB3179-001-P1-K1-B3
tccggttttggtttacaccttggcttttgaaggccagggctgcctgttccgcgttcgtctttgggttcgttacgttcatgtccattggaggattcccttcgttcgttgaagaaatgaaggtcttccagcgggaacggctgaacgggcactacggtgtcgcggcgtttgtcatcagcaacaccatctcggcaacgccgttcctgattctgatatgcttcttgtcgggaaccatatgctacttcatggtgcgcctccatcctggcttcgagcactacatcttcttcgtcttgaacctgtacgccagcgttacggtggtcgagagcttgatgatggcgattgccagtgtcattcccaatttcctcatgggtatcatcataggggccgggattcagggaatattcatgctggt

SEQ ID NO: 15 - DNA, 375 bp, Zea mays
  Clone ID: LIB3179-001-P1-K1-B4
cggacgcgtgggctactcacgccgtactgtctgattggcaacacctcgtgtacacgtaggcccggagatatggcatcgccggtggccatcggcacggcggtgttccagcgggggccgctccgcgtggaggcgaggcacgtcgactacagccaggtccccagcgtgcccaagccgctcatggtggtcgcccccaccgacgccggcgtgtaccccgtggccgtcttcctgcacggctgcaacacggtcaacagctggtatgagagcctcctgtcgcacgtcgcgtcccacgggttcatcgccgtggcgccccagctctactgcgtgacgctcaacatgaacgacttgaaggacatcgacgccaccaggcaggtcacc

SEQ ID NO: 16 - DNA, 258 bp, Zea mays
  Clone ID: LIB3179-001-P1-K1-B5
caccatattattctcaattcactttgtttcttcataaatcacaaaagatatcacagccaactcaactgcctctgccccggcaaaaacaactccaaagacctataaaactgtctctttacccgcccagcttctgataatccgaaatggagcagcatgtatgtatattaccaaaaacaagatggaaaaaagcacaaacacccgctgctccaatagcacccgtaaataaaccaatgcccgcatgaacttgacttacaaata

SEQ ID NO: 17 - DNA, 367 bp, Zea mays
  Clone ID: LIB3179-001-P1-K1-B7
tgcatgatgagattattcaactgtttttcagtcattatgatgtcaaatcgtctgggacaataccagcaaaggattttgcattgtccatggttgcttctgctgacatgaaccatatcaacaagctgcttgatagagttgatagtttggtcaaggagccagatctgaaggacatacgcatcacctttgaggagtttaaggcatttgctgatttgcgacgaagattggagccactgtcgatggctatctttgcttacggtaaattgaatgggttattgacgaaagaggatctaaaacgtgcagtgcaacatgtttgcggggtttacttaacagatagagttgtagacatcattttcatgtgttcgacaca

SEQ ID NO: 18 - DNA, 127 bp, Zea mays
  Clone ID: LIB3179-001-P1-K1-C10
accctagaggccacaactgccaacttgccaatggctgtcgtccgacagcgccggcagctgtcgaaccttaccctcccgctggaccacttcgccctgcgcgtgccatcgcagtcttagaccaccgtcg

SEQ ID NO: 19 - DNA, 408 bp, Zea mays
  Clone ID: LIB3179-001-P1-K1-C3
ctccgaaataccacaaacacccccaatcccacccagaatccggcggaagtcaagccaacctccgtcctccatccatgggcgagcaatccctctcccagcccaaggcccagcctctctccccgttcccgtcgcctcccgcctccgccgcgttgccgccccccgcctctgcctctgcctctgcctctgctgcctccacctcccgcaccaccagcgccgcggcctcgcgccccaagaagaaggtgacgaacccatcgcccgaccgtaacccggcaaagaagccccgcctgacgttctcgatcccgggccggcccctgtccgcagtcggcgaggtgggcgtggccatccgctacctgcgcgccgcggaccccgccctcgccgtcgtcattgacgcgcacgagccccccgtgt

SEQ ID NO: 20 - DNA, 406 bp, Zea mays
  Clone ID: LIB3179-001-P1-K1-C6
gatgcagcccatcaacggcgaccccttcatcggcagcctggagacgccggtcacctcgagcccgctcgtggcgtggtacctctccaaccttccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcaccatgtacggcgtcgcctccttcaacgagggggacccgttcacggcgccctcgctcacgctcaccggcaggaagaaggaggccgacaagctgcaaaacctccaccgctgggccaagttcaccgggggattctttttt

SEQ ID NO: 21 - DNA, 383 bp, Zea mays
  Clone ID: LIB3179-001-P1-K1-C8
gccacaccgtccaccggcacgtccaccggctcccatggcgctccacgccgtctgctccgcggcggtctcctccccgttgcgcgccctctcacgcagcctcccccagcgcccaggctgtggttgtttaccaaagcagtccgtcatgatttactccacaaaatttgcaagacctcaggctggaccggtggacttcgctggcaggcctctggttcttggacgctcggacaagagagcagttttgatgcatgccactattgaagaaatcgaagcggagaaatccctcatcgaagaccaagctaaagaaaagatggagaaggcaatcgaaacagtccaagctaacttcaacactgtgaggacaggacgtgcaaacctcgccatgcttg

SEQ ID NO: 22 - DNA, 407 bp, Zea mays
  Clone ID: LIB3179-001-P1-K1-D1
ctcaactacagggaaatcagccatgagtgcgtcgtcggcgaagccagccaccggcggcaagacgtcgtggccggaggtggtcgggctgagcgtcgaggaagccaagaaggtgattctggcggacaagccgaacgccgacatcgtggtgctgcccaccaccacgcaggcggtgacctccgactttgggttcgaccgtgtccgcgtcttcgtcgggaccgtcgcccagacgccccatgttggctaggctagagcctcagcctagaggtcgtcggcaccgccggccatgaccacctgctatatgtcactactagtaataaagtataaataacagggaggatgcatgctcatccttggaatctgtacgcttgttggactactacttggctacttgaaacgactacttggct

SEQ ID NO: 23 - DNA, 355 bp, Zea mays
  Clone ID: LIB3179-001-P1-K1-D11
cgcaaacgcaagctcccaagcagctaccaaccagccgggagagggagcgcacgcactgcgacaatggccacggccggcggaggggccgggcatctgaagctgctgggcgcgtggccgagccccttcgtgaaccgcgtacgcatggcgctgcacctcaaggggctggagtacgagaacgtggaggaggacctcaccaacaagagcgacctgctcctcgcctccaaccccgtccacaagctcgttcccgtcctcctccacggcgacaagcccatctccgagtcactcgtcatcgtggagtacctcgacgacgccttccccggcgctggccaggccgttcttcccgccgacccctatg

SEQ ID NO: 24 - DNA, 266 bp, Zea mays
  Clone ID: LIB3179-001-P1-K1-D12
tccatcttctgctgggtagcagcttgcagtatacaagagcttgcttgctgtcctagtcctacctactgacgagctcgccatggcctccctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggtccaagaggtgctgt

SEQ ID NO: 25 - DNA, 185 bp, Zea mays
  Clone ID: LIB3179-001-P1-K1-D2
ctttattattgttgttgttattattaatttgactcgctatagtgtgtcgtgttcatagcaccaccaccgcgccatcgacatgccacacctgtgctctgtctgtcacgtcacgtgcgagtcctactacgggaaaaaatgcatggtaatcgtggagttgcttctcaaaagaaaaaaaaccgaaaacg

SEQ ID NO: 26 - DNA, 333 bp, Zea mays
  Clone ID: LIB3179-001-P1-K1-D3
agtcacactctcatttcgccgccgccgccgccctgcactccgtgaggagagccgaccgctgccctgcgacactacacctgggcaagttccatgaccacgggctcaggtccggccgttctaagagatccggttcagcgagggtgggcgccttcccgtcgctggacgtggtgccgctgatggtgacgatggtggagcacgtggacatgtcgcgggactacgtcgtgaccaagtccatctggcatctcagcgacgtagccctcaagagcgtctataccttctacgccatgttcaccgtctggggagtctgctttttcgcgttcatgaaggatccct

SEQ ID NO: 27 - DNA, 214 bp, Zea mays
  Clone ID: LIB3179-001-P1-K1-D4
cgacccacgcgtacgtatacgatcccactcggcagcggggtgtcgcaatggacacccacgcagctctcggcgccttccgcatacacgccggcgcccggctgcacagcagggcgccgtggttggcaggcacggcgtgcagaggttggacattcgctcacttcttcgggctcacgccggggtcatggtccgcgagcgctgtctgacgggaggcagg

SEQ ID NO: 28 - DNA, 489 bp, Zea mays
  unsure (1)..(489): unsure at all n locations; Clone ID: LIB3179-001-P1-K1-D5
cgggtcggacccacgccgtccgagcggcaaggtacactctctgggctacaatgtaccgnntcctcaagacgctntngcgcaactccaaggggaaaggctgatctatcanntcgcaaacannactgccctctcacttaggaagtctgagattgagtacctactgccatgcttgtgccaaagttaggcgtgcactcatttccacgtgaaacagatgtgtgagtcttggcacctgctctgtcggcgaagtacctacagcggatgtgggctgcctgcagtatcaatcgaccacaaggtgacttcggaccatcatcagttaccactccctggcacctcagtgaggccagctcccggcaccccattgcaagcttgcttcgccctttctcaaagatgaagattgagatgttagcgcttcccggccctatgtccccgttccttttttttatctntttagctatgtaaattttgctacccatgtgtccatctaccata

SEQ ID NO: 29 - DNA, 332 bp, Zea mays
  Clone ID: LIB3179-001-P1-K1-D6
gcatttttgggatacgctgtgggtatgacggtgaccatcgttgtaatgaactggtttcaagcggcgcagcctgctctactataccttgttcctggtgtgattggttttgtcgctgttccctgtctgtggtatggagaagtgaaacagctactggagtttgacgagtcaaaaactgagtcggaggaaggcagtacagaagaggagcaagatgatgatagttccaaaggcaacaaaaaggtggactagcaggatttagttccggaggtaaaaggacaggaagacagttttcgtgtaatgtcgtctggcagcttaaaaaacggggtctgatgacc

SEQ ID NO: 30 - DNA, 209 bp, Zea mays
  Clone ID: LIB3179-001-P1-K1-D9
acgggcataaaatgaataggcaacttttttacaatcaatacgatgtgactgcggggggggaggtaccagtacatcaataaggacagccaaaccaaaataagtctgttatgaatcatattatcgtgctggctgatacacgtggttgtcctgacaaggtgccacattctcacggcatacgttagacccttggggtgttaacggcaggtgct

SEQ ID NO: 31 - DNA, 278 bp, Zea mays
  Clone ID: LIB3179-001-P1-K1-E10
aaagccagagaacattttactttatagagatgggcacatttcattgacagactttgatttgtcttgcttgacattctgccgaccacaagtgtttcttccacacgatattgataagaagaaaaagaggaggaagagcaggagtaatcccatattttttgctgaaccaatgcgagcatcaaattcttttgttggtacagaggagtacattgcaccggagattattaccggagctggccatacgagtgctgtagattggtgggcgctaggaattcttttat

SEQ ID NO: 32 - DNA, 119 bp, Zea mays
  unsure (1)..(119): unsure at all n locations; Clone ID: LIB3179-001-P1-K1-E11
cgaggacaaaatggaaaagaaacatgtggtatgtgtgtgttaataaggagcgaggtcgagttggctgccatacataggtatngtgtggtgtgtgttagagagagagaaacaggttttta

SEQ ID NO: 33 - DNA, 320 bp, Zea mays
  Clone ID: LIB3179-001-P1-K1-E12
atccactactttactcaaagtctagtagccagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttcttcgtccagacgcccttgtacctgaccggcgagttccccggcgactacggctggga

SEQ ID NO: 34 - DNA, 321 bp, Zea mays
  Clone ID: LIB3179-001-P1-K1-E3
gaggttggaataactttcttggttggttggggatgaattggaatgggcctaaaactcttttagtcattagagttggaagtgaagacaactcccacccgtaacttgtgtatgtacagtatatatatgtattacctattcttcgctacatctttgaaggtgtatctgttgggattttcgggaggggctcaatttaaatgcggttaaatggcctttgggttttacggggtcacgagtgaggggagaagggaagggaagggaagggaagggaagggatggaggttgattcaaataataatgtctattaaatttgattatgctaaa

SEQ ID NO: 35 - DNA, 333 bp, Zea mays
  Clone ID: LIB3179-001-P1-K1-E7
gtgcaacaagcaagatttacctgcctatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttccttttcttgccccaaaactt

SEQ ID NO: 36 - DNA, 136 bp, Zea mays
  Clone ID: LIB3179-001-P1-K1-E9
gacagataaagtatcctacacctctatttactatagccatttttccctctggcggcggtcttaaattttatcaaccatcacctacaccgtaaaaccattatccgagcctaatctgaagagcggtcatacgaaacct

SEQ ID NO: 37 - DNA, 399 bp, Zea mays
  Clone ID: LIB3179-001-P1-K1-F5
cactgctcagctagcgtccacctccacttcctatcgccatctctccccctttcggcatgcttctctctcctctgccatcgcgtccgccgccccaccgccatccgcgccgaagctgaagtgcggcctccgctacctgtctccgcggcggagtcagagccccctgacgccggcgctgtggaagccgaaggtcagggacccgtggagctccgcgctccgacgctcttctcgactgatgacaatcccaccccgctccagactgccaccagtctcctcctcaccggcgccatctcggtctttctctttcgcgccctccgccgccgcgcccgtcgcgccaaggagcttagagtgcggtcgagcgggttgaagaagcccaacaatctcaccgaggaggccctggag

SEQ ID NO: 38 - DNA, 228 bp, Zea mays
  Clone ID: LIB3179-001-P1-K1-F6
caccaaccagcagccgcaccacgcatttagcgcaaagcgatggcgtcgctcaccatgatggcgtccttcgccgccgtggcggtggccgcgccctcgcgccgtggcaccttcgtcgtggtcaggtccgccaaggtcgaccgctgccaggagcccgccacgctagcagcaacctaggccaggcccgccgtcgacggacgccgagccgtcatgctcgcggctgctgcggcg

SEQ ID NO: 39 - DNA, 265 bp, Zea mays
  Clone ID: LIB3179-001-P1-K1-F7
gccagcagcgccctcggagatttcggcgactccaagacggtgtcgctgtgcgtgaggaggctggtctacaccaacgatcagggggaggtcgtcaaaggagtctgctcgaacttcctctgtgacttgaagccaggcgctgaggtgaagatcacagggccagtgggcaaggagatgctcatgcccaaagaccccaacgcaacaatcatcatgctcgcaacgggtaccggcatcgctccgttccgctcctttttgtggaagatgttct

SEQ ID NO: 40 - DNA, 389 bp, Zea mays
  Clone ID: LIB3179-001-P1-K1-F9
tgtcttttttttttatgagataaagtttgaatgctagaattaatgaagttcgctactttcttcgtaggggtgtatggcacatactacacaattgatgtttcatgaatatatatacatatctaccaaaaaaagggttacacctgcagagttgctgcagctaattgtacaatttacataaactgaagcgatggaaggacgaatcagctctccaaggtctctagggctgctatctggagttgtcctttgaagcatctggtgtggaggtgctatcagaattccttgcctctgacttttcgtttgagtacgtcgacaatattgtgacccagacaagcttcacacagtcgacccatagaagtctttgctcaacaggaaccacaccatatgtaatt

SEQ ID NO: 41 - DNA, 251 bp, Zea mays
  Clone ID: LIB3179-001-P1-K1-G10
ggcaaacacaagcttccaattagttattaataccagacggcagagggagcgcgcggggggtgacaatggttcatacgtacggcggaaggaacggtcatttgacgctgctgggcgcgtggccgagcccattggagaaccgcgagcgcatggcgctgtacctcaaggggctggagtacgagaacgtggtggaggacctgatcaacaagagcgacctgtttattgtctttaacctcagctacacgctcgttatg

SEQ ID NO: 42 - DNA, 218 bp, Zea mays
  Clone ID: LIB3179-001-P1-K1-G11
ccctcaactacagggaaatcagttatgtttgcgtcgccggctaagccagccggcgggggtatgacatttttgtcggaggtggtcacgctgagcgttatggaagccaagaaggtgattttggcggacaagccgaacgcctacatcgtggtgctgtccaccaccacgcaggcggtgacctttcgactttgggttcgaccgtgtacgtgtcttcgttctgg

SEQ ID NO: 43 - DNA, 294 bp, Zea mays
  Clone ID: LIB3179-001-P1-K1-G12
ccctcaactacagggaaatcagtttttagtgcgtcgtcggcgaagccagccacggtgggcaagacgtcgtggccggaggtggtcgggctgagcgtcgaggaagccaagaaggtgattctggcggacaagccgaacgccgacatcgtggtgctgtccaccaccacgcaggcggtgaccttcgactttgggttcgaccgtgtccgcgtcttcgtcgggaccgtcgcccagacgccccatgttggctaggctagagccttaatctatatggtgttggcaccgtcggtcatgaccacc

SEQ ID NO: 44 - DNA, 408 bp, Zea mays
  Clone ID: LIB3179-001-P1-K1-G2
cgcgccccgcgcccctcgccgtttccgccggcgcaggagccaggaagctacccgcagccagcctcgcattcccggcgaaatccttcttcggcgcgccgctggccgccaccgcggcctccgtcgcgtcgccgctcccgcgcaagccggccacctccaccacctcgctcgaggtcgtcgcggcggggaagaagggctacaagatgaagacgcacaaggcgtcggcgaagcggttccgggtgacggggaggggcaagatcgtgcggcggtgcgccgggaagcagcacttgctcgccaagaagaacaccaagcgcaagaagaggctctcgaagatggtgcaagtcaacaagagtgactacgacaatgttacgggtgcactgccctacctcaaagtgaataggaaagcaaact

SEQ ID NO: 45 - DNA, 429 bp, Zea mays
  Clone ID: LIB3179-001-P1-K1-G5
caaacccgcacgacacgacaccaagtcgaggagctcgagggcaccaatcatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctgccagttcccctacaacttcactgggtgccaggacctcgccaagcagaagaaagttctcctcatcagcgacgacctcgagat

SEQ ID NO: 46 - DNA, 288 bp, Zea mays
  unsure (1)..(288): unsure at all n locations; Clone ID: LIB3179-001-P1-K1-G7
gaaacaagttgtgcaagtgcagcaagtagatcaaaagtgctgcctgtttgtatcgatggatcctgcaacatatagcatctggtgatgttgagaattcggagcagttcatcgactggattctgacgccggcaagcatcgacgtcaatgaatgtctaatacttagtacatcaagacatgtaataaaactgaaactcccccgttctggttctgattactgtaaccctaatccatgtatcttcagtttctgaactctggcgagaaagtcttnnataaaatattaaaatgtgt

SEQ ID NO: 47 - DNA, 60 bp, Zea mays
  Clone ID: LIB3179-001-P1-K1-G8
accggatctaggatcgcgagtcgtgccgcttctatatggatccaagtcttactgtacgcg

SEQ ID NO: 48 - DNA, 373 bp, Zea mays
  Clone ID: LIB3179-001-P1-K1-G9
agcgcttatagcttgtcagccatggtcaccgccgccgcgtctagcctcctcaggtgctgcttcgcgggctcccggctcccggccgccacgcggaccacaccggcgtccctcgtggtggccaccggcccgcgcggcgccggcgcggggcccatctgcgcgtccatgtccatgtccttctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgtggtgctgttctgcgcgtacgagctcttcaaggacccctccgtgagcattgcca

SEQ ID NO: 49 - DNA, 178 bp, Zea mays
  unsure (1)..(178): unsure at all n locations; Clone ID: LIB3179-001-P1-K1-H2
gcaatatcattttctaccactttttattcctaacgctgagctttatatgtactacgatatcttatatgatgaataataatatgaccgccttgtgatctaaaaaaaaaaaaaaaaaaatantaaaaaaaaaaaataaaaaaaaaataaaaaaaaaaaaaaaaaaaaaaaaatttttttt

SEQ ID NO: 50 - DNA, 345 bp, Zea mays
  Clone ID: LIB3179-001-P1-K1-H3
gcctcgcctcctcttctcgtcgagcggatgtgcaagctccggccggagcgtcaggataagaaccgcgcggcggcaggcagctcctcctgcgactgcgagcgcccgtccaatggcgtccctctccccttccctccacctcccttgcaattcaagaactggcttccttggaaagacacgtgggattcgtccttgtgttttccctgctggaagagttggatttgtcagaacagtagtggaatgcaaggaatctagaattggaaagcagcccatcgaagttccatcaaatgttactctcacattagaagagcagtttgtcaaagctaagggttcgctgggggagttatc

SEQ ID NO: 51 - DNA, 416 bp, Zea mays
  unsure (1)..(416): unsure at all n locations; Clone ID: LIB3179-001-P1-K1-H5
acgcgnncagacgggaacggggatgggaagcgcttttgcgctgctctggcacacgccgcagcagcggcacggccgtggcatcctcttccgccagagccggcctctcctgcgccagcgcaacctgcctctaatatcgctagctgccccggcgctcgagcccgagcgccgccgccggcagtgcctccgctgcgctgccgtcgacggggacggcgccctccgggagtctgggccactgccacagaaggagtctccgtccagcggcatcggtgccgcactcgaggacccgcctccaggacctcctgtggagaatggttcctttggaggcccctcacaggaagaacagagtgctctatatacttttctttatccaagcaaagacttacttccagatgataaggagatgagtatatttgatc

SEQ ID NO: 52 - DNA, 364 bp, Zea mays
  Clone ID: LIB3179-001-P1-K1-H7
gcgaccacgcgtccggcatgtcttccctgtgcatgctttctatcagcagcaccccacatgttccgcacggctgcattcgacgatttatcgaccccgactcatataggtccagatcctacctcgtttgccaaagtcacctcccgtccgggccgttgtcaagtgtttgtttcttcgtaggtaggattgttctatttcttaccttctttatattattgtcattttatttatttacaatcttaaattattatcatattatatttttatgatatcttttattcctatgttatattattatttattttttggtggggggtggtttttattttatttttttttatctctgttatatatatatttaatttat

SEQ ID NO: 53 - DNA, 458 bp, Zea mays
  Clone ID: LIB3179-001-P1-K2-A12
attaccataggctcattcatcgaaacgcaaatcagagagacagtttatgtttaaaagaattttgatcaaatcaatagaaggaaggatcccttacctggtgtgaatttcatcctcctttaaataggatatgctctaagtctttccatactttcctataatgactgcaacgattttctccattttgcgaattcctattttatttgaagtatattactatcatatacattatctaaatcgatccactttaaattaaatagaaataatcgaaagaaaaaaaaaaatgtaagagtaaataataattcaggattatctgcttcataattcttagaatagagttcttttttttagttttcctccttattaggatgtatatatttatcattctattttaatttttatttatcttctatttctatgtggttctaattcatttattaataagttttttcttttttttt

SEQ ID NO: 54 - DNA, 467 bp, Zea mays
  Clone ID: LIB3179-001-P1-K2-A4
gcctcgcctcctcttctcgtcgagcggatgtgcaagctccggccggagcgtcaggataagaaccgcgcggcttcaggcagctcctgctgcgactgctagcgcccgtccaatggcgtccctctccccttccctccacctcccttgcaattcaagaactggcttccttggaaagacacgtgggattcgtccttgtgttttccctgctggaagagttggatttgtcagaacagtagtggaatgcaaggaatctagaattggaaagcagcccatcgaagttccatcaaatgttactctcacatttgaagagcagtttgtcaaagctaagggtccgctgggggagttatctttgagctttccaggtgacttgtagatcgtgaaagaagaatccggtaacctgagaagtttattagactgcagagaccaagagggcgaaccagatgcccggacttttcagaacattgacagac

SEQ ID NO: 55 - DNA, 363 bp, Zea mays
  unsure (1)..(363): unsure at all n locations; Clone ID: LIB3179-001-P1-K2-A5
gtcgcacactcctcgccgacgaccctgaggccttcgcggagctcaaggtgaaggagctcaagaacggccgcctcggcgtgttctccatgttcggggtcggggtccaggccatcntcaccggcaagggcccgctcgagaacctcgccgaccacctcgccgaccccgtcaacaacaacgcatgggcctatgccaccaactttgtgcccggcaagtgagggggtggaggcgccaccgtccaccggccaccgctgcggatatctaggtgttcggatgcacgtgagcgcgcactgttttcagtttgtaccatgatgtaaattacttaccgtaccagggttcaatcggcaaggaagaattgatgtgttc

SEQ ID NO: 56 - DNA, 361 bp, Zea mays
  Clone ID: LIB3179-001-P1-K2-A6
ggcaaagagattgagaagtctacctccagcatttttccacttcaaaacgtcttcatccgcaaggtgaagatactcaaggcccccaagtttgatctcgggaagttgatggaggttcatggcgactacaaagaggacgttggtgtgaagcttgagaggcctgtcgagggtgatgaggctatgcaggaggttgctgctgccgagtagtttatttgctacttctttatctagacgaatctggacaggaggtcccttatgacgcgaacttcataaaattgtctggcgacatgttttcttctgtccctgccctaaactctaaacccaaaggttattcgtaacaagtgttttaagattatttttgttt

SEQ ID NO: 57 - DNA, 409 bp, Zea mays
  Clone ID: LIB3179-001-P1-K2-A9
aacggtctgtacctgagtgctcgaacggttgaaggccatccctacctttagtttgcatcggaagacattgttgacccgaggtgtgaggttcatcacgtacggccacaaggtgaacggcaaacgggtggtgcgcttcaagtcgaaccatcttggcaagttctggaggcggagccccaactggatctggttcgacaccgacgacaccagcaccaagaactccgacaccctgttcgaggtcattaagatcgacgaggacggtgtgtacgcgctccggaacctttgcaacaaccacttttgtcacaggctgacctacgacggctaggtgagctgcctgaatgccacaatttcgaccatcatgaaggaggcgcacatcaagatcgaagaagccgtccttttctggtagatcttc

SEQ ID NO: 58 - DNA, 555 bp, Zea mays
  Clone ID: LIB3179-001-P1-K2-B10
cggaaaacccggggtttgcagtatcaaaagagtttaaactgattttgtaaccattcaaatttttaaaattttaaagagtattgttacaaacgcgtaattttaataaaaagagatggtgttaaaaaaaaaaaaaaatataaaaaaaataaaatatatttttattaaaaaaaattatttttaaataaaattttttgttttttaaaaattattttttttttattatatattttttattattaataataattttttatttaccttttatttttttttttatataaattatttttatttattctactaacattattttttttttataatttattatttaaattttttttataatttatatttaattatttattattttttattttataaattttaatataattaaatttatttattattctatattatatataatattttttaatttttcatattcttctatttatttttatattataattataattatatatattttctcatattattttatattattatataattttatataatataattattatattaatattttat

SEQ ID NO: 59 - DNA, 313 bp, Zea mays
  unsure (1)..(313): unsure at all n locations; Clone ID: LIB3179-001-P1-K2-B12
tcggctgcgttgacctcgggttntggtcgacaatatttgtggttctgtgccgggtaatggccggttgcatgcattatgtgaagtacagatgttggaggctcgttgtctcggtgccttgctcgagatgctgcttttcctgtgatgtcattttgattacattataatgcttgtacgtgtttgtaacgttgtctcagactttctgttgacctatcgtttggtctattcgttaactttgtcgttagtatatattatttttactttatcaattaatctctattatcttaattgtttttcctctaattaattttttttt

SEQ ID NO: 60 - DNA, 408 bp, Zea mays
  unsure (1)..(408): unsure at all n locations; Clone ID: LIB3179-001-P1-K2-B2
acgggttggtgtacgagggcgccaatgtgggagattagttcgtggagacggagtactacaanggcgtcggtctcgtcggcgagctgggcacacaacctgaacgggcttcatcaagatggacaaagctaaaggcgcccccttcaaactgtctgaagatcccaatgcagaggagctacatgcttcttgcaggggaaaccctgctaccaacgagtggatcccgtcagctgacacggtgtacccggcgtcagacaagccaagcagaagcgacagctgagggactgtatatcttcagccatgagaattcatacgagtgctttccaccattagaataagaaaccacactggttgtccaccatatctttactgttctgcgtcgagattcttgtgattcttacgtggaacaaatta

SEQ ID NO: 61 - DNA, 54 bp, Zea mays
  unsure (1)..(54): unsure at all n locations; Clone ID: LIB3179-001-P1-K2-B4
gcgccagcgcgtgccagctttaatcccaagcctccnaattttctnnctgaggaa

SEQ ID NO: 62 - DNA, 352 bp, Zea mays
  Clone ID: LIB3179-001-P1-K2-B5
cggacgcgtgggctactcacgccgtactgtctgattggcaacacctcgtgtacacgtaggcccggagatatggcatcgccggtggccagcggcacggcggtgttccagcgggggccgctccgcgtggaggcgaggcacgtcgactacagccaggtccccagcgtgcccaagccgctcatggtggtcgcccccaccgactccggcgtgtaccccgtggccgttttcctgcacggctgtaacacggtcaacagctggtatgagagccttttgtcgcacgtcgcgttccacgggttcatcgccgttgcgccccagcattactgtgtgacgcttaacatgaacgtcttgaaggaca

SEQ ID NO: 63 - DNA, 452 bp, Zea mays
  Clone ID: LIB3179-001-P1-K2-B7
tgcatgatgagattattcaactggagttcagtcattatgatgtcaaatcgtctaaagcggtaccagcaaaggattgggggtggtccatggttgcttctgctgacatgaaccatatcaacaagctgcttgatagagttgatagtttggtcaaggagccagatctgaaggacatacgcatcacctttgaggagtttaaggcatttgctgatttgcgacgaagattggagccactgtcgatggctatctttgcttacggtaaattgaatgggttattgacgaaggaggatctaaaacgtgcagcgcaacatgtttgcggggtcgacttaacagatagagtagttgacatcatttttcatgtgttcgacacaaatcatgatgggaacttgagcccagaagaggtcttaagagcgttacaaagaagagaaactgttattcttgaaccaacaatacca

SEQ ID NO: 64 - DNA, 456 bp, Zea mays
  Clone ID: LIB3179-001-P1-K2-C1
gctttcgctctacaccttgcctctgcaggccagggctgcctgttccgcgttcgtctttgggttcgggacgttcatgtccattggagggttcccttcgttcgttgaagaaatgaaggtcttccagcgggaacggctgaacgggcactacggtgtcgcggcgtttgtcatcagcaacaccatctcggcaacgccgttcctgattctgatatgcttcttgtcgggaaccatatgctacttcatggtgcgcctccatcctggcttcgagcactacatcttcttcgtcttgaacctgtacgccagcgttacggtggtcgagagcttgatgatggcgattgccagtgtcattcccaatttcctcatgggtatcatcataggggccgggattcagggaatattcatgctggtctctggctacttcagacttccatacgacatcccgaaagcccttttggagat

SEQ ID NO: 65 - DNA, 427 bp, Zea mays
  Clone ID: LIB3179-001-P1-K2-C10
gtgccgacatggttgacatccatgcgtcgatcctctttcaggctctgcactgccagaagaagtaccttctcatgcgaggatgatactttgactggtgacgcatcgtccgtggacatcgccaccaaggagaacatggagtctctgatatcgatcggccaggatctgctcaacaagccagtggcttgagtgaacatcgacacagggctgtacgagtcctgcgagggtgagggcacaaatgcacagtcgctagctgacttcgccaagcatttttctgactagcgcaagctacgcaagagcaatcttaactccaactaataaatacctcttggtcacagcatgtgctctttctgtagattcaccgtttcttatttttaatttcatattcaatttattgtttgttttgtatggacattgtgtgttccaatta

SEQ ID NO: 66 - DNA, 317 bp, Zea mays
  unsure (1)..(317): unsure at all n locations; Clone ID: LIB3179-001-P1-K2-C11
cggaanacccgggctcgccgagaactccataaccccacaggccacaacttccaacaatccaatttctctcttccgccagcgcccccagctgccgggaccttaccctaccgggggaggacttctccctgccccttccacctcatcctcattccaccgcctctccgtccaccttcacgttctactccctcctctcctactactatttgctctccgttctcggccacaacaacttcggcaccgtttacaatgctctgcaccacctttcctctcaatctattcgtacttaatctattcgcattcttttacaccttttcttt

SEQ ID NO: 67 - DNA, 75 bp, Zea mays
  unsure (1)..(75): unsure at all n locations; Clone ID: LIB3179-001-P1-K2-C2
actaacttgnttcaaaaaaaaaaaaacaatctatatttataaaaaaaaaaaaaaaaaaaaaaaacagaatggttt

SEQ ID NO: 68 - DNA, 254 bp, Zea mays
  unsure (1)..(254): unsure at all n locations; Clone ID: LIB3179-001-P1-K2-C3
cacagctcgcagcacctgcaccacttgacaaccagccagctagctaaccaaccnncntatccgggggcaagcaagagacgagggtgcgcgcgtccaggcatcatgtgcaactccaacgtcaagtccgcgggcgtcgcccatatcgacggccgcccggtgctgcagccggcggtcaactctcgtggcgtgtctttactccaaccgtctcttcaagaagaatctgttcatgtccttttttattccgtctttctact

SEQ ID NO: 69 - DNA, 310 bp, Zea mays
  Clone ID: LIB3179-001-P1-K2-C4
tgcatgatgagattattcaactggagttcagtcattatgatgtcaaatcgtctaaaacaataccagcaaaggattttgcattgtccatggttgcttctgctgacatgaaccatatcaacaagctgcttgatagagttgatagtttggtcaaggagccagatctgaaggacatacgcatcacctttgaggagtttaaggcatttgctgatttgcgacgaagattggagccactgtcgatggctatctttgcttacggtaaattgaatgggtcattgacgaatgaggatctaaaacgtgcagtttttcatgt

SEQ ID NO: 70 - DNA, 167 bp, Zea mays
  Clone ID: LIB3179-001-P1-K2-C9
gccacaccgtccaccgtcacgtccacctttttccatggcgctccacgccgtctcctgcgcggcggtcttctacccggggggcgcgctcttacacaaccttccccatcgcccatgctgtggtttgtttaccaaagcagtccttcttgtattacttcacaaaatttgca

SEQ ID NO: 71 - DNA, 376 bp, Zea mays
  Clone ID: LIB3179-001-P1-K2-D1
gggtcgaccaggcgtccgctccgaaatactcacaaacacccccaatcccacccataatccggcggaagtcaagccaacctccgtggtccatccatgggcgagcgggggctctcccagcccaaggcccagcctctctccccgttcccgtcgcctcccgcctccgccgcgttgccgccccccgcctctgcctctgcctctgcctctgctgcctccacctcccgcaccaccagcgccgcggcctcgcgccccaagaagaaggtgacgaacccatcgcccgaccgtaacccggcaaagaagccccgcctgacgttctcgatcccgggccggcccctgtccgcagtcggcgaggtgggcgtggccattcgctacctgcgcg

SEQ ID NO: 72 - DNA, 314 bp, Zea mays
  Clone ID: LIB3179-001-P1-K2-D10
aaatttttatttttatataaaaaaataaaaaaaattaaaaaaatttatataaattagataaaataaatttttttttgtaaaaaaaaaaaaaaaaaaaatatataaaaataataaaaaaaaattaattaataaaaaaataaaataaaaataaaataaaaaaaattaattaattaaaaaattatataaaaataaaaatttaaaaaaataatttttttaaaaaaaaaaaatttaaaaaataaataattaaataaaaatataatataataataaaaaaaaaatatattaaaaaaatataaaattaaaaaattaattat

SEQ ID NO: 73 - DNA, 422 bp, Zea mays
  Clone ID: LIB3179-001-P1-K2-D12
cgcaaacgcaagctcccaagcagctaccaaccagccgggagagggagcgcacgcactgggacaatggccacgggcgggggggggtgccgtcatctgaagctgctgggcgcgtggccgagccccttcgtgaaccgcgtacgcatggcgctgcacctcaaggggctggagtttctagaacgtggaggaggacctcaccaacaagagcgacctgctcctcgccttcaaccccgtccacaagctcgttcccgtcctcctccacggcgacaagcccatcttctagtcactcgtcatcgtggagtacctcgacgacgcctttcccgtcgctggtcagaccgttcttcccgccgacccctattaacgcgctcttttttgcttcttttccaaatacttttactgcatgtttttctgtcttatggttatat

SEQ ID NO: 74 - DNA, 362 bp, Zea mays
  unsure (1)..(362): unsure at all n locations; Clone ID: LIB3179-001-P1-K2-D2
ggaanncccgggctcaactagcagggaaatcagccatgagntgcgtcgtcggcgaagccagctcaccggcggcaagacgtcgtggccggaggtggtcgggctgagcgtcgaggaggcgaagaaggtgattctggcggacaagccgaacgccgacatcgtggtgctgcccaccaccacgcaggcggtgacctccgactttgggttcgaccgtgtccgcgtcttcgtcgggaccgtcgcccagacgccccatgttggctaggctagagcctcagcctagaggtcgtcggcaccgccggccatgaccacctgctatatgtcactactagtaataaagtataaataacaagggggatgcatgctca

SEQ ID NO: 75 - DNA, 191 bp, Zea mays
  Clone ID: LIB3179-001-P1-K2-D3
ctttattattgttgttgttattattaatttgtctcgctatagtgtgtcgtgttcatagcaccaccggcgcgccatcgacatgcggcagctgtgctctgtctgtcacgtcacgtgcgagtcctactacgggaaaaaatgcatggtaatcgtggagttgcttctcaaaaaaaaattttttattaaaaaatatt

SEQ ID NO: 76 - DNA, 487 bp, Zea mays
  Clone ID: LIB3179-001-P1-K2-D4
ccggggaggcaggcgatcaacggcgaccccttcatcggcagcctggagacgcctgtttcctcgagcccgctcgtggcgtggtgcctggccaaccttgcgggctgggggaccgccttgagcccgctgctgcggggcgtcgaggtcggcctcgcgcacggctacctcctcgtggggcccttcgcgctcacgggcccgctccgcagcacgcccgtgcacggccaggccggcgcgctcggcgccgtcggcctcgtcgccatcctcagcgtctgcctcaccatgtacggcgtcgccttcttcaacgagggggacccgttcacggcgccctcgcttacgctcaccggcaggaagaaggaggtctacaagctgcagaccttcgactgctgggccaagttcaccggtggaatcttctttggcggtatcttcgggcggccttgggccttctttttttttttacgtgctcgaccttccctaccttttaaagttgaaa

SEQ ID NO: 77 - DNA, 60 bp, Zea mays
  Clone ID: LIB3179-001-P1-K2-D5
tacgatcccacccggcagcggcgctcgctttttatacccacgcagctcttgccaccttcc

SEQ ID NO: 78 - DNA, 463 bp, Zea mays
  Clone ID: LIB3179-001-P1-K2-D6
agcggcaagtacaccctgggctacaagaccgttctcaagacgctgcgcaactccaagggaaaggtggtcatcatcgcaagcaggggcgcctccacttaggaagtctgagattgagtactacgccatgctggccaaagttagcgtgcaccatttccacggaaacaatgttgatcttggcactgcctgcggcaagtactacagggtgtgctgcctcagtatcatcgacccaggtgactcggacatcatcagtaccacccctggcacccagtgagccagccccggcacccattgcagctgcttcgcctttctcaagatgagatgagatgtatcgctccggccctatgtccgtttcctttttttatcttttagctatgtaattttgctaccatgtgttcatctaccatactgatagtacctcttattatggctgctatgcaaggcatattcatggttttgtttgatg

SEQ ID NO: 79 - DNA, 214 bp, Zea mays
  unsure (1)..(214): unsure at all n locations; Clone ID: LIB3179-001-P1-K2-E1
ccgggcnggacgagccatggcctaaccgctgctcaagtcacactctcagctcgtcgtcttcgccgccctgcactccgtgaggagagcgcgccgctgccctgcgacggtgcgcctgtncaagttccatgaccacgggctcaggtccggccgttctaagagatccggttcagcgagggtgggcgccttcccgtcgcttgacgtggtgccgctgatg

SEQ ID NO: 80 - DNA, 394 bp, Zea mays
  Clone ID: LIB3179-001-P1-K2-E10
catcttctgctgtgtaacatctaactttattcaaaatctttctttctttcctaatcctacgctacttacaaacatttcgtgtgctccctctcctcttcctccttcacctccccttccttcttcttaccatctccattcctctcccttttcataattattttctttatctttctctcctttcttcacaaaaccaccttcacccctctcttttcaataactttcatttcccttctttccttcttttccattacccattattttctcctttactctttcttctatcttcttttttttttaccctatctattttatttttaaattctctttatttcttcacaataaatttttttttccccccttcccttttctattttttataattttcttttttctt

SEQ ID NO: 81 - DNA, 381 bp, Zea mays
  Clone ID: LIB3179-001-P1-K2-E11
acgaaagccaaagaacattttacttcatatatatttgcacatttcattgacagactttcagttgtgtttctttacatcgcggcgtgcggcaaatgtttcttccacactatattgataagaagaaaaagaggaggaacagcattagtaatcccatattttttgctgaaccaattctatcatcaaattcttttgttggtacataggaatacatttcacctgatattattacccgagctggccatactagttctgtatattgttttgcgctaggaattcttttatatgagattttatattgttatacactcttcattgggaaaacaattcataagacatttactaatattttttacaaagatattatattttctgttagcattc

SEQ ID NO: 82 - DNA, 279 bp, Zea mays
  unsure (1)..(279): unsure at all n locations; Clone ID: LIB3179-001-P1-K2-E3
aaaaaaaaanaaaaaaaaaaaaaaagaaaaaaaaaaaaaaaaaaaaaaaaaaaaaaaaanaaaaaaaaaaaaaaaaaaaaaaagaaaaaaaaaaaaaaaaaaaaaaaaaagaaaaaaaaaaaaaaaaaaaaaaaaaaaanaaaaaaaaaaaaaaaaaaagaaaaaaaaaaanaaaanaaaaaaaaaaaaaaaaaaaaaaaaaaaaagaaaaaagaaagaaaaaaaaaaaaaaaaaaagaagaaaaaaaaaaaaaaaaaaaaaggaaaaaaaaaaaaaaa

SEQ ID NO: 83 - DNA, 287 bp, Zea mays
  Clone ID: LIB3179-001-P1-K2-E4
gcatttttgggatacgctgtgggtatgacggtgaccatcgttgtaatgaactggtttcaagcggcggagcctgctctactgtagctgggtcctggtgtgattggttttgtcgctgttccctgtctgtggtatggagaagtgaaacagctactggagtttgacgagtcaaaaactgagtctgatgaaggcagtacagaagaggagcaagatgatgattgttccaaaggcaacataaaggtggactagcaggatttatttccggaggttaaaggacaggaagacagttt

SEQ ID NO: 84 - DNA, 350 bp, Zea mays
  unsure (1)..(350): unsure at all n locations; Clone ID: LIB3179-001-P1-K2-E8
agtgcaacaagcaagatttacctgcccatcgatcatatcgtcaactggtccggcatttcgcgagaccattagctccacggggtggggctncttcttcttctgctccaagacgtcttgtcctgatgtggtcgtgctgagcgtggatgactccaagaaggtgatcctcaagtactatccgtacgccgacatcgttgtgctgcccttctgcttcttggttaccgctgattatctcccttaccttgtccgcatcttcttctacattctcgtccagactccctacatttccttattatatataatctatcctttattttctttcctttgtccaaaactttaaataaatatttttt

SEQ ID NO: 85 - DNA, 290 bp, Zea mays
  Clone ID: LIB3179-001-P1-K2-F1
gcaagttccggactaaggatactccggagtttgcattaccttcctggtttgcttgtgatgaattggaattcgcctaaaactcgtttagtcattagagttggaagtgaagacaactcccacccgataacttgtgtatgtacagtatatatatgtattacctattcttcgctacatctttgaaggtgtatctgttgggattttcgggaggggctcaatttaaatgcggttaaatggcctttgggttttacggtgtcacgagtgaggtgagaagggaagggatgggaagggaa

SEQ ID NO: 86 - DNA, 212 bp, Zea mays
  Clone ID: LIB3179-001-P1-K2-F10
atccactactttactcaaagtctagagccatttttttgctttgctcaccagacaaaccgcaggagattgcgtcgacggtgatgggcgccacctcccgcatcgtcgcggccaagacgccgtatcttggccagggtcgcgccgccttcgtcgtcgtcaatgccagcccctttcgcgacgtcgccgtcgtcgctgctggctgtctgatcaccatg

SEQ ID NO: 87 - DNA, 417 bp, Zea mays
  Clone ID: LIB3179-001-P1-K2-F11
ggaggcaagtccactggcttcggcctcatctacgataacctcgagtctgccaagaagggggagcccaaataccggcgagcaggaatggtcttgctactaaggttgagaagtcccgcaagcaaatgaaagagcggaagaacagggccaagaagatccgtggtgtcaagaagaccaaggctggtgacgccaagaagaagtaaacagtcatttatatttctgtattactgtcctgaactctgggtggtcgtctagttgcaatgtcataattatggtcgtgttagtgtttgttccgcactcagcattaagtgaagttttgtaattcctggatgtgaacctacccggattggctgtagcatgtttttagatgagaaggctattttgtcatgcagttgtgtcatttgtaagccaattcatttt

SEQ ID NO: 88 - DNA, 406 bp, Zea mays
  unsure (1)..(406): unsure at all n locations; Clone ID: LIB3179-001-P1-K2-F12
acatacatttctagatcgctatcttcctctctattttttccaaacttacttacgcttncatactgcgtggtttctattatatagtggtacctaaatacaattcactttccttcnttatacaacttctttactgttaaaaccctttccttacccatcttaatctccttacattttttttttcctttctccatttaacaaaataactaaaatttcctcacctatctctctttccaacaatttttcatccttaattactatttttactcactcttttatcttttcattatatatttttattttttttattattctttttttttatatcttttttttttttctcatcatttatttttttcctttataatactatattattttttttcttaaatttaattttttttttttt

SEQ ID NO: 89 - DNA, 163 bp, Zea mays
  Clone ID: LIB3179-001-P1-K2-F6
acactgctcaactatcgtccacctccacttcctatttccatctctccccctttcttcatcctggtctctcctcatacatcgggtgcgccgacccaccatcatcctctcctaatcttaaatgctgcctcctctacctatctccgcatcatattcatatccccct

SEQ ID NO: 90 - DNA, 253 bp, Zea mays
  Clone ID: LIB3179-001-P1-K2-F8
tccagcagcgccctcgaagatttcggcgactttaagacggtgtcgctgtgcgtgaagaggctggtctacaccaacgatcagggggaggtcgtcaaaggagtctgctcgaactttctctgtgacttgaagccaggcgctgaggttaatatcacagggccagtgtgcatggagatgctcattcccaaagacctcaactcaacaattatcatgctctcaacggttaccggcatctgtttcgatctcgtttcttttt

SEQ ID NO: 91 - DNA, 448 bp, Zea mays
  unsure (1)..(448): unsure at all n locations; Clone ID: LIB3179-001-P1-K2-G10
tctgtctctctttatgtttcaagcttacgtacgcntncatnctgcgtcgtttctataatatagtggtaggtaaaatcaattcacttnccntctttttacaactttttttacttttaaaaccctttcttttacccaacttaatcttctttcatttttttttttttttttcctnctaacataataactaanatttcctcacctatcttccttttcaacattttctcatccttaatttcttattttactctctctttatctactcattaatttcttttttttttttatattctcttcatttttccttttctactttttattctctatctcctttttttttccttttctttctcttcttttttttcacttttttctacttttctcttttttcttttatattttttcttttttttatatttctttttttttttttttctaaattttttctttt

SEQ ID NO: 92 - DNA, 516 bp, Zea mays
  unsure (1)..(516): unsure at all n locations; Clone ID: LIB3179-001-P1-K2-G3
cgggncggcccagcgcgtcacgcgcgcccccgcgccccctcgctcgtttccgccggctcatttagcccaggaagctaccccgcanncccagcctcgcgattcccaagcgaagggccggctgggcggcgcgccactggcccgccaccgcggccctcccgtcgcgtcgccgctcccgcgcaagaccggccactctccaccagcctcgctcgaggtctttctcggcggggaagaagggctacaagatgaagacgcacaaggcgtcggcgaagcggttccgggtgacggggaggggcaagatcgtgcggcggtgcgccgggaagcagcacttgctcgccaagaagaacaccaagcgcaagaagaggctctcgaagatggtgcaagtcaacaagagtgactacgacaatgttacgggtgcactgccctacctcaaagtgaataggaaagcaaactgagagctacttggtcttcaaaaaaacattaagtttcgttccaccaaattggaattttgtgtatctt

SEQ ID NO: 93 - DNA, 350 bp, Zea mays
  unsure (1)..(350): unsure at all n locations; Clone ID: LIB3179-001-P1-K2-G6
gacacaacaccaantctagtagctctatttcaccaattattttccgcgtgaactccancntcntcgggctcgatcccaaccaacagtggcgggggccaccaccncctcatcttcttctaaacgttttcatctttcctctccctatttccgcctctccgctctgctcggcctattttttttttttttcgtcacggacaccacctaatcttccaattccacgatcttctattaatacctttataatagcatagccaacaatgatcttaactacaataatattcttttcaccattttctcctacttttctctctccttcatctttttatttcttttactttccttttccccta

SEQ ID NO: 94 - DNA, 407 bp, Zea mays
  unsure (1)..(407): unsure at all n locations; Clone ID: LIB3179-001-P1-K2-G7
cgggcccggnctttttttaaatgacaataaacgtttgaatgctattaaatattttattttcgctcactttcttcntaatattctatggggcatactacaaagttggtgtgtcatgaatatatatacatatctaccaaaaaaagggttacaccttcatagttgctgcagctaattttacaatttacataaacttaatttatttaaggaccaatcacctctccaaggtctctatggctgctatctggagttgtccttttaagcatctggtgtggaggttctatcaaaattccttgcctcttactattcgtttgagtacatcaacaatattttgacccatacaagcttcacacagtccacccatagaaatcttttctcaacaggaaccacaccatattttaattaattgt

SEQ ID NO: 95 - DNA, 418 bp, Zea mays
  unsure (1)..(418): unsure at all n locations; Clone ID: LIB3179-001-P1-K2-G8
aaacaagttgtgcattttcatcaagtttattttaagtgctgcctgtttgtatcnatggatcgtgcaacatataacatcgggtggtgttaaaaattcccnccanttcatctactggattctgacccctgcaagcatcgacctcaatgaatgtctaatacttagtacatcttttcatgtaataaaactgaaactccccctttcttgttctgattactgtaaccctaatccatttatcttcagtttctgaacttcttcgagaaagctttatttaaatactactatttttttaaaaaattttcttcctctctaaaagatccattcttacatactcgttcttgctacttcatatcttttctttagtgtcaccctaaatttaattcacttgccttcttttacaacctcttacttttaaaaccct

SEQ ID NO: 96 - DNA, 258 bp, Zea mays
  Clone ID: LIB3179-001-P1-K2-H1
ataccaaaaattctcctacctatcttcctttttaacattttctcattcttaattactaatgttactctccctttatcttttcattaaacactttattttttttttttacctctcttttttacctcttcattttttcttttccctatctccttcttcctttcaactttttttccttctctatcttatctttttttcctctgtttattctctttttttctttatattcttattttttcttttaaaactactaattttttt

SEQ ID NO: 97 - DNA, 369 bp, Zea mays
  unsure (1)..(369): unsure at all n locations; Clone ID: LIB3179-001-P1-K2-H10
cctcaactacanntaaatctnccattttttcttcttcccccaanccaaccacctncggcaggtttttatacatatttgtctgcggccaaaacatcttttaanccaatattttttttctttctaacaatccttttctcccacattttttttctttcccaccaccactttttttttttcctcctatctttaaaacaaccttttttctttttttacaatcttttttcttttcccatacttcctttttttttactttttctttttttcctctcctctactatttttttcaccactctttcttttttttctctcacccaacattttttttttctctctcatttattttttctctttcccttactattctttttt

SEQ ID NO: 98 - DNA, 183 bp, Zea mays
  unsure (1)..(183): unsure at all n locations; Clone ID: LIB3179-001-P1-K2-H3
atatcattttctaccacttttcattcctatactcttagctttntatgnactactatatctgataggtttaataatatattacgtccttgagaacaaaaaaaaaaaaaaaaaaaaaaaaaaaaaaaaaaaaaaataataattataaaataattaaggttaaaaaaaataattttttattttttt

SEQ ID NO: 99 - DNA, 206 bp, Zea mays
  unsure (1)..(206): unsure at all n locations; Clone ID: LIB3179-001-P1-K2-H7
agagcgcttatagcttgtcagccatggcctctcttcttcacgtctagcctcctcaagtcctgcttgtcttactcccaaatccgggcgtccacncaaaccacaccttcttccctctttttgtccaccttccctctcgtcgccttctctattcctatctgttcttccatctttttttttttctttaaccctttctacaacctgacatt

SEQ ID NO: 100 - DNA, 361 bp, Zea mays
  unsure (1)..(361): unsure at all n locations; Clone ID: LIB3179-001-P1-K2-H8
cttccctnttcatttttaccattattatcaccccacatgttccncannncttcatgcgttcttatagaatctcggttgcgtctaaaccaacatcctacctcttcttccaaattcacctcccttccgttcctccatcaatcttcttcttctatttacgatttttttttttttctctctcccctataaacccaccttctttttttttctctctcttatttttttctacacaaatttatttttttttctaccatttcttcttatctccaattttttttttttttcacactctatttttttttctacatataatatttttttttcaactttattttattattttcttcactctttcctttttttc

SEQ ID NO: 101 - DNA, 227 bp, Zea mays
  unsure (1)..(227): unsure at all n locations; Clone ID: LIB3179-001-P2-K1-A1
cggcggccgggggaacaaccccacccaaaaaaacaacccaaggccggaggaggggccncccgggggaggaggagcaaccggaaccaaaacccaagcaggggggaacggaaagggaaggcaggaggccaggcngggaagccaccaggaaggggcccccaccgagggcaagcaccagggaagggaaggcggacccggaccaaaaaacccaacgcccaaaaagggggggg

SEQ ID NO: 102 - DNA, 247 bp, Zea mays
  Clone ID: LIB3179-001-P2-K1-A11
cgaaatccccgggccgccccacccgtccgaacctgcaagctttcacttgcaaacttttttttatttaaaaaaaaaaaaaaatcaacaaggcgccaaaaattatttattacgaagggccatttttcaaacataataaattaattctctcacatcattttcttcaccccccaaattttttctaaggggccgtcttctcacaaagaccccatttctcccccccacatcctttctcccccccaaacttttt

SEQ ID NO: 103 - DNA, 345 bp, Zea mays
  Clone ID: LIB3179-001-P2-K1-A12
attcccataggctaattaatggaaccgcaaatcagggggccggtaattttaaaaggaatttggaccaattaattggagggagggttcctttcctgggttggaatttattcctccttaaaatgggatttgcctaaagtcttccaatactttcctataaggccggaaccaattttctccatatggcaaattcttatttaatttgaggtttttaactaccttttccattatctaatttgatccatttaaattaaattcgaaaaattctttggaaaaaaaaaaggaaggggtatatattttaccgggatattcttttctataatcctaaatatagtgcccctttctttt

SEQ ID NO: 104 - DNA, 156 bp, Zea mays
  Clone ID: LIB3179-001-P2-K1-A2
ccgcccgataggacctgataaaggaaaaaattccaatttttttttttaggagaaaaaaaaaaaaaaaagggggggccgttttaaaggacccaggctaacttccccaggcttccaacgtattagctttcttatggggtcacctaaatcaaattaacg

SEQ ID NO: 105 - DNA, 320 bp, Zea mays
  Clone ID: LIB3179-001-P2-K1-A3
gaattctaaattaatgagtggtggggtgggactaatgtttcttttaccagaacctaaaccaggggttggattaaatgttgttgtaaaggatattaaatggcctaactacaccccggggtacgaaaccaaggatcctgattttttggcagctttcctggtaactcctaacttcggggttccgcctgaaaaaccaggacctgcagttcctgcggaatcttttactggtccatggccaactgtttggcctgttggacttaccagctttgatcgttccaaaggacaatgttataacatcgggcccgttcttggggacccaaatc

SEQ ID NO: 106 - DNA, 395 bp, Zea mays
  Clone ID: LIB3179-001-P2-K1-A4
atttccggggcggacccaggcgtcgggcctggcctctttttttggtgaggcggaggttcattttctggccggagcgtcaggataagaaccggccgttggaaggaagttcctcttgcaactgcaagcccccgtccaagggggtccctttccccttccttcaaccttcttggaaattaaggaccgggtttctttggaaggacacttgggattcgccctggggttttcctggcgggaagagttggattggtaaaaccagtatgggaaggcagggaatttagaatgggaaggcggcccatcgaagtcccatcaaaggttacctctaacataaaaaaagcagttggtaaaagttaagggtccgctgggggagtgatctctgagctttcaaggggacttga

SEQ ID NO: 107 - DNA, 411 bp, Zea mays
  unsure (1)..(411): unsure at all n locations; Clone ID: LIB3179-001-P2-K1-A5
cgggggccggaaaacccccggcggacaacccggaggccnagggggggccaaaggggaaggagccaagaaccggcggcccggccagggcctccaggacgggggggggggcccagaccaacgcaaccggaaggggcccgttggggaacccggccgacaacccggcggacccggaaaaaaacaccgcaggggccaaggcaaccaactaggggcccggaaggggggggggggggggggcaaccgccaacgggccacggcgggggaaaacaaggggacagaaggacacggggcccccacggggccaagaaggacccaggggggaaaaaaccgaacggacccaggaggcaagggggaaggaagaagggcggcgccaaaaaaaaaaaaaaaagggggggccggcccaaaaggaaccag

SEQ ID NO: 108 - DNA, 430 bp, Zea mays
  unsure (1)..(430): unsure at all n locations; Clone ID: LIB3179-001-P2-K1-A6
acccggggcggacccagccgcccggccaaagaganggagaagccaacccccagaattttcccacacaaaaacgcctcaacccgaagggggaagaacccaagggcccccaggcgggacctcggaaggtggagggaggtccagggggccaccaaaagggacgcgggggggaacctggagaggccggccaggggggaagaggcaatgcagggggcggcggcggccgagaagacaattggcacccccctaaacaagccgaaccgggacggggggcccccaaaagaccgaacgccaaaaaaagggcgggcgaaaggtttaccccggacccggcccaaaacccaaaacccaaggggaaacggaaccagggggccaagagaaatttcgggccaaaaaggtcacccgacaaaaagaaaggaaaaaaaaaaaagggggg

SEQ ID NO: 109 - DNA, 322 bp, Zea mays
  unsure (1)..(322): unsure at all n locations; Clone ID: LIB3179-001-P2-K1-A8
ggcgggaaaaacccgggcggaccaaggcgnccgaaaaaaaaaaaaaaaaaaaaagggggggcggaaaaaaaaggaaacaaagaaaacgaccgggggggggaaagaaaaaaagggggggggggggcaaccaaaaacaaaacaacgggccggggaaaaacaaagccgagacgggaaaaacccgggggaacccaaacaaaaaggccaggcagaaaaaacccaaacagacagcgggggaaaaagaaaaaaggcccgaacggaaggcccaaccaaaaaaaggggcagccggaaggggaaagggaacgcgcccagaaccggaccaaaa

SEQ ID NO: 110 - DNA, 216 bp, Zea mays
  Clone ID: LIB3179-001-P2-K1-A9
accggcctgaccctgagtgctcgaccggtggagggccatccttactttcagttggaatcggaggacattgtggccccaattttgaggttaataacctacaaccccaaggtgaacggaaaacggttggggcgtttcaagtcaacccttttcggcaggtcttggaggtggtgccccaactggttttggtccgcaaccttcatcacctgttctataaat

SEQ ID NO: 111 - DNA, 198 bp, Zea mays
  unsure (1)..(198): unsure at all n locations; Clone ID: LIB3179-001-P2-K1-B10
cgggggggggcggaacaaaagagaganaaaacggaggnggcaaccaggttagtttttgaaaatttaaaagagattgggggaaaccttattttatggaaaaagggggggtaaaaaaattaaaaaaaaaaaaaaaaaaaaaaaaaaaaaaaaaaaaaaataaataaaatataaaaataattattttatttttttataaaa

SEQ ID NO: 112 - DNA, 309 bp, Zea mays
  Clone ID: LIB3179-001-P2-K1-B12
cggaccacacccttccggttgcattgactcggtttgggccaattttttttgtttttggccgggaaatgccggtggcataattatggaaaacagaggggggggccctagcctcgaccctgttttggaagccctttccttggatgccattggattaatattaaccaatgccctaaaaaaccaagggccaaccaacttgtttccacatgatgggaaatttgttgaactatccgtttgtttcattatttaaattttctcattatcccctttattgaagtgtaatccccttaaaaggttttcgattgttacttt

SEQ ID NO: 113 - DNA, 327 bp, Zea mays
  Clone ID: LIB3179-001-P2-K1-B5
cgcggccccgggggctaccaacgccgacctgtttgtttggaaaaacctttgtgccacgtaggcccggggatatggaatcgccgggggccatcggaccggtggtgttcaagcgggggccgttcttagtggaggctaggaacgtttattacagcagggtccccagggggccaaaacctttaatgggggtggccccaaccaacaccgtggggacccccggggccgttttccagaaacggttgaacaacggccaaaagttggtattgaaagccttttgtggatcgtggggatcaaaggattatattgcaggggggccccagcttaactggg

SEQ ID NO: 114 - DNA, 272 bp, Zea mays
  Clone ID: LIB3179-001-P2-K1-B6
ggggaaaaacagggggcccaaaaaaaaaaaaaagaaaaagggaaaaaacggccgggcccggaaaaaaaacgcaaggacaaaaaaacgggcactaaccggccggccccggaaaacccgaaagggggcacgagggaggggaattccaaaaaacaggggggaaaaagggccaaaccccggggggccaaaaaggcccggaaaaaaaacaaagggccgcaggaaacgggcgaaaaaaagggggggggggggagccaaagaggggaaaaggttggccc

SEQ ID NO: 115 - DNA, 263 bp, Zea mays
  unsure (1)..(263): unsure at all n locations; Clone ID: LIB3179-001-P2-K1-B7
cgggnccggaatcccggggcggacccacccgtccgtgcatgataggattattaaactggggttatttttttttgtggtcaaatggtttaaaccaatcccagcaaaggatttggcatggcccatggtggcttttgttgccatgaaccttataaacaggctgttggatagagttgatggtttggtcaaggagccagacctgaaggacatccccttaacctttgaggagttaaaggcattggctgatttggtccaaaaatggaagc

SEQ ID NO: 116 - DNA, 283 bp, Zea mays
  Clone ID: LIB3179-001-P2-K1-C10
gttccgccatggttgccatccatccgtcaatcctttatcagtccttttactgcaagaggaagtcctttcccatccaggatgttccttgaacggggagggcttctcccggggccatcgcccccaagggaaccatggagcctttgtttttaatcggccagaatctgctcaccaggccatttgctagggggaccacttccccagggctgtcctagcccggcaaggtgtagggcccaaaaccacagtccttagctaactttgccaagcagttttttgccaggcccag

SEQ ID NO: 117 - DNA, 95 bp, Zea mays
  Clone ID: LIB3179-001-P2-K1-C12
ttttagatggggggttgccgttttttttgatccaggcttacgtccgcgggctggcgaggtatttgttttttattgggggaacctaaatcaaatta

SEQ ID NO: 118 - DNA, 292 bp, Zea mays
  unsure (1)..(292): unsure at all n locations; Clone ID: LIB3179-001-P2-K1-C3
gggcggacccaggcgaccgaccagcnggaagaaccggcaccacaggacaaccagccagcaggcaaacaaaccgggggggccaggaccaggcaagagacaacgggcccggcccaggcagaaggggcaaccccaacgccaagcccgggggcgcggcccaaacggacggccgcccggggcggaagccggggggaaaccgggggggggagccggacgcagcccgacagaaaaaaagggcccggcgaaggaccaaaacaaagcggccgcccaccaaaaacaaggcaacggggccggc

SEQ ID NO: 119 - DNA, 393 bp, Zea mays
  Clone ID: LIB3179-001-P2-K1-C4
tccttgaggggattattcaacgggggttaattctttatgaggtaaaatggtttaaaccattcccggcaaaggatttggcttgggccagggtggtttttgctgccatgacccatataaccaggctgttggatagagtggatggttgggccaaggggccagatttgagggccttccccttaactttggaggggttaagggcattggctgattggcaccaataatgggagccacggtcgatggttatcttggcttacggtaaattgattgggtattggccaaaggtggatttaaaacgtgcagggcacacttgttggcggggcgcgtttacacagatggggtggtggactttattttccatgggttggacccaaataaggttgggaacttgggccc

SEQ ID NO: 120 - DNA, 280 bp, Zea mays
  Clone ID: LIB3179-001-P2-K1-C6
tggatatgggatcaaaaatttctttttgtcctcaaaggctataattccgttggggaaggttttaaaaatggggggccgtgaaactgaaattagtttttttaataaaatagattttttacttaatatttattataaaaaaaaaaatggtgggcctttttaaaggttccaagttaacttttctgggattgcgacgttatataattttattagtgtccccaaatttaaattaattggccgctgttttaaaaagtggagatgggaaaaactttgtgtttcccaa

SEQ ID NO: 121 - DNA, 111 bp, Zea mays
  Clone ID: LIB3179-001-P2-K1-C7
ccgggccggatccccgggccgaccacacccttccttcaacacaaccgagagcccaggcacttcttttttctgaagctaaagtataaaaagcgccggtccctgatcaatggg

SEQ ID NO: 122 - DNA, 258 bp, Zea mays
  Clone ID: LIB3179-001-P2-K1-C8
ccaagtttcctacccctggcatgcgaggcgttatcttttttatgggggggcctaaatcaaatcaacgggccgccgtttaacaactcctggtctggtaaaacccggccatttcctatcttatttgcttggcagcacaactcttcttttttcagttgggtttttttctaaaagttttgtcccgattttcttttccctacaaaaatcttattttgtaagcgaaatggttcccccccttttttcttcccaataatctttttt

SEQ ID NO: 123 - DNA, 353 bp, Zea mays
  Clone ID: LIB3179-001-P2-K1-D11
cggaattccggggctccgggaaactcctaacccaaaaggccacaacggccaacaggctcattggttttggtccgccagggccgccggttgcggaactttaccttccggtgggacaatttggccttgggcgtgcaaccgaagcctaagccaaccgccgggccgtcaacttcaacgtccgacgcccgcctttccgattacaaggggttttccgttttgggccacggaaacgggggaaccgggtccaaggggcggaaccgccggtccgggcagccggtcgaactaaagctattgggggacggggccaccttgggggcccccgaggccaaaaaactgatgttggccggggacccccc

SEQ ID NO: 124 - DNA, 339 bp, Zea mays
  Clone ID: LIB3179-001-P2-K1-D12
gccaaacccaggctccaaagcagttaccaattatccgggagagggggcgcacccattgggccattggccacggccggggggggggccggccttttaaagttgttgggcccgtggccaacccctttctggaaccgggtccccttggcgctgaacctaagggggctggagtccaagaccgtggaggaggacctaaccaacaggagcgacctgttcttggcttccaaccccgtcaacaagctggttcccgtcctcctccacggggacaggccaatttccaagtaactcgacatgggggagtaccttgacaacgctttccccggggttggccaggccgtcttt

SEQ ID NO: 125 - DNA, 339 bp, Zea mays
  unsure (1)..(339): unsure at all n locations; Clone ID: LIB3179-001-P2-K1-D2
gaatnccgggcctgaactccagggaaataagccatgatggcgtcgtcggcaaaccatatcatcttttgaaagacgccggggccgaagggggtcggctttaccgtcaaggaagccaaaaaggggattctggcggccaagccgaacgccgacttcggggggttgcccacaaccacccaggcggggccctccgactttgggttcaaccggttccgggttttcgtcggaaccgtcgcccaaacccccaaggttggctaggttaaagcctaagcctaaaggttgtgggacccgccggccattgacaacctgttttttgtaccttcctagttattaaggtttaaa

SEQ ID NO: 126 - DNA, 271 bp, Zea mays
  Clone ID: LIB3179-001-P2-K1-D3
ttttataatggtggtggtaataataaattttttctgtttttgggggccgggtcaatagaaccaccaccgtcccattgactggccaaacctgtgctttgttttgaacgtaacgtgcgagtccaactacgggaaaaaaggcatggtatttggggggtggcttttcaaaaaaaaaaattattataaatatttatattaaggggcggccgttttaggggacccaagcttccgtccccgggcatgctacgtaatagtttttttttggggcaaccta

SEQ ID NO: 127 - DNA, 393 bp, Zea mays
  Clone ID: LIB3179-001-P2-K1-D4
acggcgaccctttaataggaagcttgaaaaccttttttatctttagcccgttcgggggggggaacctttcaaactttccggcctacggaacctccttaagccccttgttgtggggcgttaaggtcggccttgtccacggttacttcttgggggggccttttgggctaacgggcccgttccgaaaaacccccttgcacggccaggccggtccgcttggatcctccggcctgtttgcaatcctaagggtttgcttaacaattaacggggtcgcctttttaaacaagggggacccttcaacggggcctttgttaacgcttactcggtggaaaaaggaggccaacaagttgcaaacttccaacggttgggcaaagtttaccgggggatttttttttg

SEQ ID NO: 128 - DNA, 184 bp, Zea mays
  Clone ID: LIB3179-001-P2-K1-D5
attccaatcccacccggaagcggggttccctttgtttccacctacccagttttggccgcttcccgattccccgccggggccgggttgaacagaaggaccctctcttctaccaggaacggatggcatgggctggacttttccaacttttctggggtaagcccgggttaaggctctcgaggcgttt

SEQ ID NO: 129 - DNA, 375 bp, Zea mays
  Clone ID: LIB3179-001-P2-K1-D6
acagccgtccaagcggaaggtccaccttgggttccaagactttctttaaaacgctgggcaactccaagggaaggtggttcataatggaaaccaagggccctccatttaggaggtttgagatggagtcctaccccaggctggccaaagttggggggcaccatttcaacggaaccaatgttgttttgggaactgcttgcggaaggacctacagggggggctgcttaagattaatcgacccaggggactgggccataataagtcccacccttggcccccagtgggccagccccggaacccatggaagttgtttggcctttttaaagaagagatgagatgtaccgctccggccctttgcccgtttcctttttttatctt

SEQ ID NO: 130 - DNA, 313 bp, Zea mays
  Clone ID: LIB3179-001-P2-K1-D8
cggaatcccgggcggcccacccgtccgttagtttgaccgcggccggccgttttattgttccaagctcctccccgcctggcgacgcttattttttaatggggtccctaaatacaattaactggccgccgttttcaacttcgggcctgggaaaccccggccgttccccaccttaatggccttgtataccattcccctttttgccagtgggcgtataatcaaaaaggccttaacctttcgcctttcctaacaattgtcctacctgattggcaattggaacctcccctgtattggcccattatcccctgtcggtttt

SEQ ID NO: 131 - DNA, 299 bp, Zea mays
  Clone ID: LIB3179-001-P2-K1-E1
gggccggaaatcccgggccgggccgacattggccttgccgttgttaaggtaaaattttaagttgttttttgccgccgccttgaattcggggaggggggccgaccgttgccttgggacattacacctgggcaggttccatgaccacggcctaaggtccggccgttttaagagatccggttaagcgggggggggcgccttcccgtcgttggacggggtgccgttgatggggacaatgggggagcacgtggccatgtcggggaattacttggggaccaagtccatttggcatttaatggacg

SEQ ID NO: 132 - DNA, 395 bp, Zea mays
  Clone ID: LIB3179-001-P2-K1-E10
gaccacacccgtccgtccatttttggttgggtggcagctagcattttccaagagctggctggcggtcctagccctacctactgacaggctggcaagggcctccttttctttggccgccgtaaccgccctttctttggcggaacaagggcaggcccgggccggggtaagaagggggtccttaacggggcgcgcttttttccgaagggccactggaaccgccgccgtggcatgggttgcaagctccctgttggccggcggtgccagggccaaggaggggtttttggctcatggtatcgggggtttagttttatgtcccagtattatatacctgtatggtcgtcttctctttaaatttaatatcagtccggttttctaaaaatttttttttataatat

SEQ ID NO: 133 - DNA, 293 bp, Zea mays
  Clone ID: LIB3179-001-P2-K1-E11
gttttggaccgcgggcggccgttctttagtttccaggctaacgtccccgggcttgcgacggcatacttcttttttggggcggcctaaattaaatcaactggccgccgtttaccaccgtctggcctgggaaacccctggcgttccccacctaatttgcctggcagaaattccccctttcgccggttggcgtaataccaaaagggccggaaccgtttgcccttccaaacagtggcccaccctgaatggctattggaaccccccttgtaccggctctttaagcccgggggtggtgg

SEQ ID NO: 134 - DNA, 348 bp, Zea mays
  Clone ID: LIB3179-001-P2-K1-E12
gcccggaatcccgggccggggccaaaagggaaaggaaccagggggatggggggggaaattatggggcggggccgacctgcctgccatccataggtattgtttggggtgtgtgagaaaaaaaaaaccaaagtccttaagttggttatctttttttgcaggttgggcgtcggccttggtcctcatgtccgaccgggggtctacctccttgtgggttgacccgatggcttttgctgtacccatttattaatgggcccacgatgttatgattggatcctatattaatcctaaacccggcctttttattttaaaaaaaaaaaaaaaaaaagggccggccgttttagaggatcc

SEQ ID NO: 135 - DNA, 314 bp, Zea mays
  Clone ID: LIB3179-001-P2-K1-E4
gcattttggggatcccctgggggtatgacgttttctcatcgtggaaatgaacgggtttaaggcggggcagcctgtttaactatacctggtcccgggggggatgggtttggccgcttttcccggcctggggtttggtgaagggaaactccttctggggtttgttttgtaaaaaactgttttgtgggagggcttttcttattaggactctgatgttgttagttccatgggcaccaaaatggttgttctcgcagagattttttttccgggggttttttgttcctggtattctctgttttttctgtaatttttgtttt

SEQ ID NO: 136 - DNA, 120 bp, Zea mays
  Clone ID: LIB3179-001-P2-K1-E5
ggggcggccccacgcgtccgactggttttggatcgcgggcggccgtttttttggttccaagctaacgtcccctggcttgcgaggggtttgttttctaatagggggacctaaatccaatta

SEQ ID NO: 137 - DNA, 236 bp, Zea mays
  Clone ID: LIB3179-001-P2-K1-E6
gttttggatcgtgggcggccgtcctggagtttctttgctaacgaccgcttgcttgcaacggatgggtttttttttggggtaaccggaatcaaattaattggccgcggtttaacaacttcgggcctgggaaaaccttgtcgtaacctaacttattcgctttgctttacatccccctttctctggtgggggaatttttgaaaaggcctttacctatcgcccttcttaacaattggcaa

SEQ ID NO: 138 - DNA, 226 bp, Zea mays
  Clone ID: LIB3179-001-P2-K1-E9
cggaccacacccttccgcccacccgtccggttttagatcgggggcggtcgttttagaggatccaacctaccttccgcgggcatgtaacttcttagcggggcaatagggtaacctaaattcaattaacgggccgtcgattttcaactcctggccgggtaaaccccggccttaccccaccttaatcgctttgtaccacatccccttttgtccagctggcttaatttct

SEQ ID NO: 139 - DNA, 313 bp, Zea mays
  Clone ID: LIB3179-001-P2-K1-F1
accgggccggaaattccgggggaaggtcccgaccataaggatcctccggagttggaataacctcccgggttttttggggaggaatgggaatccgcctaaaacttttttagtaataaaagtgggaagggaaaacaactccaacccgtaactggggtttgtccagaatatatatgaataaccaattcttggttccatctttgaaggggaatctgtggggattttgggagggggctaaattaaaatgcggttaaagggccttggggttttacggggcaacaagggaggggagaaggaaaggaaagggaagggatgg

SEQ ID NO: 140 - DNA, 190 bp, Zea mays
  Clone ID: LIB3179-001-P2-K1-F10
cggaccacacccttccgatcacactactttactaaaagcctaatgtccttttttttggtttggttaaccaaacaaaccgaagcaaatggcgtcgacgatcagggccgccacctcccgaatggtgggggccaaaaccccgtttttgggccagggtggggccgccaccgcctctgccaaggcaagccccttc

SEQ ID NO: 141 - DNA, 332 bp, Zea mays
  Clone ID: LIB3179-001-P2-K1-F11
aaggccagagaccatttaacttaatgtggtttggcccatttaatggccggacttggattggtttggttggccatccggccgaccccaagtgttttttcaacacgtttttgttaggaggaaaaggggggggaggggcgggagtaatcccatttttttggttgaaccaaggcgggcttaaaattttttggtgggtccagaggagtccattgcaccggagattattaccggggctggccatacaagggtctgaaatgggggggcgctaggattttttttttttgagatgttatatggttttccaccctccagagggaaaccatgccaaaggcctt

SEQ ID NO: 142 - DNA, 328 bp, Zea mays
  unsure (1)..(328): unsure at all n locations; Clone ID: LIB3179-001-P2-K1-F3
gggggcggccgcccaggaggatccaagcnaacgaccgcgggcaggcgaggagaaagcccaccaaaggggggaccaaaaacaaaacaacgggccgcggnaaacaacgcggggacggggaaaacccgggggnaaccaaacaaaaaggccgggaagaaaaacccccgnnggccagcgggggaaaaaacaaaaaggcccgaaccgacggccctcccaaaaagaggcgcagccggaagggggaagggaacgcgcccggaagggggccaaaaaggccgggggaggggggggcaacccgcagggggaccgcaacacaggcaagggcccaaggcgc

SEQ ID NO: 143 - DNA, 197 bp, Zea mays
  Clone ID: LIB3179-001-P2-K1-F5
cttccgactggttttggatcgcgggcggccgtttttgtggttccaagtttacgtccgctggcttgcgaggtgttagttttctattggggcggcctaaattaaattaactggccgcggttttacaccgtcttgcctgggaaaaccttggctttccccaacttaattgcttggcagacattccccttttcgccggttgg

SEQ ID NO: 144 - DNA, 389 bp, Zea mays
  Clone ID: LIB3179-001-P2-K1-F9
ccggcccggatttccggggtggaccacacccgtccggaacctttggttttgaccactgacggcctttattactggcgatataattttccgggggggccaaaaaaagatttggggactggactggccaccaattaaaagaatttaattttaaaagaaggcccagaaccaatggctgttttaattgttgaacctggaaggggggctgggggggtaatccttcctccaaggacttattttgccagggtccaggcaatcgcaaagaagtttgccatttttttaatagcaaatgaggtgatcactgctttgggaaggctgggaacattttttggaggcgattcctttaccataaagccggatttagtttaactggccaaggttttttcaaactc

SEQ ID NO: 145 - DNA, 353 bp, Zea mays
  Clone ID: LIB3179-001-P2-K1-G1
cgggcccggatttccgggggggtggggtccttgggggggcagttttccggtttggcgtccactgctatttgttgggggcagtcttatgggtaagggggcgtaaggcctccaatcatttacggggacttgggccgccccaacccaatgaccgttttttggtcaaaaacggaccaaagcttgacgtttcgcccaatgaaggggatgctgactggcccagtaacaatcttaaactggtccttggtccggaatgaccagccgaggtttgagacttgttaccaaatcgtttttgcaaccaaaaaggaagtcgaggatcttgaggctgggggaattaaggttttccaaatcgacaaggt

SEQ ID NO: 146 - DNA, 126 bp, Zea mays
  Clone ID: LIB3179-001-P2-K1-G10
cggaattccggggcggaccacacccgtccggttttagatggggggcggccgttttataggttccaggcttacgtccgcgggcatgcgagggattagtttttttatggggtgacttaaattaaatca

SEQ ID NO: 147 - DNA, 344 bp, Zea mays
  Clone ID: LIB3179-001-P2-K1-G11
cggaccacacccttccggaaggcaggtccattggtttcggcttaattttcaataccttcgagtttgccaagaggttggggcccaaatcccgcttgatagggaatggtttggttactaaggtggagaagtcccgcaggcaattgaaagagcggaggaccagggccaagaagatccgtggtgtcaagaaaaccaaggttggtgacgccaaaaagaagtaaacagccattattatttttgttttactgtcctgaactttggggggtcggttagttgcaaggtaataattttggcccggtaaggttttgttccgaacttatcattaaggggaagttttgaaattcctt

SEQ ID NO: 148 - DNA, 422 bp, Zea mays
  Clone ID: LIB3179-001-P2-K1-G3
gcgtccgggcgcccggggcccttggcggtttccgccgtttaggagccaggaggctccccgaagccggcctggatttcccggggaaatcctttttgggggcgccgttggccgccaccggggcctccgtggggtggccgttccggggcaggccggccacctcaacaacttggttgggggtcgtcgggggggggaggaggggctccaagaggaagacccccaaggggtcggcaaaccggttccggttgccgggggggggcaggatcgggcgggggtgtcccgggaagcataactggtttgccaggaggaccaccaagcccaggaggggcgtctcgaagatgggccaggtcaccaggggggcctccgccatgtgttcggtggcactgcctctccttaaggggaatgggaaggcaacctgagggctt

SEQ ID NO: 149 - DNA, 405 bp, Zea mays
  Clone ID: LIB3179-001-P2-K1-G4
aacaaacaagaagccgaacaacgcaccaatttaaatagcgatggcgtcgttaacaatgatggcgtcctttgccgccggggcgggggccggcccttttggccggggaacttttgccggggtaaggtccgccaaggtcaaccgttgccagaagcccgcaacgttagcagaaaccaaggccaggcccgccgccaacggaccccgggccttaatcttctcggttgttttgtcggcccaggaagccatcggaggtgccgtttctcccatggcgggcccaaaaaaatgaacccccaaggttaaaaaaaaattacccggaaatttgtttaacaattccaaccgccaagggtttgcacataatttaccatccctcttttttaatttaagggccgtgggggggttttttattta

SEQ ID NO: 150 - DNA, 264 bp, Zea mays
  Clone ID: LIB3179-001-P2-K1-G5
cgtccggttttagatggcaggcggccgttttggaggttccagtgtttacgtccccgggcttgcaacggattggtttttttttggggtaacctaaattaaattaactggccgcggttttacaacgccgggactgggaaacccctggggttccccaacttaatggcttggcagaaaatccccctttggccggttggcgtattaccgaaagggcccgaaccgatggcccttccaaccagtggggcagcctgattggcaattgggacc

SEQ ID NO: 151 - DNA, 117 bp, Zea mays
  unsure (1)..(117): unsure at all n locations; Clone ID: LIB3179-001-P2-K1-G6
gaatnccggggcaaacccgaacgacacaacaccaagtcgaggagctggagggcaccattatttgccggcgtgaactccagcgtcttcgggttaaatcccgccggggaagggcggaag

SEQ ID NO: 152 - DNA, 56 bp, Zea mays
  Clone ID: LIB3179-001-P2-K1-G7
ccggcctggaattcccgggccgtcccttctttcaagaaaaaaaatttggaagcctc

SEQ ID NO: 153 - DNA, 129 bp, Zea mays
  Clone ID: LIB3179-001-P2-K1-G9
gcctggaattcccgggcggaccacacccgtccggttttagatcgggggcggccgttttggaggttccaggctaacgtccgcgggcatgcgaggtattagttttccaatggggtgaccaaaatcaaatta

SEQ ID NO: 154 - DNA, 106 bp, Zea mays
  Clone ID: LIB3179-001-P2-K1-H1
cacccttcggtttttggttgggggggggccgttttgggggttccaggtttacttccgcgggcttgcaacgtaatagtttttttttggggtcacctaaattaaatta

SEQ ID NO: 155 - DNA, 218 bp, Zea mays
  unsure (1)..(218): unsure at all n locations; Clone ID: LIB3179-001-P2-K1-H10
aataccggggccgaccacacccttccgccttaaatatccagggaaataagcctttatgtcttcttcggcaaacccagccaccggcggcgggacttcntggccgaaggtggccggcctgaccttcaaggaacccaaaaaggtgattttggcggccaagccgaaccccaccatcgtggggctgccaaccaccacccaggcggggacctccgattttgggt

SEQ ID NO: 156 - DNA, 249 bp, Zea mays
  Clone ID: LIB3179-001-P2-K1-H12
cggactggaatgccgggtccacccaacccgtccggggaataatagccgaaaccgtgtccgattttttttggccatggtggccaaaacgcccaagatgggttgttaatttataggctggccgttttttcctttccttgccccaaaactggaaataaatttatatccgttgaaataccgggggcatgccgaataagggagggggtgaatctaactaattaagtaaggcttaaataacacgtttaaaaggtc

SEQ ID NO: 157 - DNA, 282 bp, Zea mays
  unsure (1)..(282): unsure at all n locations; Clone ID: LIB3179-001-P2-K1-H2
cggggcggaccgaggcgaccggccgcccggggccagcggcggnncccgggggcccaggagccgggaagcaacccgcagccggccgggcatccccggggaaaaccgggggggcgcgccccgggccccacccccgacctcggggggaggggccacccggggcaggcggggaaccacaaccacgggggagggggcgcccggggcggggaggaaggcctccaagaggaacccccccaaggggccggcaaaccggccccggaggccggggggggaaaggaccaggcc

SEQ ID NO: 158 - DNA, 98 bp, Zea mays
  Clone ID: LIB3179-001-P2-K1-H3
gattataattttctacacacttttaatccttaacgttgggcttttaaggacctacaatatgtaaaaggaggaataataaaaggaccgcttggggatct

SEQ ID NO: 159 - DNA, 349 bp, Zea mays
  Clone ID: LIB3179-001-P2-K1-H4
gaggatgtttcttcaatcaccggtcggggtttattttccattggccgattcaagcgtggaaccgcgaaaattgttgccacagtggttatctttggaatccgggacacccggaactgaaccgtgactggcgttgagatgttccaaaaaaccatggacaatgccttggttggggacaatgtcggactgttgttcctgggtttgcaaaaggatgccatttgaaagaggcttggtgctggtaaagcccggtttttataaaccgaacaccaagtttggggctgttgggtttgtcctaaaaaaggaaaagggtggccgggactaacctttttttcctggttaccgcccgcagttt

SEQ ID NO: 160 - DNA, 250 bp, Zea mays
  Clone ID: LIB3179-001-P2-K1-H6
ggacttcaatgccggtcccacccaacccgtccggaaacgggtatgggaagccctgggctttttttttggaacacgccgaacaagttgaacggccggggattctttttccggcggagccggcttttcctgcgcaggggcaaccggcctttaatatggttggttgccccggggctggagcccaagcgccgccgccggaagggcctccgttgggctgccgtcaacggggacggggccctccgggggtttgggc

SEQ ID NO: 161 - DNA, 366 bp, Zea mays
  Clone ID: LIB3179-001-P2-K1-H7
aagcgctaatggttggtaagccatggccaccgccgccgggtttagcctcctaaggtcctctttggggggttcccggttccgggcggcaacccggacaaaaccggggtccttggggggggcaaccggcccgggcggggccggggcggggccaatttggccgtccatgtcaaggtcttcttcaaaccggccttacaaccggacttctttccggtcaagcccaataagggagtccatcgggtcccgggggaggacccgccgttccatgacggccatgataacttacgccaccaccaacgtgttaatggggggcgccggttccggggggttgtcctgggcgtacaagctttcaagggaccccgccgtggg

SEQ ID NO: 162 - DNA, 194 bp, Zea mays
  Clone ID: LIB3179-001-P2-K1-H8
gcatggtttccttgggcaggtttaccttcattagcacccaaaatgttccgaagggttgaaggcaacaatttaccaaccccgggtcgtttaggccgaaatcctacctggttggcaaaagtaacttcctgtccgggccgccggaaagcggtgatgtcggggaaggaggtgttttggtaaaaactcccctttgttgg

SEQ ID NO: 163 - DNA, 196 bp, Zea mays
  Clone ID: LIB3179-001-P2-K1-H9
acccgtccgccatttgggggcctaaaggaggagccttcttttgaatccgaggttggttcggaggggggggcaataatttaacaattgggaccagggttggcgggccccaactcctaaggggaggcctttttttattgttgccctgaactttggggagattgttctacccaagttggattttgcactgaggggcctt

SEQ ID NO: 164 - DNA, 255 bp, Zea mays
  Clone ID: LIB3179-002-P1-K1-A1
gttgaagcgggaccccatggtctcgaggatccaagcttagtcgcgcatgtaccagaccgagtagctcttgtagggactaggctacatggaaccaggtgacctcaaggggacagcgtagtgacatgctgaagcgctgacggatcctaactttgttggctccacgcacacgatgaatgacgccgtgtgcgttgaaccaggaaggcatgcacatagcgccgttcctatacagtcagcaggctgcctgacgaacgggac

SEQ ID NO: 165 - DNA, 373 bp, Zea mays
  Clone ID: LIB3179-002-P1-K1-A10
cgaagctaattctaggttgcagcagaatgggatcaccaatgataatgctacagaagatggttctgagcaagatttgcagatgcatcctttactgtttcattatcctcgagatgtggtttcgtcatatagtcatccggttcaaaatcttattaatcagtcaagaaaatatgatcttttcccctttgagaaagttcaagttgagagaagtaacaaccagactacaggttccaccaaaaatggtactgtaaatgctaacactatcgacttccatcctctcttgcatagaacagaagttgatgtgcataatgatgtaccagaatatgatagtaaccttgattaccatcagtctgataataacatgagcaaagttcca

SEQ ID NO: 166 - DNA, 400 bp, Zea mays
  Clone ID: LIB3179-002-P1-K1-A2
ctcaactacagggaaatcagccatgagtgcgtcgtcggcgaagccagccaccggcggcaagacgtcgtggccggaggtggtcgggctgagcgtcgaggaagccaagaaggtgattctggcggacaagccgaacgccgacatcgtggtgctgcccaccaccacgcaggcggtgacctccgactttgggttcgaccgtgtccgcgtcttcgtcgggaccgtcgcccagacgccccatgttggctaggctagagcctcagcctagaggtcgtcggcaccgccggccatgaccacctgctatatgtcactactagtaataaagtataaataacagggaggatgcatgctcatccttggaatttgtacgctagttggactactacatggctacttgaaacgaaaa

SEQ ID NO: 167 - DNA, 228 bp, Zea mays
  unsure (1)..(228): unsure at all n locations; Clone ID: LIB3179-002-P1-K1-A3
aaatgattcatcagtgcgtcgtcagcttttttctttcaccggaggcaagacgtcgtgggcgggggtgtttttgctgagcgtcaagtaagccaaaaagatgattctggcggacaagccnatcgccgacatcgtggtgctgctccaccaccactcattcggtgacctcctactttgggttcgactcggtccgtttttttctttggtaccattatttttacgctccatgat

SEQ ID NO: 168 - DNA, 306 bp, Zea mays
  Clone ID: LIB3179-002-P1-K1-A7
taaaaaaaaaaaaaaaaaataaaatttaaaaaaaaaaaaaaaaaaaaaaaaaaaaaagaaaaaaaaaaaaaaaaaaaaaaaaaaaaaaaaaaaaaaaaaaaaaataaagggaaaaaaaaaaaaaaaaaaggggggggccgttttatgggacccaggttttctaccgggggtttgggagggaatagttttttttttgggccccctaaattaaattcttgggccggggtttaaaaacggggggccgggaaaaccccgggggttcccaaattaaatggcttgggaaaaaatccccttttccccggtggg

SEQ ID NO: 169 - DNA, 396 bp, Zea mays
  unsure (1)..(396): unsure at all n locations; Clone ID: LIB3179-002-P1-K1-A8
cctaaccctaaatttgggggcgcttgggtcaaagagacggggggaggaatcgagccggcggcttgcggcggcatcagcgatggcggcgaagcgggagatctcgagcaccctcaggaacctcaagtttatgcagcgcggcgcggctgcgcagaaggccgaggagaaggccgaggtggaggtacaggaggaggcggtggtgatggcgccgagtggaggcttcgcctcgtccgcgcaggtcgttaggaagtgcatagttatcatggagggtaatcctcatccaggagctataaagggtcggatgtctttccaaaatttcaatccatctatcgataaactaaatgaagaggtaagaggngaccatcaaacagaatcagcttcccccagttacttagacca

SEQ ID NO: 170 - DNA, 242 bp, Zea mays
  unsure (1)..(242): unsure at all n locations; Clone ID: LIB3179-002-P1-K1-A9
aaccataaatttggggacgcttggttcaaagtttctttttgaggaatcgagccggcggctgggggggggttctgctatggcggccaaacgatagatccctgtttcaccctcaggaaccttaagnctatgcagcgctgctcggctgctcacaatgcctaggagaatgccgttgtggaggtacaggaggaggcttttgttatgtgtcactattgaagtgcttctcctcgtttttttctttttct

SEQ ID NO: 171 - DNA, 375 bp, Zea mays
  Clone ID: LIB3179-002-P1-K1-B10
cagcagtgcaacaagcaagatttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatg

SEQ ID NO: 172 - DNA, 71 bp, Zea mays
  Clone ID: LIB3179-002-P1-K1-B11
cttgtacacatccatcttgaggtgaccgaggatataagacgcaccaaggtgaggatgaaagtttttgagtc

SEQ ID NO: 173 - DNA, 298 bp, Zea mays
  Clone ID: LIB3179-002-P1-K1-B12
ggagctgtacatgtactgcatttgctcaagattcgaagatggaaaaaacaaggcacgtagaccaaccatgcttcacgctataaattacaaccgtgcagccgctgatacgcacactccgccgtccccggtgttgttgccagctagcagctcagtcggacttcatgcggttgatctggttgagcgccggctggaggatgttgaagagcacccagccgatggcgggcgtgacgacgatgagcagcaggagcccccgattgtcgtcggcgggcgcggccgttctagaggatccaagcttacg

SEQ ID NO: 174 - DNA, 336 bp, Zea mays
  Clone ID: LIB3179-002-P1-K1-B3
gattttcgtgggcccagaggcgtctaacagctgcatttcttccaggcgaccacttggtgttcttcatactgaacatcttcacgttcatcggtttcgtcttcaccttcagaccgtttttcgttcgaggcagtgccaagcactgaaacatggatgaagcggacgacgacccatgggtatcctatccaggggcaatcgaatatagattttcttgtggcgtggccaagggcggtgccgagcctgtaccagtacgacgactcatgccagaacacacggcgtatggtatggtacacatcaaggccgtgttgttgctgtaaggtttgttatttctgtcttcct

SEQ ID NO: 175 - DNA, 259 bp, Zea mays
  Clone ID: LIB3179-002-P1-K1-B9
acgaagtgcgagcgacccacgttctcacgacacgaaccaccaccaccaaccaggagccgcaccacgcacccagcgcaaagcgatggcgtcgctcaccatgatggcgtccttcgccgccgtggcggtggccgcgccctcgtgccgcggcaccttcgccgtggtcaggtccgccaaggtcgaccgctgccaggagcccgccacgctagcagcaaccgaggccaggcccgccgccgacggacgccgcgccgtcatgctcgcg

SEQ ID NO: 176 - DNA, 406 bp, Zea mays
  unsure (1)..(406): unsure at all n locations; Clone ID: LIB3179-002-P1-K1-C1
cggaangccggggcggcccaagccttcgggggttccattccggnccggcccttggntttttcggtttcggccggaccccgggggcgggggacaagaagccatgtggggctccaacctttcaaccgcctggtcctcctgggggctggccagaagggcctcaaccacccgtgggggctcccccccgggctcgggtttcctggggcggggttccctccgggggctccgaacccgaatcgactccgtaaggaacacccaaaaaatcacggaggccatgaagctggtggccgccgccaaggtccggcgcccgcaggaagccgtcgtctcctttcgccctttttcggaggcgctggtggaggtgctctacaacatgaaccaggagatccagactgaggacatcgacctgccc

SEQ ID NO: 177 - DNA, 372 bp, Zea mays
  Clone ID: LIB3179-002-P1-K1-C10
cttcttcaccctcaagtcatacctgccgtccgacacgcccaaggggctggaggacctgaggaagaaggacctgcaggcgctgcgcggcgacgggcacggcgagcgcaaggtgttcgagcgcgtctacgactacgacgtgtacaacgacctgggcgacccggacaagaacccggcccaccagcggcccgtgctgggcggcaacaagcagtacccatacccgcgccgctgccgcaccggccgccccaggaccaagaaggaccccgagacggagatgcgcgagggccacaactacgtgccccgcgacgagcagttctcggaggtgaagcagctcacgttcggggccaccacgctgcgctccggcctgcacgcgct

SEQ ID NO: 178 - DNA, 227 bp, Zea mays
  Clone ID: LIB3179-002-P1-K1-C11
cgcctcatcgccaccctcttttcacaccccacaggccaagccagccgtggcgggccgcaccgcattttggacatggcgtcgtcctcctgcctcgcctcgccgtgtggcgccacgctctgccgtccgcggcggccgaggtgccgtgtggcgtgctcggcggcccacgcccgcgatcgcactgggcctgtttctgctcaggagccagtcttacccatacccttgccgct

SEQ ID NO: 179 - DNA, 70 bp, Zea mays
  unsure (1)..(70): unsure at all n locations; Clone ID: LIB3179-002-P1-K1-C2
agagganccaagcnnacgnacgcgngcangcgacgncanagcncnncnanaggggcacccaaanncaann

SEQ ID NO: 180 - DNA, 310 bp, Zea mays
  Clone ID: LIB3179-002-P1-K1-C4
aagacgacttgtttcattgattcttgaagagatcgagcttcttttgcaccacaaggtggaggatgtcttgcaactgcggatcaagctgcagctgctgctcaagctgcaagcgcggcaagaagtaccctgacctggaggagacgagcaccgacgggcaggccaccgtcgagctcagcttgtcccccgagaagaaaggcacgcccgagttcctcgatgcctccaaagagttcatgcagggctgccactcctggcgcttgtgtagcagctgcaagtgcgacccccagaactgctgatcacatggaacgacgac

SEQ ID NO: 181 - DNA, 374 bp, Zea mays
  Clone ID: LIB3179-002-P1-K1-C6
gcaggtgaaacaatcaaaatgctgagaaaaaggagcaacgagagacactaaggacgtgtttggtttgcgaattcagttgatccggcatgagctgctcctgcatgaggtcgtccgatgtttttctgggagtgaaccggtgctgcataattgcacttctaacgagcactacatggagtatctgatgtcggacgacacagatctatgatgtaaaccaaacaaatatattaggttcggatataggatcggatgattccggagaccgttgtccggcaaaccaaacacgttgtaaattaaatcgctggatccaagagtatgctgaaactaactgtattgacgaccaaagtttgatgttgttgagctcaaataacttgagc

SEQ ID NO: 182 - DNA, 291 bp, Zea mays
  unsure (1)..(291): unsure at all n locations; Clone ID: LIB3179-002-P1-K1-C9
aagctggccnnncngnnnacaccctaaaacnaaaacnagagncgncggcggcaacaagcggnacgnacgnagaggangaagagcaggagcagcactcngnnggnganccnagnncnccaggcccnncngcnctcngcggcgggggccaaaggaccngcagggccgaagaagcagggcnggngcggcgagggcaccagcnggncgggcgngnggaccngcgacgaccnccncaccaagggcgccgccaccggcaagaacccgcgccccgnngccacgggcaagggcgccacc

SEQ ID NO: 183 - DNA, 374 bp, Zea mays
  Clone ID: LIB3179-002-P1-K1-D10
caagcgcgccgtcaccatcctggtcatggccaaggcccgcatcgggcacttcgtggaggcccagatcctggaggccctgggcgtcgactacgtggacgagagcgaggtgctcacccccgccgacgacgcgcaccacatcaacaagcacaacttccgcgtccccttcgtctgcggctgccgcgacctcggcgaggcgctccgcagggtgcgcgagggcgccgccatgatccgcaccaagggggaggccggcacgggcaacgtcgtcgaggccgtgcgccacgtgcgctccgtcatgggcgacgtccgcgcgctccgcagcatggacgacgacgaggtcttcgcctacgccaagcgcatcgtcgcgccctacgacc

SEQ ID NO: 184 - DNA, 279 bp, Zea mays
  unsure (1)..(279): unsure at all n locations; Clone ID: LIB3179-002-P1-K1-D11
gacccacgacgtccgcaagtcgcgtccgacaccattctctttttatggccaaggcaccgcaatcgggcgcgggtgggtgtggcctcagatcactggtaggcccctgggctctcttactacgtggactagagcnnagttgctaaccttctgccaacgacgtcgcaccatatcaacaagcacaacttccgcttcccctatcgtctgctgttgtcgcgaccttggcgaggcgctcctcagggtgcgcgagggcgccgtcttgatcctcaccaaggtggaggt

SEQ ID NO: 185 - DNA, 376 bp, Zea mays
  Clone ID: LIB3179-002-P1-K1-D2
aaacgccgccccttctcgtctcgacctctccccaccggctaaccctagcagcggcacgcgggcgacggcgaccagtagagggctagtcgcgccaccggcgaagggattcagcggtctacccgtcctccgacacaggcgcggcggcgtcctgcagattattattggtttgttgcaaaatgtctacggaagcgactttgaacaattctggtggttctgaatctgcattgctgttactggaacagcttgctgaagtttttggaaagttaaaaactcacaccgaaacatttctgcatttgcaaaatggcataaaatgggaagatattgaagggcatttcctcagccttgatgagttgtacagaagcaagtttgatgaact

SEQ ID NO: 186 - DNA, 377 bp, Zea mays
  Clone ID: LIB3179-002-P1-K1-D3
gacagagaagaaaaactgcagccgccgagctcagcctcagccgccgcgacggggacagagaaagatggccgacggcagtgcctccgcctcaccgccttccgtttctccgcaccagtaccaccgcgacgccatcaagtcctcagtgcgcaatacagctgctaataggaggagagaacatgctattgcaatagggaaggaaagaagggaagccttgatgcgtgcaaagcgtgtatgccgagctcctctttctggcagtgatgaggctgcagcagaagagggggacatggttgttgatgaggagaaagcagatcttgagactagaacgactcaggctgttgaggagctgaaatctgctttgtcaagccagggaaaaggtg

SEQ ID NO: 187 - DNA, 303 bp, Zea mays
  Clone ID: LIB3179-002-P1-K1-D4
aagacaacttgaatcattgattcttgaagatatcgagcttctttcgcaccacagggagggggaggtcttgcaactgcggatcaagcttcagctgctgctcaagctgcaagcgcggcccgaagtaccctcacctggaggtgactagcacctacaggcagtcctccgtcgtgctcacattctaccccaataagaaaggcacgcccggattcgttgaggcctgcaaagcgtttatgccgagctcctatttctggcagtgatgaagctgctgcaaaagatggcgacacggctgctgatcacatgaaa

SEQ ID NO: 188 - DNA, 380 bp, Zea mays
  unsure (1)..(380): unsure at all n locations; Clone ID: LIB3179-002-P1-K1-D5
gacagagaagaaaaactgcagccgtctagctcagcctcagccgccgcgacggggacagagaaagatggccgacggcagtgccttcgcctcaccgccttccgtttctccgcaccagtaccaccgcgacgccatcaagtcctcagtgcgcaatacagctgctaataggaggagagaacatgctattgcaatagggaaggaaagaagggaagccttgatgcgtgcaaagcgtgtatgccgagctcctctttctggcagtgatgaggctgcagcagaagagggggacatggttgttgatgaggagaaagcagatcttgagactagaacgactcangctgttgaggagctgaaatctgctttgtcaagccaggggaaaggtgcac

SEQ ID NO: 189 - DNA, 391 bp, Zea mays
  Clone ID: LIB3179-002-P1-K1-D6
ctttagtatatagcaatagcacactcggcccccctcctcttcaactcccccggccgtcctgctcgccggcttctggctggcccctgcatccgcccagtgtgtgtgacctcagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcga

SEQ ID NO: 190 - DNA, 259 bp, Zea mays
  unsure (1)..(259): unsure at all n locations; Clone ID: LIB3179-002-P1-K1-D7
actagaacgagagcgggcgcgccagaggaaccaagcccacgcacgcgggcgcgcgacggcaaagcccnagcaaagcgacaccgaaacccaaancaaaggccgnggncggacaacgacaagaccgggaaaacccaggcgcnacccaacccaaacgcaaggcagcacaagcacaaaccgccagcgggcagaagagcaaaaaggcccggaccgaccgcccncgccaacagnagcacaggcggaaaggcgaaggggacgcgcc

SEQ ID NO: 191 - DNA, 82 bp, Zea mays
  unsure (1)..(82): unsure at all n locations; Clone ID: LIB3179-002-P1-K1-E12
tttttcttttctagagganccaagcttacgggggcgggcatgctacttcatatctcttctatagngtctcctaaattcaatt

SEQ ID NO: 192 - DNA, 353 bp, Zea mays
  unsure (1)..(353): unsure at all n locations; Clone ID: LIB3179-002-P1-K1-E2
accgattaaccaatttctcgactctggtgttgatcctaaagagataccactgcctgatgaatttatcttgaatcgcgaccttttggctcaactttatcctagttttgccgaaggagcaaccccttttttcaccttgaattggtccaaatatgcggaatttcttagttttcgcggaggactagatccaataaccggtggtctatggttgagcgatattgcacaccatcatttagctattgctattcttttcctgatcgctggtcatatgtataggaccaataggggtattggtcatggacttaaagatattttggaggctcatattggcccnattacaggacaagggcataaag

SEQ ID NO: 193 - DNA, 319 bp, Zea mays
  Clone ID: LIB3179-002-P1-K1-E6
gcaacaaagagggaccccgcttccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgttgctgccgaaaatcgaggacgacggcaacccgcgattcgtcatcttcattccaaccgtcaatgtctacttctggtatcccggtcaacatt

SEQ ID NO: 194 - DNA, 337 bp, Zea mays
  Clone ID: LIB3179-002-P1-K1-E7
aaaaaaaaaaaaaaaaaaattaaatttaaaaaaaaaaaaaaaaaaaaaaaaaaaagaaaaaaaaaaaaaaaaaaaaaaaaaaaaatattaaaaaaaaaaataaaaaaaaaaataaaaaaaatttaattaattattttttgggggggcctttttagggaaccaaattttttttccggtttatttgaatttaaaagtttttttttgggggacccaaattttatttatttggcgggggtttaaaaatgttttttttggaaaaactttgtttttcccaaattattattttttgtataaattctccttttctcagtttgattttttttttaattgttctttt

SEQ ID NO: 195 - DNA, 371 bp, Zea mays
  Clone ID: LIB3179-002-P1-K1-E8
gcggataaatgcttgcccctatttgctcagcccgctctcggacgaacccattcacccgtccggccgtccgtgcgcggcgcacccacccggcaccggcaccagcaccaccgcccgcccggcgcccgtcacgctcgagaggaggaggaagaagaagggactgggcgacagcgcgcgatggccgccgtcgtgtgcgtcaccggcgccggcggcttcatcggctcgtggatcgtcaagatcctcctcgcccgcgggtacgccgtccggggcacctcccgccgcgaagctgctgaccccaagaacgcgcacctgtgggcgctcgacggcgcggcggagcgcctcaccatgctgcaggtggacctgctcgaccgcgc

SEQ ID NO: 196 - DNA, 372 bp, Zea mays
  Clone ID: LIB3179-002-P1-K1-F10
gccccagcaacaacgggcagagcatctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtgga

SEQ ID NO: 197 - DNA, 189 bp, Zea mays
  Clone ID: LIB3179-002-P1-K1-F11
cattcccatcccgagacaggagagggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaagacggtcggggtggaggtggt

SEQ ID NO: 198 - DNA, 375 bp, Zea mays
  Clone ID: LIB3179-002-P1-K1-F2
ctgcatttcaaaataggcgtatcttcctgcgcttttcctagccctttgtcatccaaggaaacaataaacaaccggcgcttttacacccccgccaagaacaggagcaacaacaacaaggctcctcgcaacaatccattctcatccatggcgaagctcatgaacaagttggtcgattcgttcgagcacgacgagataccggacgtcggctgcgtgcgcgccgtgctggccgagctcgtcctcaccttcctcttcgtcttcaccggcgtctccggccgcatggccgcggatccgacgggaagcccggcgacgctatgccgatggcgacgctggcggcggtggctatcgcgcacgcgctggccgctggcgtcctggtga

SEQ ID NO: 199 - DNA, 377 bp, Zea mays
  Clone ID: LIB3179-002-P1-K1-F3
aagcagctgttgcaaccggttccttcgaggagaacgtgagaaagaagcatgaggccccaggtgctgctcgtcgcactggccgtcttcgccgtcctcgtagctctgccactgggcaaagcgcacgaggaggaggaggaggaagggcttgaactcgaagccagcaggaggcggtggccgtgctgcgaccagtgcggcatttgcaccaggtcgcagccgccgatatgcgagtgcagggacacgtcgacgaccggctgccacccggcttgcaaggcgtgcgccctgtccatctccgacggcctcttcgtgtgcaaggacaagatcgtcaacttctgcaagcgccgatgtacccgtcgtactgatgatgatgatgcgtgact

SEQ ID NO: 200 - DNA, 373 bp, Zea mays
  unsure (1)..(373): unsure at all n locations; Clone ID: LIB3179-002-P1-K1-F4
ggtttctcaatcattgtttttggcaacaaaattagcacacaaactggaattggcacgtccattgccatagctggtgttgctatgtactcttacattaaggctaagattgaagaggagaaaaggaaaaagagcgcatgactgctgtgaataatattatcgagaccttcctcggacacaacatcgtcgacaatcacgacctacttctatatcttgttttgttttcatcttgagtcagtcggtccattgtttgttcccagtctggtgattaaaagtctgcaaattctgtttgtggaattggcagcgatacaaatttggcttctttaagtaaatccggttgccggtgtaaaaaannnnnnnntttactttctttttt

SEQ ID NO: 201 - DNA, 373 bp, Zea mays
  Clone ID: LIB3179-002-P1-K1-F9
gcagcctccactgttgctgcgccttcacctcctcttccgctctgaaacccaaattcctttactccggcgacgacccagctgcgacgcgccccattgccggaccaggagggttggaggcggcggcagtgggcttcgtcaccggtaagaggaaggccaccgaggtagcccaagcgttctggagaaatattgttcagaaaggggatacggtggtcgatgccacatgcggccatgcgggaatgacaatgacacgctcgctctgcttaagatggtggctgacaaaacaggccgtggatgtgtttatgggatggacattcaagaatctgcgatagagaatactttctcttttctgaaaatggccgtggatgatgaacat

SEQ ID NO: 202 - DNA, 374 bp, Zea mays
  Clone ID: LIB3179-002-P1-K1-G10
gcggagacagatggcggcacgagtcgtaggctgatgctgcagtcggcagactatttcctgccagctgggttcaaatgtagaagagcttcgtacgtcctatcccgcgtctgggcaaacgacgaaacggttcaggagagcctcggtgtccgcaaggggacaatcggagcgtggaaacgatgcaaccaggacatactttacaaccagaacgtccaaagtgtagtgccgtaccattcgaggctagccgcgaaagggtacagggcgctgatatacagcggcgatcacgatcgtatcgtacccttcgttggcacacaagcatggattaggtatctcaacttgaccgttgtagatgactggcgaccatggtatgttggtgg

SEQ ID NO: 203 - DNA, 303 bp, Zea mays
  unsure (1)..(303): unsure at all n locations; Clone ID: LIB3179-002-P1-K1-G11
ccagagggnnataaaagaccncgccctncaagacangngaaccancaggcggagaaaaangacacngaaganggcacagcgaccaggncnccagacaggcaacngaagagaaagcanganncngcnggaaccganganancaggnangcaaagagggcancgaccagcccagnncaaccgaaaaanncaccncaancnggaagcacnggcgangagaccagagggaacaaccaaaaaaaaagggcnccnagcgaagcaaggggnggcaagccggcnaaaccacaggcaaggaagagaagccca

SEQ ID NO: 204 - DNA, 242 bp, Zea mays
  unsure (1)..(242): unsure at all n locations; Clone ID: LIB3179-002-P1-K1-G4
cagtaatgcgatggactaacgactggaatagaactttcttttggnggaaacacaanccactgcggtgagccacttttctacatccgccccttatccaacttcaagtatttctctttntancattcattattattctatttatttcgactctgatacctctttcgagatatttttacataggatgccactctttaaaattaaaaaaatgagtaaacatctttttcacgaaaaataacttatcc

SEQ ID NO: 205 - DNA, 236 bp, Zea mays
  Clone ID: LIB3179-002-P1-K1-G7
cgtgttcagccctgaggtgcttgacctttccgaggaggacctgattgagaagtgtgccactggtgtctccatggttgcctccctgtcactggcgatctcgtacccgacccttgctgctgtgccccacatgttcatcaatggtttcaagaatgtgcttgctgttgctgtcgagacagactactcgtacccacatgctgacaagatcatggagtaccttaaggacccaagcaagtttg

SEQ ID NO: 206 - DNA, 373 bp, Zea mays
  unsure (1)..(373): unsure at all n locations; Clone ID: LIB3179-002-P1-K1-G8
ggaaatcaaagcaacaaagttgccggccgagagaagcaaccatgagacctcaggcgtcgttactcgtcacactggctgttatcgtcgtcgtccctgcagctctgccactcagcaaagggacggaggaggaaggaggaggggaggcagtcgccgccgtggacgccgccggaacgagctcgtggccgtgctgcaacaagtgcggcttctgctacctgtctgacccgccgcagtgccaatgcctggacttctcgacggtcgggtgccacccagagtgcaagcggtgcatcaggtacaccgccgacggtggtgtcgacattccgcccgtgcacgcctaccgntgcgccgacatcctcttcaacttctgcgagcgccg

SEQ ID NO: 207 - DNA, 375 bp, Zea mays
  Clone ID: LIB3179-002-P1-K1-G9
gcggcagcgaggcggaagcaaaggaaaggggatatgtcgaggccgcccaacaggagcgacgcgcacctctccgccgaggacgaggcggcgctggaggccgaggtgcgggagtactacgacgacgcggcgccaaagcgccacaccaagccctcccgcagcgagcactccgccgcgtacgtcgacgcgctcgtcccggacgtcggcggcaactcccacccggagctggacaagttccaagagctggaagcccacaccgagaggttggtgtacgagggcgccaatgtgggagatgagttcgtggagacggagtactacaaggacctaggcggcgtcggcgagcagcaccacatgaccggaacgggcttcatcaagatg

SEQ ID NO: 208 - DNA, 337 bp, Zea mays
  unsure (1)..(337): unsure at all n locations; Clone ID: LIB3179-002-P1-K1-H1
ggctttcactctcaagggccccactcccacctggccgccgaagccatggggatcacagggccaactcccgacatcctcggcgagcgccagtccggccaggacgtccgcacgcagaacgtgatggcttgcggggcggtggccaacatcgtcaaatcctcgctcggccccgttggtctcgacaagatgctagtggacgatattggggatgttacaatcactaatgatggagcacccatacttaagatgttggaagttgagcatncagccgncaaggttcttgttgagttggctgagctccaagatcgtgaggtaggagatggaactaccttcgttgtca

SEQ ID NO: 209 - DNA, 162 bp, Zea mays
  Clone ID: LIB3179-002-P1-K1-H2
ggtacggtttcggaattacagaacagaactactggttgacaatgtagtatgatgtgcatattaaacactacatagataactattcatatttaggattaaaatctaagatgaccactaatattgcttcaaaaagagcagcttttgtgaggccattcacttctc

SEQ ID NO: 210 - DNA, 372 bp, Zea mays
  Clone ID: LIB3179-002-P1-K1-H3
cttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcct

SEQ ID NO: 211 - DNA, 73 bp, Zea mays
  unsure (1)..(73): unsure at all n locations; Clone ID: LIB3179-002-P1-K1-H6
tctagagganccaagcnnacgnacgcgggcatgcgacgncanagcncnnctatagngncaccgaaanncaann

SEQ ID NO: 212 - DNA, 211 bp, Zea mays
  Clone ID: LIB3179-002-P1-K1-H8
ctcaagttttgttctcctctcctagtctagccagcacctgcagatctgctcgtggcctggggctactgatttgggggaacgaagcgatggttcgaagggggcccggggtttcctgcttgctgttcctggggggggcgggcaacctgttaaggggatggccacgcagacagcggctgcagatgcggctgctggcgaccaacgcggagctgga

SEQ ID NO: 213 - DNA, 266 bp, Zea mays
  Clone ID: LIB3179-002-P1-K2-A1
tgtgaagcgagagcccactgtctccaagatccaagcttagtcgcgcatgtaccagaccgagaagcaactgtatggactaggggacatggacccaactgacctcaaggtgacagcctcgtcgcagctgcaagagctcacggttcctaatgctatcggctccacgcacacgattaatgacgccatttgcgttgtaccagaaagtcatgcacatatcgcccttcctataaagtccgcagtgtgtttgaagaacgggacccgccccatat

SEQ ID NO: 214 - DNA, 442 bp, Zea mays
  Clone ID: LIB3179-002-P1-K2-A10
cgaagctaattctaggttgcagcagaatgggatcaccaatgataatgctacagaagatggttctgagcaagatttgcagatgcatcctttactgtttcattatcctcgagatgtggtttcgtcatatagtcatccggttcaaaatcttattaatcagtcaagaaaatatgatcttttcccctttgagaaagttcaagttgagagaagtaacaaccagactacaggttccaccaaaaatggtactgtaaatgctaacactatcgacttccatcctctcttgcaaagaacagaagttgatgtgcataatgatgtaccagaatatgatagtaaccttgattaccatcagtctgataataacatgagcaaagttccagtagatgaccagtcaacggctgggcaagcatccacaggcccttctgagagggagacaagtattgacttg

SEQ ID NO: 215 - DNA, 403 bp, Zea mays
  Clone ID: LIB3179-002-P1-K2-A2
ctcaactacagcgaaatatgccatgagtgcgtcagtacagcaaaaccattcacttttcaaaaaaacaaaaataaaaaaaaggaaaaaggtaaaaaaaaaaaggggagacgaaaaaaaaaaatctaaaaaacaagcctaacaaaaaaaaaaaaaggggcggccctttttaaggtacccagttttcctcccccttggttgcaacctaatactttttttttgggggccccaaaattaaatcccctgcccctgttttaacaacagccttattgtaaaacccttggtttccccaaattaattccctttgcaaaaattccccttttttcagggtggttaaataccaaaagggcccaaccatattcctttttcaaaaaattgccaaccttttatggtaaatggccccccc

SEQ ID NO: 216 - DNA, 387 bp, Zea mays
  Clone ID: LIB3179-002-P1-K2-A3
cgggcctaaccctaaatttgggggcgcttgggtcaaagagacggggggaggaatcgagccggcggcttgcggcggcatcagcgatggcggcgaagcgggagatctcgagcaccctcaggaacctcaagtttatgcagcgcggcgcggctgcgcagaaggccgaggagaaggccgaggtggaggtacaggaggaggcggtggtgatggcgccgagcggaggctacgcctcgcccgcgcaggtcgctaggaagtgcatcgttatcatggagggtaatccttatccaggagctataaagggtcggatgtctttccaaaagttcaatccacctatcggtaaactaaatgaagaggcaagaggggcccagcaaacagaatcagctttcccca

SEQ ID NO: 217 - DNA, 404 bp, Zea mays
  unsure (1)..(404): unsure at all n locations; Clone ID: LIB3179-002-P1-K2-A4
cgggctgagctacagggaaatcagccatgagtgcgtcgtcggcgaagccatccattttcggcaagacgtcgtggccggaggggggcgttctgagcgtcgagggagcgcaanaaggagattctggcggacaagccgaacgccgacatcgtggtgctgcccaccaccacgcaggcggtgacctccgactttggtttcgaccgtgtccgcgtcttcttcgggaccgtcgcccagacgccctatgttggctaggctagagccttatcctagaggtcttctttactctcgttcatgaccaccttgctatatgttactactagtaataaatgttttaattacatggaggattcatgcttatcctttggtatctttactctttgttgtacttcttacttcggctacttgat

SEQ ID NO: 218 - DNA, 398 bp, Zea mays
  Clone ID: LIB3179-002-P1-K2-A8
ctcaactacagggaaatcagccatgagtgcgtcgtcggcgaagccagccaccggcggcaagacgtcgtggccggaggtggtcgggctgagcgtcgaggaagccaagaaggtgattctggcggacaagccgaacgccgacatcgtggtgctgcccaccaccacgcaggcggtgacctccgactttgggttcgaccgtgtccgcgtcttcgtcgggaccgtcgcccagacgccccatgttggctaggctagagcctcagcctagaggtcgtcggcaccgccggccatgaccacctgctatatgtcactactagtaataaagtataaataacagggaggatgcatgctcatccttggaatctgtacgcttgttggactactacttggctacttgaaacgaa

SEQ ID NO: 219 - DNA, 127 bp, Zea mays
  unsure (1)..(127): unsure at all n locations; Clone ID: LIB3179-002-P1-K2-B11
cgggcctggtacaacatccatnncttgaggtgactcgnnaggatataagaacgctaccatagtgtgaggatnngaaagtttnnttgagtcaagaggagagaaaaaaaaaagaaagggagggagggag

SEQ ID NO: 220 - DNA, 409 bp, Zea mays
  unsure (1)..(409): unsure at all n locations; Clone ID: LIB3179-002-P1-K2-B9
gattttcgtgggcccagaggcgtcaaacagctgcatttcttccaggcgaccacttgntgttgttcagactgaacatctgggcggtcagcggtttcgtcttcaccttcagaccgtttttcgttcgaggcagtgccaagcactgaaacatggatgaagcggacgacgacccatgggtatcctatccaggggcaatcgaatatagattttcttgtggcgtggccaagggcggtgccgagcctgtaccagtacgacgactcaggccagaacacacggcgtatggtatggtacacagcaaggccgtgttgttgctgtaagttttgtaatttctgtttcctttttctcggcttcgcagcatgctattgctgtattttatgtgagaacactttgttactgtgcttgttgcgcggtt

SEQ ID NO: 221 - DNA, 449 bp, Zea mays
  unsure (1)..(449): unsure at all n locations; Clone ID: LIB3179-002-P1-K2-C1
acgaagtgcgagcgacccacgtccacacgatacgaaccaccaccaccaaccagcagccggagcacgcacccagcgcagagcgagggcgtcgctcaccatgatggcgtccttcgccgccgtggcggtggccgcgccctcgcgccgcggcaccttcgccgtggtcaggtccgccaaggtcgaccgctgccaggagcccgccacgctagcagcaaccgaggccaggcccgccgccgacggacgccgcgccgtcatgctcgcggctgctgcggcggccgtggcagccatcggcggcgccggcgccgccatggcgggccccaagaacgggacccccgaggcgaagaagaagtacgcggccatctgcgtcaccatgcccaccgccaaggtctgccacaactgagcacgcccgcgtngcatgcagctgcagggccggggggtggtatataattaat

SEQ ID NO: 222 - DNA, 372 bp, Zea mays
  unsure (1)..(372): unsure at all n locations; Clone ID: LIB3179-002-P1-K2-C10
cttcttcaccctcaagtcatacctgccgttcgacacgcccaaggggctggaggacctgaggaagaaggacctgcaggggctgcgctnctacgggcacggcgagcgcaaggtgttcgagcgcgtctacgactacgacgtgtacaacgacctgggcgacccggacaagaacccggcccaccagcggcccgtgctgggcggcaacaagcagtacccatacccgcgccgctgtcgcaccggccgccccaggaccaagaaggaccccgagacggagatgcgcgagggccacaactacgtgccccgcgacgagcagttctcggaggtgaagcaactcacgttcggggccaccacgctgcgctccggcctgcacgcgct

SEQ ID NO: 223 - DNA, 174 bp, Zea mays
  Clone ID: LIB3179-002-P1-K2-C11
ctcctcatctccaccctctcttcacattttatataccaagccagccctacctcaccggaccgtattttatacatggggggcggcttcttactcacattgccatctcacgccactctattccgtcctctactaccacggttccaactaccttgctcacctgtacactatctcttt

SEQ ID NO: 224 - DNA, 188 bp, Zea mays
  Clone ID: LIB3179-002-P1-K2-C4
aaaacaacttgatccattgattcttcaaaatatctttcttcttttccaccacaagcacaaggatgtcttccaactgcggagggagctccaacttcaactcaatctgcaaatgcgtacaaaagtaccattacctagaccatactagcacctacatgcattccaccgacgaacttaccttttaccccaat

SEQ ID NO: 225 - DNA, 423 bp, Zea mays
  Clone ID: LIB3179-002-P1-K2-C6
gcaggtgaaacaatcaaaatgctgagaaaaaggagcaacgagagacactaaggacgtgtttggtttgcgaattcagttgatccggcatgagctgctcctgcatgaggtcgtccgatgtttttctgggagtgaaccggtgctgcataattgcacttctaacgagcactacatggagtatctgatgtcggacgacacagatctatgatgtaaaccaaacaaatatattaggttcggatataggatcggatgattccggagaccgttgtccggcaaaccaaacacgttgtaaattaaatcgctggatccaagagtatgctgaaactaactgtattgacgaccaaggtttgatgttgttgagctcaaataacttgagcttgtagtttttgaaaaaatataattttttaaatattttttttttttttt

SEQ ID NO: 226 - DNA, 470 bp, Zea mays
  Clone ID: LIB3179-002-P1-K2-C7
gcgctcccatcccgtcccgccccttgtctcttccgcttccgcccgaccccgcgcgccgcggaccagcagccatgtcgtgctccgaccgctccaccgcctggtcctcctcggcgctcgccagcagcgcctccaccacccgtcggcgctcccccccgcgctcgggtctcctggtgcggtgttccctccgtgagctccgcacccgcatcgactccgtcaggaacacgcagaagatcacggaggccatgaagctggtggccgccgccaaggtccggcgcgcgcaggaggccgtcgtctcctctcgccctttctcggaggcgctggtggaggtgctctacaacatgaaccaggagatccagacggaggacattgacctgtcccttacccgcacccgtcccgtcaagaaggtggccctcgtggtcctgaccggcgagcgcggcctctgcgggagcttcaacaacaacgtgctcaag

SEQ ID NO: 227 - DNA, 457 bp, Zea mays
  Clone ID: LIB3179-002-P1-K2-D1
aagcttgccttcttgtttacaccctaaaactaaaactagagtcgtcggcggcaacaagcggtacgtacgtagaggatggagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtgtccacgggcaagggcgccaccaagtacaggtgccgcgacttcctccccgaaaactgcgggtgcaagatccactaaactcatccaattccaccatggccacagcagccgatggatccttcttccatatgcatgttctcctccgtccgtccgcctagctttgctacaagcaggcgctaataagcaagct

SEQ ID NO: 228 - DNA, 399 bp, Zea mays
  Clone ID: LIB3179-002-P1-K2-D10
caagcgcgccgtcaccatcccggtcatggccaaggcccgcatcgggcacttcgtggaggcgcagatcctggaggcccggggcgtcgactacgtggacgagagcgaggtgctcacccccgccgacgacgcgcaccacatcaacaagcacaacttccgcgtccccttcgtctgcggctgccgcgacctcggcgaggcgctccgcagggtgcgcgagggcgccgccatgatccgcaccaagggggaggccggcacgggcaacgtcgtcgaggccgtgcgccacgtgcgctccgtcatgggcgacgtccgcgcgctccgcagcatggacgacgacgaggtcttcgcctacgccaagcgcatcgccgcgccctacgacctcgtcatgcagaccaagcagctggg

SEQ ID NO: 229 - DNA, 97 bp, Zea mays
  Clone ID: LIB3179-002-P1-K2-D2
actagatctagagcggaacgctctatttgtttcaagctcacgttcacgtacatgcgcctgcgtagctatagtatagcgggaggtaaatctaattcaa

SEQ ID NO: 230 - DNA, 380 bp, Zea mays
  Clone ID: LIB3179-002-P1-K2-D5
gacagagaagaaaaactgcagccgccgagcttatcctcagccgccgcgacgggaacagagagagatggccgacggcaggggcgccggctcaccgccttccgtttctccgcaccagtaccaccgcgacgccatcaagtcctcagtgcgcaatacagctgctaataggaggagagaacatgctattgcaatagggaaggaaagaagggaagccttgatgcgtgcaaagcgtgtatgccgagctcctctttctggcagtgatgaggctgcagcagaagagggggacatggttgttgatgaggagaaagcagatcttgagactagaacgactcatgctgttgaggagctgaaatctgctttgtcaagccagggaaaaggtgcac

SEQ ID NO: 231 - DNA, 460 bp, Zea mays
  Clone ID: LIB3179-002-P1-K2-D6
tagcaatagcacactcggcccccctcctcttcaacttccccggccgtcctgctcgccggcttctgggtggcccctgcatccgcccagggtgtgtgacctcagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggggtcatcgagaccttccagagccaggcgaacgacacgaagcggggcggcatcaccgtcttcgtgcccagggacttcgcgttcgcggcg

SEQ ID NO: 232 - DNA, 486 bp, Zea mays
  unsure (1)..(486): unsure at all n locations; Clone ID: LIB3179-002-P1-K2-D7
gaaaaacccgggccgacccgggcgtccgcaacaactaaaggcaggcgtcggcacaccgtttcaccttaccggcctagacacttggagaagggggaggcaccccagcggcatgggcgccagtcccntcatccctgcgacgatgctcgtcgtcgctctccttgtcgctaggtagtactgtctgcttcggcgccaccgncaccgacaccgacaccgacggcgccattcgtctccccagcagctcttgtgctgttggtcgaccgtgggagtgctgtgactatgtcaccaaggagccgtttatcaagccgccccggtggcgctgcaacgacgtggtggacaagtgctccgccgactgccaagagtgcgaggagtcgtccgccggcgaccgcttcgtctgccgtgactggatcttcagcctgctcgagcccccggtctgcacacccaggccgtgggactgctgcgacttcgccgtctgcacaagggactaca

SEQ ID NO: 233 - DNA, 468 bp, Zea mays
  Clone ID: LIB3179-002-P1-K2-D8
aaacgccgccccttctcgtctcgacctctcctcacctgctaaccctagcagcggcacgcgggcgacggctaccagtagaggggtggtggcgccaccggcgaagggattcagcggtctacccgtcctccgacacaggcgcggcggcgtcctgcagattattattggtttgttgcaaaatgtctacggaagcgactttgaacaattctggtggttctgaatctgcattgctgttactggaacagcttgctgaagtttttggaaagttaaaaactcacaccgaaacatttctgcatttgcaaaatggcataaaatgggaagatattgaagggcatttcctcagccttgatgagtcgtacagaagcaagtttgatgaactggtagagaaggagaaggcattagaagaaaagaaagctgaagcttgtaggttgattgcagagaaagaggctaaagtttctacaaaagagcatg

SEQ ID NO: 234 - DNA, 470 bp, Zea mays
  unsure (1)..(470): unsure at all n locations; Clone ID: LIB3179-002-P1-K2-D9
gacagagaagaaaaactgcagccgccgagctcagcctcagccgccgcgacggggacagagagagagggccgacggcagtgcgcgccgcgtcaccnccttccgtttctccgcaccagtaccaccgcgacgccatcaagtcctcagtgcgcaatacagctgctaataggaggagagaacatgctattgcaatagggaaggaaagaagggaagccttgatgcgtgcaaagcgtgtatgccgagctcctctttctggcagtgatgaggctgcagcagaagagggggacatggttgttgatgaggagaaagcagatcttgagactagaacgactcaggctgttgaggagctgaaatctgctttgtcaagccagggaaaaggtgcacagaataggaagacagaagtgcttcgtgctttaaggcgtttgttgtcccagtctgaagtacctncagttgatgcagcaattaaagctgga

SEQ ID NO: 235 - DNA, 408 bp, Zea mays
  Clone ID: LIB3179-002-P1-K2-E12
acatctctctatttctattatctctagctccctcatcttttttatccactacttacctacaccattcgtgctacttttataactctgtgtggcgtgacactctaaattcaattcactattccctctttctacaacattcttacttttaaaaccctttctttacccaacttaatctccttttatttcattccctcttctccaactatcattatattctacattccttcacctatctcctctcccaacttcttctcatctctattataactatatcctctctctctttatcttccctttaacctctatcttttctttttttattcttaacctttctcctactcctttcctaatatccttacctttcctttattttttactctctattccatcactttctccccctctttt

SEQ ID NO: 236 - DNA, 304 bp, Zea mays
  Clone ID: LIB3179-002-P1-K2-E2
aaaaaaaaaaaaaaaaaaaaaaaaaaaaaatttaaaaaaaaaaaaaaaaaaaaaaaaaaaagggaaaaataaaaaggaggggaggaaaaaaaaaaaaaaaaaaaaaaaaaaaaaaaaaaaaaaaaaaaaaaaaaaaagggcccccctttttagagaaccaaatttttcttccttttttttccaattattaattttttttttttggccccttaatttaaattccttgccctttttttaaaaacttggttcttgaaaaacccttgttattcccaaatttaattcttttatataatattcctttttc

SEQ ID NO: 237 - DNA, 456 bp, Zea mays
  unsure (1)..(456): unsure at all n locations; Clone ID: LIB3179-002-P1-K2-E3
gcggataaatgcttgcccctatttgctcagtccgctctcggacgaacccattcacccgtccggccgtccgtgcgcggggcgcgcacccggcaccggcaccagcaccaccgcccgcccggcgcccgtcacgctcgagaggaggaggaagaagaagggactgggcgacagcgcgcgatggccgccgtcgtgtgcgtcaccggcgccggcggcttcatcggctcgtggatcgtcaagatcctcctcgcccgcgggtacgccgtccggggcacctcccgccgcgaagctgctgaccccaagaacgcgcacctgtgggcgctcgacggcgcggcggagcgcctcaccatgctgcaggtggacctgctcgaccgcgccagcctccgcgccgtctttcgcggctgcgacggcgtcatccacaccgnctcgccgatgcacgacaaccccgaggagatcatcgag

SEQ ID NO: 238 - DNA, 430 bp, Zea mays
  unsure (1)..(430): unsure at all n locations; Clone ID: LIB3179-002-P1-K2-E6
gcaacaaagagggaccccgcttccatggaggtggtgggcggcgtgtcgctgaggccgtcgggagcgccggcgcgtatgcgggtaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtctacttctggtacccgctcaacatcatcacgggcggtacgacggcgaagatcatgctcgccgccaaggacaactttctcggcaggtacatctacaaggacacgctcgccaggaacctcgccgncgtcaattacaaaga

SEQ ID NO: 239 - DNA, 465 bp, Zea mays
  Clone ID: LIB3179-002-P1-K2-E8
tttaccgattaaccaatttctcgactctgtttttgatcctaaagagataccacttcctcatgaatgtatcttgaatcggggcgtgggggctcaactttatcctagttttgccgaaggagcaaccccttttttcaccttgaattggtccaaatatgcgcaatttcttagttttcgcggaggactagatccaataaccggtggtctatggttgagcgatattgcacaccatcatttagctattgctattcttttcctgatcgctggtcatatgtataggaccaattggtgtattggtcatggacttaaagatattttggaggctcataatggcccatttacaggacaaggccataaaggtctctatgaaatcctaacaacgtcatggcatgctcaattatcttttaacctagctattctaggctctacaactatggttgtagctcatcatatgaactctatgccccc

SEQ ID NO: 240 - DNA, 392 bp, Zea mays
  unsure (1)..(392): unsure at all n locations; Clone ID: LIB3179-002-P1-K2-F1
tgacaagttagctacccgcgcagcgccgcgcgccatggccacgatgaaccaccgcattgtgcccctcctgctggtcgcagccacactgctcgcgcaggccgcggcctgcccctactgcccgacgccgaagccgncgncgnctccgccgccgtcgtcgtcgtccacgccgtgccctcccccgccctactcgccgtcgccgtccacgccgacgggtaagtgccccgtgaacacgctcaagctgctcgcgtgcgtggacgcgctcaacggcctcgtgcacgccgtcatcgggaccaaggccagcgacacctgctgcccgctgctctccggcgtggccgacctcgacgccgcgctctggctctgcaccaccatcaaggccaaggcgctcagcgtca

SEQ ID NO: 241 - DNA, 376 bp, Zea mays
  Clone ID: LIB3179-002-P1-K2-F10
gccccagcaacaacgggcagagcattttgtatataacgcctggaagaaggccggcgcctgctgcggcctcagcgaggaaggctggcttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggtgaacggcacgttcatcgactgccccgcgccacagcagtacacctgctccaaggagatcctcttccacccctttaagaagtggat

SEQ ID NO: 242 - DNA, 187 bp, Zea mays
  Clone ID: LIB3179-002-P1-K2-F11
cattcccatcccgagacaggagagggcaaggatgctgctcctgagctcccccttcgtgtgcgtgtcgccgccggcggcggcgctcagctcccatggcgctcgcccggcgctgcggatcgaggcggccaggcagctgacggggcgggtggtgacgaccaaggcggacaagacggtcggggtggaggtg

SEQ ID NO: 243 - DNA, 453 bp, Zea mays
  Clone ID: LIB3179-002-P1-K2-F2
ctgcatttcaaaataggcgtatctccctgcgcttttcctagccctttgtcatccaaggaaggaatggacaaccggcgcggttacaccgccgccaagaacaggagcaacaacaacaaggctcctcgcaacaatccattctcatccatggcgaagctcatgaacaagttggtcgattcgttcgagcacgacgagataccggacgtcggctgcgtgcgcgccgtgctggccgagctcgtcctcaccttcctcttcgtcttcaccggcgtctccgccgccatggccgccggatccgacgggaagcccggcgacgctatgccgatggcgactctggcggcggtggctatcgcgcacgcgctggccgctggcgttctggtgacggccgggttccacgttttcggcggccacctgaaccccgcggtgacggtgggtcttatggtgcgcgggcacatcacg

SEQ ID NO: 244 - DNA, 468 bp, Zea mays
  Clone ID: LIB3179-002-P1-K2-F3
aagcagctgttgcaaccggttccttcgaggagaacgtgagaaagaagcatgaggccccaggggctggtcgtcgcactggccgggctggccgtcctcgtagctctgccactgggcaaagcgcacgaggaggaggaggaggaagggcttgaactcgaagccagcaggaggcggtggccgtgctgcgaccagtgcggcatttgcaccaggtcgcagccgccgatatgcgagtgcagggacacgtcgacgaccggctgccacccggcttgcaaggcgtgcgccctgtccatctccgacggcctcttcgtgtgcaaggacaagatcgtcaacttctgcaagcgccgctgcacccgtcgtactgatgatgatgatgcgtgacttataatctaagtgggcaaataaccttgccaataaataatttccgttcggagctccatttgcatctttctcaagatgcagacgacagggttt

SEQ ID NO: 245 - DNA, 386 bp, Zea mays
  unsure (1)..(386): unsure at all n locations; Clone ID: LIB3179-002-P1-K2-F4
ggggtctgaatcattgtttttggcaacaaaattagcacacaaacttttattggcacgtccattgccatagctggtggtgctatgtactcttacattgaggctaagattgaagaggagaaaaggaaaaagagcgcatgactgctgtgaataatattatcgagaccttcctcggacacaacatcgtcgacaatcacgacctacttctatatcttgttttgttttcatcttgagtcagtcggtccattgtttgttcccagtctggtgattaaaagtctgcaaattctgtttgtggaattggcagcgatacaaatttggcttctttaagtaaatccggttgccggtnnaaaaaaaaaaaaatatattaaatattctaaaaaaaaaaatat

SEQ ID NO: 246 - DNA, 440 bp, Zea mays
  Clone ID: LIB3179-002-P1-K2-F5
gcagggcaagaaaactccgcaggccagtctgcgcgagttggatggccttcttcttggccctcgtgtccatcctcgtcttgcgtagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggtacggcgagatcttcaagacgcaccttctgggctgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactacca

SEQ ID NO: 247 - DNA, 463 bp, Zea mays
  Clone ID: LIB3179-002-P1-K2-F9
gcagcctccactgttgctgcgccttcaccttctcttccgctctgaaacccaaattccttgagtccggcgacgacccagtgggacgcgccccattgccggaccaggagggttggaggcggcggcagtgggcttcgtcaccggtaagaggaaggccaccgaggtagcccaagcgttctggagaaatattgttcagaaaggggatacggtggtcgatgccacatgcggccatgcgggaatgacaatgacacgctcgctctgcttaagatggtggctgacaaaacaggccgtggatgtgtttatgggatggacattcaagaatctgcgatagagaatacttcctcttttctgaaaatggccgtggatgatgaacatcatgtgtgggtttgaactatgaagcttttacctaattttctctgaagaatgaaatagaaaggagacaacttatgaattctgaattgacatt

SEQ ID NO: 248 - DNA, 435 bp, Zea mays
  Clone ID: LIB3179-002-P1-K2-G10
gcggagacagatggcggcacgagtcgtaggctgatgctgcagtcggcagactatttcctgccagctgggttcagaatgtggaagagcttcgtacgtcctatcccgcgtctgggcaaacgacgaaacggttcaggagagcctcggtgtccgcaaggggacaatcggagcgtggaaacgatgcaaccaggacatactttacaaccagaacgtccaaagtgtagtgccgtaccattcgaggctagccgcgaaagggtacagggcgctgatatacagcggcgatcacgatcgtatcgtacccttcgttggcacacaagcatggattaggtatctcaacttgaccgttgtagatgactggcgaccatggtatgttggtggccaaggttgccggattcacaaggtactcaggcaacctaacatatgcaactgtgaagggcg

SEQ ID NO: 249 - DNA, 489 bp, Zea mays
  unsure (1)..(489): unsure at all n locations; Clone ID: LIB3179-002-P1-K2-G11
ccagagggttataaaagacctcgcccttatgacatgtgaaccatcantcttatagagaatgacactgaagatggcagagcgaccaggtctccagacagtcaactgaatataaagcatgatttagttgtatacttataaatcatgttttcaaatagagtctattttattctttttttatttgtaatcttattacctttttattttattttattttatatatgttctatttttattttttttcttttattatttttttattaattttcttatattctttatcttatcatttttttattatttattctatatatattttattggtttttttgttcacattgtttttttaaatataatattttatattatatttctttatttatatatatatttcatttatttatttattttttttttctatttcatctattattcatttttatttcttttatatttatcttatttatattatctatatattatatttaatat

SEQ ID NO: 250 - DNA, 289 bp, Zea mays
  Clone ID: LIB3179-002-P1-K2-G7
cgtgttcagccctgaggtgcttgacctttcctaggaggacctgattgagaagtttgccacgggtgtctccatggttgcggcggtgtcactggcgatctcgtacccgacccttgctgctgtgccccacatgttcatcaatgggtacaagaatgtgcttgctgttgctgtcgagacagactactcgtacccacatgctgacaagatcaaggtgtacctcaaggacccaagcatgtttgctgttgccgccccggtttgctgctggtgactttgtcgctgcatttgcttttta

SEQ ID NO: 251 - DNA, 435 bp, Zea mays
  Clone ID: LIB3179-002-P1-K2-G8
ggaaatcaaagcaacaaagttgccggccgagagaagcaaccatgagacctcaggcgtcggtgctcgtcacactggctgggatcgtcgtcgtccctgcagctctgccactcagcaaagggacggaggaggaaggaggaggggaggcagtcgccgccgtggacgccgccggaacgagctcgtggccgtgctgcaacaagtgcggcttctgctacctgtctgacccgccgcagtgccaatgcctggacttctcgacggtcgggtgccacccagagtgcaagcggtgcatcaggtacaccgccgacggtggcgtggacatcccgcccgtgcacgcctaccgttgcgccgacatccttttcaacttctgcgagcgccgctgcagcacttctcgggtctctcgctgttgctagcaccaagtagacggttgcatattgcatg

SEQ ID NO: 252 - DNA, 423 bp, Zea mays
  Clone ID: LIB3179-002-P1-K2-G9
gcggcagcgaggcggaagcaaaggataggggatatgtcgaggccgcccaacaggagcgacgcgcacctctccgccgaggacgaggcggctctggaggccgaggtgcgggagtactacgacgacgcggcgccaaagcgccacaccaagccctcccgcagcgagcactccgccgcgtacgtcgacgcgctcgtcccggacgtcggcggcaactcccacccggagctggacaagttccaagagctggaagcccacaccgagaggttggtgtacgagggctccaatgtggtagatgagtttgtggtgacggagtactactaggtcctcggctgctttttctagcagtaccacacttatcggaactgtctttatcaagattgtcaaagttaaagtgttcctcttaaaacttgttttatgattccaatg

SEQ ID NO: 253 - DNA, 410 bp, Zea mays
  unsure (1)..(410): unsure at all n locations; Clone ID: LIB3179-002-P1-K2-H1
gcaagctccttcgcctcgaaccctctcgcgcttggcttgctttcactctccagggccccacgcccacctcgccgccgcagccatggcgatcacagcgccaactcccgacatcctcggcgagcgccagtccggccaggacgtccgcacgcagaacgtgatggcttgcggtgcggtggccaacatcgtcaaatcctcgctcggccccgttggtctcgacaagatgctagtggacgatattggtgatgttacaatcactaatgatggagcaaccatacttaagatgttggaagttgagcatccagccgccaaggttcttggtgagttggctgagctccaagatcgtgaggtaggagatggaactacttccgttgtcatcatagcnggcagagtactcaagagaggcaatgatc

SEQ ID NO: 254 - DNA, 162 bp, Zea mays
  unsure (1)..(162): unsure at all n locations; Clone ID: LIB3179-002-P1-K2-H2
ccggncggaanacccgggaaagacattattactgcttgacaatgtagtatgatgtgcatattaatcactacatagataactattcatatttaggattaaaatctaagatgaccactaatattgcttcaaaaagagcagcttttgtgaggccattcacttctc

SEQ ID NO: 255 - DNA, 410 bp, Zea mays
  Clone ID: LIB3179-002-P1-K2-H3
acgcttcctgcaggatggcactcctccttggcttgctgctgctagtagtagcttcgcccgcgagcgctgatgacgactccggtatgtactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagact

SEQ ID NO: 256 - DNA, 152 bp, Zea mays
  Clone ID: LIB3179-002-P1-K2-H4
ccgggcagacacagtgtcactgcatgacactctatcctgtttcgcctatttttcatcttcacacacagctcttcctctttcgggtggagaatctaacatgagcgcggaggtttcttcaaaacgagcacctttcgtgaggccattcacttctc

SEQ ID NO: 257 - DNA, 374 bp, Zea mays
  Clone ID: LIB3179-002-P1-K2-H5
gccctcgccgcctcctctcccgttcccccaccaaccgcagcagcgagagcgagactgagaatggccgcggcgccgtcgtccctcgtgtcctcccatctctctcgcctcgccgacctccgccgcgcggcggcgccggccactcccaccgtcccacagcagcttcgcgtcggctgctcgcgccgccgcgcccagcgcgtcgtcgccatggctggatccggcaagttcttcgtcggaggcaactggaagtgcaacggaacaaaggactccgttagcaagcttgtctctgaactgaatgctgctaccctcgaaactgatgtagatgttgtggtggctcctccattcatctatatcgatcaggtcaagaattcacttac

SEQ ID NO: 258 - DNA, 200 bp, Zea mays
  unsure (1)..(200): unsure at all n locations; Clone ID: LIB3179-002-P1-K2-H8
acgctcannagttttgttctcctcttcctagtctagcctagcacctnngcagatctgctcgttgccgttgggcgtacttgatattatggggaggcggagagcggatggcttcnngcagcggcngcccgnttggtttcccttggcatgccctgctcnnctggtggtngnngcggcgctaaccctgtctcatgnngtgatgg

SEQ ID NO: 259 - DNA, 290 bp, Zea mays
  Clone ID: LIB3179-002-P2-K1-A1
tcgcccacacccttccgtttaaaccgggaccccctgttctccaggatccaagcttagttggccttctacccaaccgagaggctttttatggacctaggggacatggacccaggtgccctcaagggtaaagcctattacatgtaaaaaccctcagggttcctatttttgtgggttccccccaaaccctgattgcccccttttgctttttaccaaaaaggcctgcacatggggccgtccctttcaatccagcaggttgcccgaggaccgggacccgccccagttggtgcttt

SEQ ID NO: 260 - DNA, 448 bp, Zea mays
  unsure (1)..(448): unsure at all n locations; Clone ID: LIB3179-002-P2-K1-A10
gggncggatttccggggcggccccgccgtccgcgaggctaattcgggtggcggcagagggtttcaccaaggttatggctccagaggagggtcctgagcaggattggcagatgcatcctttacggttcaataatcctggagagggggttccgcaatatagccatccggttaaaaatctaattaataagccaggaaaatttgaccttttccccttggagaaagtcaaggtggggagaagtaccacccagcctccaggttccaccaaaaagggtcctgtaaaggctaacactatcgacttccatcctttttggcaaagaccagaagtggtggtgcttattgttgtcccagattttgatagtaccctggattaccatcagtctgttaataccatgagcaaggttccagtggttgaccagtcaacggttgggcaggcttccccaggccctttt

SEQ ID NO: 261 - DNA, 269 bp, Zea mays
  Clone ID: LIB3179-002-P2-K1-A11
acccgtccgttggttttagatcgggggcggccgtttttttttttccaggcttacgtccccttgcttgcgaggtaatagttttcttatggggcaacctaaattaaattaactggccgtggttttacaccgtcgggcctggaaaacccctggcgttccccaacttattggcttggcagaacatccccttttcgccggttggcttattagcgaaagggcccgaaccgttcgcccttccaaccagttgcccagcctgattggcaattgggacc

SEQ ID NO: 262 - DNA, 418 bp, Zea mays
  Clone ID: LIB3179-002-P2-K1-A2
cgggccgggatttccgggcctacaactccagggaaataagccatgagggcgtggtcggcaaagccagccaccggcggaaggacttcttggccggagggggtcggcctgaccgtcaaggaagccaaaaaggtgtttttggcggccaggccgaacgccgccttcggggtgctgccaacaaccacccaggcggggccctccgactttgggttcgaccgtgtccggtttttcgtgggacccgtcgcccaaacccccaatgtgggttgggctggagcctaagcctagaggtggtgggaaccgccggccttgaccacctgttttttgtaactcctggtattaaggtttaaataccaggggggaggcttgctaatcctgggaatcgtgccgctggtgggactactactgggctacttgaaacgaa

SEQ ID NO: 263 - DNA, 473 bp, Zea mays
  Clone ID: LIB3179-002-P2-K1-A3
gatttccgggtcggccccacccgtccgcgtttggccggggaagttgggggcgatggatatttgcaaaggccattgtgggaatggctgaatcagctggttggatttagcaccgttgaggggttaaaggggttggctgcaccaaatcgggctgtttttctggaccctgctttgatgagacctggtcgcttggcccgtaggatggagttccctaatccatcaaaggaggcaggggctggattcctgcaaatccactcggggaaattgattgtgattccagatgtcaactttgaagagtgggcccgtccaaccgatgtattaatgggccctcagttaagggctgtttgcgtaaaggctgccttgctcgttttacgccaggatgctccagaggttacccacgaggttttcaccggggggttcatccaagtgcaggcaaagaggaagtccagtttgatttactacccgtaaggggggga

SEQ ID NO: 264 - DNA, 462 bp, Zea mays
  Clone ID: LIB3179-002-P2-K1-A5
aaccgaactttaccccttttttggggttgaaggattcaacctcggtttttataaattttggaaaccggttccttttaaaaaaaaaaaaaaaaaaaaaaaaaaaagggggcggccgttttaaaggaccaaagttaactaccccgtgcatgcaacgtaatagtttttttatagggcaacctaaatcaaatcaactggccgcggtttaaaaacgtcggaactggaaaaaccctggctttaccaaactaaatcgctttgaagaaaatccccttttggcaagttggcgtaataccaaaaaggcccgaaccaatcgcctttccaaacagttgcccaccctaaatggcaaatggaaccccccctgtaccggcccataaagcccgggggttgtggtggttacccccagggtgaccgttaaattggcaagggcctatacgcccgttcctttggttttcttcccttcctttt

SEQ ID NO: 265 - DNA, 124 bp, Zea mays
  Clone ID: LIB3179-002-P2-K1-A6
tggccccaggcttccgcccacccttccggttttggaccgggggcggccgttttggaggacccaggcttacgtccgcgggctggcgacgtattagtttttttatggggcaacctaaatcaaatta

SEQ ID NO: 266 - DNA, 468 bp, Zea mays
  Clone ID: LIB3179-002-P2-K1-A7
aaaaaaaaacccctttccccaaagatttttttttttttaaaaaaaaaaaaaaaaaaaaagggataatatttaaattaaagaagggataaacaaattaactactataaaggtaaaaaaaatataataaaagggggggccctttttaaaattccattgtttctccccccctctttcaaaactttaattttttttttttggaccctaaattaaaatcccctcccccttttttaacaatttcgtgccgggaaaaccccgggcctccccaattttatccccttttaacaattcccctttttctccttttgggaaaaatgaaaaaggccccccccaatcccctttttaaaaatttgccccccttggatgctcaatgggccccccccttgtcgggaacattaaacccggggggggggggttttaccgcacacaagtccccttcactttccaagcccctttacccttttttttttt

SEQ ID NO: 267 - DNA, 261 bp, Zea mays
  Clone ID: LIB3179-002-P2-K1-B1
actggttttggatcgcgggcggccgttttggtggttccaggcttacttccgcttgcttgcgacgtattagtttttttttggggcaacctaaattaaattaactggccgcggttttccaccgtcgggcctgggaaacccctggcgttccccaacttattggcttggcagaacatccccttttggccggttggcgtattaccgaaagggcccgaaccgttggcctttccaaacagttgcccagcctgattggcaattgggccc

SEQ ID NO: 268 - DNA, 447 bp, Zea mays
  Clone ID: LIB3179-002-P2-K1-B10
aattccgggtcggcaccacacccttccgaagaattgcaccaggcaggattaacctgccctctgataatatggtaaacgggtccggcggttggggacaccttgacctcaacggattgcggcggcggcggcggcggccccaaaacttctgggcctgaggtggtcggcctgaccttgaaggaccccaagaaggtgatcctaagggccaggccggcccccgccttctggtggctgcccgtcggttccgggtggaccggggttaatggccttaaccgggtccgatttttggtggacatgttcgcccaaacccccaaaatgggttgttaatttataagctggccgttttttcctttccttgcccaagaactggaattaattttttttccgttgaattaccgcggccttgccgattaagggatgggggaattctaactaattaagtaatgctta

SEQ ID NO: 269 - DNA, 424 bp, Zea mays
  Clone ID: LIB3179-002-P2-K1-B3
gtttttggggggcccagaggcgtaaaacagttgttttttttccaggcgaccactgggggtccttaatactgaacattttaacgttaatgggtttggttttaaccttaaaaccgtttttggttgggggcagggccaagcactgaaccatggttgaagcggccgacgccccatgggtttcctatccaggggcaatcgattttagattttttgggggcggggccaagggcggtgccaggcctgtcccagtccgacgcctaaggccagaccacacggggtttggtttggtccacagaagggccgggtggtggctgaaggtttggaaattccggttccctttttttgggtttcgaagaatgcagttgcgtgttttgatggaggaccactttgttactgggcttgtggggcggtttcaacgcgtgtaagt

SEQ ID NO: 270 - DNA, 259 bp, Zea mays
  Clone ID: LIB3179-002-P2-K1-B6
gttttggatcgcgggcggccgttttggaggttcttggcttacgtccgcttgcttgcaacgtattagtttttttttggggcaacctaattcaaattaactggccgcggttttccaccgtctggcctgggaaacccctggcgttcccaaacttattggcttggcagaacatccccttttggccggttggcgtattaccaaaagggcccgaaccgttcgcccttccaaccagtggcccagcctgattggcaatggggccccc

SEQ ID NO: 271 - DNA, 95 bp, Zea mays
  Clone ID: LIB3179-002-P2-K1-B7
gttttggatcgggggcggccgttttttttttccaagcttacttccccttgcttgcgaggggttagtttttttttggggcaacctaattcaaatta

SEQ ID NO: 272 - DNA, 234 bp, Zea mays
  Clone ID: LIB3179-002-P2-K1-B8
ttctagaggatcacaggcttacttccgcgggcttgcgacgtttttttttttttatggggcaacctaaatcaaatgaactggccgtggttttacaaggccgtgcctggaaaaaccctggggttcccaaacttaatggcctggcagaacatccccttttggccggttggcgtattagcaaaagggccggaaccgatggcctttccaaccagtggcccagcctgattggcaatgggg

SEQ ID NO: 273 - DNA, 432 bp, Zea mays
  Clone ID: LIB3179-002-P2-K1-B9
acgaattgctagcgaccaacgtcaacattattctaacaacaacaacaaaccagaagcggaacaacgcaccaagggaaaagggatggcttcgttaaccatgatggcgtccttggccgccgggggggtggccggcccttcgggccggggaaccttcgccggggtaaggtccgccagggtcgaccgttgccagaagcccgccacgttggcagtaaccgaggccaggcccgccgcctacggacgccgggccgtattgctcgcggttgttgcggcggccttggaagccatggggggtgccggggccgccatggtgggcccaatgaacgggacccccgaggcgaaaaaaaataccgcggccttttggtgaaccttgccaaccgccatggtttgccacatcttgacacgcccgctttgattgcatttgcagggccgggg

SEQ ID NO: 274 - DNA, 398 bp, Zea mays
  Clone ID: LIB3179-002-P2-K1-C1
gggctccaatccggtccggcccttggttttttctgtttcggccggaccccgggcgccggggacaagaagccatgtgtggctccaacttttcaaccgcctggtcttcttgggggttggcaagaagggcttcaacaaccggtgggggttccccccggggctggggtttccgggggcggggttccttccgggggctcggaaccggaatggactcggtagggaacacgcaaaaaataacggaggccatgaagctgggggccgccgccaaggtccggcccgcgcaggaggccgtcgtttcttttggccttttttgggaggcgctggggggggggctttacaccatgaaccaggagatccagacgggggacatggacctgcccttaaccggaaccggcccggta

SEQ ID NO: 275 - DNA, 424 bp, Zea mays
  Clone ID: LIB3179-002-P2-K1-C10
ccgaatttccgggttggaccaacccttccgttttttaaccttaaagtaatacctgccgtcttacacgccaaaggggctggaggacctgaggaagaaggacctgcaggccctgcccggcaacggcaacggcaggcgcagggggttcaagcgcgtttacaactccaacttgtccaacaacctgggcaacccggccaggaacccggccaacaagcggcccgtgctgggcggaaccaagcagtaccaatacccgggccgttgcctaaccggccgcccaaggaccaaaaaggaccccaggccggaaatccccaagggcaacaactccttgcccggggacaggcagttttggaaggtgaagcagttaacgttcggggccacaacgttgcgttccggcctgaacgcgctgttgccggcgctccgcccgttg

SEQ ID NO: 276 - DNA, 341 bp, Zea mays
  Clone ID: LIB3179-002-P2-K1-C11
gccttaatcgcaacctttttttaaaaccctttaggcaaagcaagccgaacgggcccgaacggaatttgggacttggggtgggcctcctgcttggcctggccggtgggggcaacgctttgccgcccgggggggccaaggtgccagtgggcttgctgggcggccaacgccggcggaggcaccggcccggcttgggctaagggcccgggccgctctagttgcggggtgctgccggttggtcccgctgggtccggttcaaatccgttaattgccgtaggcaagagttggcctcaattttaaacggagccaaacggatgctagctgccattcgtggggaccaaatt

SEQ ID NO: 277 - DNA, 100 bp, Zea mays
  Clone ID: LIB3179-002-P2-K1-C2
attggttttggttggggggcggccgtttttgtttttccaggtttacgtccgcttgcttgcgaggtaatagtttttttttggggcaacctaaattaaatta

SEQ ID NO: 278 - DNA, 274 bp, Zea mays
  Clone ID: LIB3179-002-P2-K1-C3
gcccgcccggaggcgtggaacctgaacgctgttgttgggggcagccgccaagcctttttggggcggaaggcacaaaacaaccacccgatggccctgttgttgttgggcggttgccccgggccgccggccgtcaacgcggccccgggggggtccgggttgttccttccggggctgccggggggggggttgggggccgccgccttttgggcctcttcggggccgtccggcaggggggcgtctgtcgtccaaggacggccggggttacggaaccggg

SEQ ID NO: 279 - DNA, 291 bp, Zea mays
  Clone ID: LIB3179-002-P2-K1-C4
aggacaactggtttaatggatcctcgaatttttttttttctttggcacaacagggccagggaggttttgcaactgaggaccaggctgtgcttgctgttaaggctccaagcccggaaagaggtaccctgacctggaggggacgggccccgccggccaggcaacggaggtcctagcattgtccccgaataggaaggccagccccgatttcttcaaggccgccatggattttttgcgggcctccaatccttgcggttgtggaggcagctgcaaaggcggcccccacagctgttg

SEQ ID NO: 280 - DNA, 344 bp, Zea mays
  Clone ID: LIB3179-002-P2-K1-C6
gtggccccacccttccggcaggggaaccatccaaatggctgagaaaatggtccaccgggggccactaaggccgtgttgggttggcaattcaagtggtcccggcttgagctgttcctgcatgaggccgtccgttgtttttttgggagtgacccggggctgcttaatggcccttttaccgagcactccttggagtttctgatgtcggccgacccaaatctttgttgtaacccaaccaattttattaggtccggttttaggaccggttgattccggggaccgttgtccggcaaaccaaccacgtggtaaataaaatcgttggatccaagagtttgctgaacctaact

SEQ ID NO: 281 - DNA, 396 bp, Zea mays
  Clone ID: LIB3179-002-P2-K1-C7
attaagcgggcggaaaaaaaaaaaaaaaaatgttttttttaaaaaaaaaaaaaaaaaaaaaaaaaaggggaaaaaataaaaaaaaaaaaaaggggggggccgttttaaagaaccaaagttaccttcccctgcctggcaaggaaaaagttttttattggggcacccaaaattaaattaacggcccgggttttaaaaccgtgtggacgggaaaaccccggggttacccaaattaaatggcttggaagaaaatccccttttggcaagtggggtaaaaaccaaaaaggcccgaaccaatcgcctttccaaaaattggcccaccctaaagtggcaatgggacccccccctttacggcccctttaagcccggggggggggggggttcccccaagggtaccct

SEQ ID NO: 282 - DNA, 427 bp, Zea mays
  Clone ID: LIB3179-002-P2-K1-C9
aagttggccttttggtttacaccttaatattaaaactggagtcgtcggcggaaccagggggtccttccttaaaggttgaagagcaggaccaccattttgtgggggatcctagttttcaaggcccttttgttttttggggttggggccaaaggacctgcagggccaaaaaaccattgctgttccggcaagtgcacaacttggtcggccttttggacctgcaacaacctcttaacaaagtgcgccgccacctgaaaaaactggttccccgtgtccacgggcaagggcgccaccaattccaggtgccgggatttcttccccgaaaactggggttgcaggatccactaaactaatccatttccaccatggccacagaagccgatggatcctttttccatatgcagtgtttcctccgtccgtccgcttagtt

SEQ ID NO: 283 - DNA, 409 bp, Zea mays
  Clone ID: LIB3179-002-P2-K1-D1
acccttccgaacaacctaagggcgggcccggaacaccggtacaccgtcccggcctaaacacttgaaaaagggaaaaccaccccaccggcttggccaccattcccgtattccttgcaacaatcctcgtcgccgttctcctggccgttggtagacctgcttgtttgggggccaccgcaaccgacaccaacaccgacggggccattcgtttcccaagaagttttgttcctgttggccaaccggggaagtgctgtaactatgtaaccaaggagccgttattaaggccgccccgttggccctgaaccaccttgttgaccaagtgctccgccaactgccaaaagtgcaagaagtccccggccggcaacggtttcttttgccgggactggatcttaagcctgttcaagcccccggt

SEQ ID NO: 284 - DNA, 374 bp, Zea mays
  Clone ID: LIB3179-002-P2-K1-D10
aaagcccgccttaacaatcccggtaatggttatggcccgaatgggcaacttgttgaaggccaaaatcctgaaggccctgggcgtcaactacttggacaaaagcaaggtgttaaccccggccgacaacccgaacaaaataaacaagaacaacttccggttccctttggtttgcggttgccggaacctcggcaaggccctcccaaggttgcccaagggcccccccataatccgaacaaagggggaggccggaacgggcaacttcttcaaggccgtccgcaacttgcgctccgtaatgggcaacttccggccgctccgaatattggacaacaacaaggtttttgcttacgcaaagcgcatggccgggccctacaacc

SEQ ID NO: 285 - DNA, 477 bp, Zea mays
  Clone ID: LIB3179-002-P2-K1-D2
tccgggttggacccacccttccgaaacgccgccctttttggtttggacctttcttttccggttaaccttagaagcggaacccggccgacggcaaccagtaaagggctggtccccccaccgccaaagggattaaggggtttacccgtcctccgccacaggcccgggggcttcctgaaaataattatgggttggtggcaaaaggtttacggaggcaactttgaccaattctgggggtcctgaatctgaatggctgtaactggaccagctggttgaagttttgggaaggttaaaaactaacaccgaaccatttttgattttgcaaaagggcttaaaaggggaggattttgaagggcttttcctaagccttgatgagtcgaccaaaaccaagtttgatgaactggtaaagaaggagtaggctttaaaagaaaaaaaagctgaaccttttggtttgtttgcaaaaaaagaggctaaagtttt

SEQ ID NO: 286 - DNA, 489 bp, Zea mays
  Clone ID: LIB3179-002-P2-K1-D3
ccgggcctggattaccgggtcggccccacccttccggccggagaaaaaaaactgaagccgcggggttattcttaagccgccgggacgggaccagaaaaggatggccgacggaagggcttccgcttaaccgctttcggtttttccgaaccagtccaaccgggacgccttaaagtcctaagggcgcattccagttgttaatagggggggggaccatgctttggcattagggagggaaggaagggaggcctggatgcgtgcaaggggggtttgccaggctcctttttttggcagggttgaggctgcaccaaaagagggggccatggttgtggttgaggagaaggcaaatctggagactggaacgactaaggctgtggaggagctgaaatctgtttttgaaagccagggaaaaggggcccagaataggaggacagaagggcttcgggctttaaggcgttggtggtcccagtctgaagtacctccagttgatgc

SEQ ID NO: 287 - DNA, 397 bp, Zea mays
  Clone ID: LIB3179-002-P2-K1-D5
cccttccggcaaagaaaaaaaaattggacgcggcggggttatttttaaccccccggacggggaccaaaaaaggtggcccacgggaattccttccccttaaccgctttcgtgttttcggaccaattcccaccggacccccttaaatccctaagggcccattacagtggttattagggggagggaccttgcttttgcattgggaaaggaaagaggggaagccttgtaccgtgcaaagcgtgtttgccgagctcctcttcttggcattgatgaggctgcaccataaaaggggaccatggttgttgatgaggagaaagcaaatctggagactagaccgactaaggctgttgaggagctgaaatttgctttgtcaagccagggaaaaggtgcccagattagg

SEQ ID NO: 288 - DNA, 449 bp, Zea mays
  Clone ID: LIB3179-002-P2-K1-D6
gatttccgggcctttagtttttagaattggaaaactgggcccccttctttttaaattccccgggccgtcctgttggccggtttttggttggcccttgattccgcccagggggggggacctaagggaatggattggtcaatccaagggaaggcaaccagactccaggagggggttaaaggccggggttttaaccggggaaatgttggccatggtggggctttcaaaacaagaagcccggaaaaagccaaaaagccttcccgttccgggatcccaattggtcctggggccggggcaagggccggaacggggggggccgaacaaggtggacctgggggacctcttaaggggggccgggccgttcaaaacgttcctggattacctgcagaagaccggggtaatgaaaaccttccaaagccaggcgaacgacacgaagcggggcggattaaccg

SEQ ID NO: 289 - DNA, 438 bp, Zea mays
  Clone ID: LIB3179-002-P2-K1-D7
cggttccggatttccgcggtgcggccccaccctccctataaaactggggcggccgccccaaatttttttagcctaagttcccttccctgcgagggggaagttttttattattgtgggcgaaacccaattcacgggccggggttttccatctacaagcctgggaaaaccttatccttccccaaccaaaactcttggcagtacatccccattccccctgttgccgtaattgtaaaaaggccgggcccgttcccctttcccaacagtatccaatcctaattggtaatgggaactggccctgtcccggtcctttaaccccaagggctgtggtggtaacccctaccgtaccctttccatttgcaatggccttatccccggttcctttactttatttcctttacttttccgcacattcacccgttttcccctttaaagtttaaa

SEQ ID NO: 290 - DNA, 123 bp, Zea mays
  Clone ID: LIB3179-002-P2-K1-D8
gttttggatcgcggccggccgttttagaggttccaggcttccgtccccttgcttgcgacgtattagtttttttttggggcaacctaaatcaaattaacgggccgcggtttaccaccgtctggc

SEQ ID NO: 291 - DNA, 75 bp, Zea mays
  Clone ID: LIB3179-002-P2-K1-E12
ttttagaggttccaagcttacgtccgcgtgcttgcgacgtattagttctcttatggggcaacctaatataatata

SEQ ID NO: 292 - DNA, 405 bp, Zea mays
  Clone ID: LIB3179-002-P2-K1-E2
gtcggacgggccttccgttaacctattaaccaattttgaaccctgtttttttcctaaagagatcccactccctaaggagtttatttggattggcgacctttgggttaaactttatccaagtttggccgaaggagcacccctttttttaacctggattgggcccaattttgcggaatttttaagttttgggggaggactagatccaatacccggtggtttatggtggaccatttttgcccaccataattaacctatggcttttcttttccggaccgctggtcatatgtttaggaccaattggggtttgggtaatggcctaaaagatatttgggaggctaataagggcccattaacaggccagggccttaaaggtttttatgaaaccctaacaccgtaatggaatgc

SEQ ID NO: 293 - DNA, 392 bp, Zea mays
  Clone ID: LIB3179-002-P2-K1-E3
cacccttccgaacccaactggttaattggttcctggaaattttttacctcctttggaaccacaaggacaaggaggtttttcaactgcggataaggctcaacttgcggttaaggctcaaaggccggaaagaggtaccctgacctggaggaaactggcaccgccggccaggcaacggtggtcctaggtttggccccgaatagtgaaggccagccccgatttctttatggcctcgaaggattcctgccaggcctccaattcttgcggttggggtggcagctgcaagtgcgccccccgcacctgttgtccacatgaatcgacgccctgggatatgataattacttatctagctggggggggaggtggaccattaatagggggggccgggctggctg

SEQ ID NO: 294 - DNA, 144 bp, Zea mays
  Clone ID: LIB3179-002-P2-K1-E4
tatggggccccccccttaaccggccctttaagcccggcggttggggtgtgtccccccagggtgcccgttacccttgccatgcccctagcccccgttcttttggtttttttcccttcctttttggcaccgttggccggttttccc

SEQ ID NO: 295 - DNA, 387 bp, Zea mays
  Clone ID: LIB3179-002-P2-K1-E6
gaaccaaaaagggaccccgtttcaatggagttgttggccggcttgtccttaaggccgtcgccggggccggcccgaatccggactaccttgcaacccgtggacgtaggcggacgcttctttttccgccggttcggggggcgccagccgccaaggccccccctgttcttggaggcccggggcggaaggggctgttcgaagcggaaaatgcagaagaagccccggccgccgttgttgccgaaaatggaggacaacggcaacccgggattggtaattttaatccgaaccgccaatgtttacttttggtacccgttaaacataataacgggcggtacaacgggaaaaataatgttggctgcaaaggacaactttttgggagggtacatttac

SEQ ID NO: 296 - DNA, 485 bp, Zea mays
  Clone ID: LIB3179-002-P2-K1-E7
ccgggtccggatttccggggtggcccacacccgtccgaaaaaaaaaaaaaaaaaaaaaaaaaaatttatataaaaaaaaaaaaaaaaaaaaaaaaaaggggaaaaaaaaaaaaaaaaaagaaaaaaaaaaaaaaaaaaaaaaaaaaaaaaaaaaaaaaaaaaaaaaaaaaaaaaggggggggcccttttaggggtaccaaggttacgtccccgggggtggcggcttaaaactttttttttggggcccccaattttaatttatgggccggttttttaaaaccgtttgggggggaaaaccctggggtcccccaaataaaatttctggaaaaaattccccctttacccggggggggtattaactaaaggggccctcctgtaccccctttcaaaaattgtccccccctttttgggtattgggcccccccctttttcggtcttttaaaggcggggggttgtgggttttcccccatatgtgcccctttttt

SEQ ID NO: 297 - DNA, 393 bp, Zea mays
  Clone ID: LIB3179-002-P2-K1-E8
ggggttaaatgttggcccttattggttaattcggttttgggacaaaccaattaaccggtcgggccttccttgcgcggggaaccaaccgggaacgggaacaagaacaacggccggccgggggccggtaaggttggaagggggggggaagaaaaagggactgggcaacagcccgcgatggccgccgtcttttgcttaaccggcgccggcggtttaatgggttgggggttggtaaggatcttcttggccgggggttccgcgttcgggggaacttccggccgggaagttgttgacccaaagaacgcgcacttgtggccgttcaacggcccgggggtacgcttaacaatgtctgaggtggacctgttggacggggcaagcttcggggcggctttcggg

SEQ ID NO: 298 - DNA, 364 bp, Zea mays
  Clone ID: LIB3179-002-P2-K1-F1
agccttccgggccaggtaagttccccggcaagggccgggctgctttggccacaatgaaccaccgattggggcccttcttgttggtcgaagccacactgttggcgcaggccggggcctgcccttacggccggacgccgaagccgcggccgcttccgccgccgtggtggtggtcaacgcggtgccttccccggccttattggcggtggcggtcaacgcggccggttaagtgcccggtgaccacgctaaagctgttcgggtgcgtggccgcgctaaacggcttggggcacgccgtaatgggaaccaaggccagcgacacttgttgccggttgttttccgggttggccgacctggacgccgggctttg

SEQ ID NO: 299 - DNA, 386 bp, Zea mays
  Clone ID: LIB3179-002-P2-K1-F10
gcccaagaaccaccgggcggagcagttggttaccgccgggaggaaggccggcccctgttccggcctaagggggaaagactacttgaggactgccctttctttccgtggccggttcaaccaactcgttggcttaaaagccaagggtttggggccggacttggggctttacggcctaaaggggaccaccagggtcttaaagggcggattaaacgcgacgccggtgatccatggcagaaggggccctttcgccaggtccttgctgttccagttttacttttgggcgggggggaacggaccgttaatggactgcccggggccgaagaagtccacctgttccagggggatccttttcaaccccttaaagaaggggttgcttaagcagcagt

SEQ ID NO: 300 - DNA, 186 bp, Zea mays
  Clone ID: LIB3179-002-P2-K1-F11
aattccaatccgaggcacaggagaggccatgtatgctgttccggagctcccccttcgggtccgggtggccgccgccgccgcggttaagttccaatggggctggcccggggctgcggatcggggcggccagccagttgacggggcggttggtgccaacacaaggcggccaagacggccgggggggag

SEQ ID NO: 301 - DNA, 295 bp, Zea mays
  Clone ID: LIB3179-002-P2-K1-F2
ttgattttaaaattaggcgtttttccctgcgtttttcttagcctttggcattccagggaaccattaaacacccggggtttttccacccccgccaggaccgggggcaccaccaccagggttcttggaaccattcaattttaatccatggcgaagttaatgaccaggtgggcggtttggttggggcacgacaggttaccggccgtcggtgtgttgcgcgccgggctggccaagttggtcctaaccttctttttggttttaacgggcgtttccgccgccatggccgccggttccgacg

SEQ ID NO: 302 - DNA, 359 bp, Zea mays
  Clone ID: LIB3179-002-P2-K1-F3
acccttccaaggaagtggtggaacccggtcctttcgaggttaccgggaaaaagaagcatgaggcccaaggggctgttggtcgaactggccgttttcgccgtcctggaagttttgccactggccaaagcccacaagggggaggaggaggaaggcctggaactcaaacccagcaggaggcggtggccgtcctgcaaccagtgcggatttggaacaaggtcgaagccgccgttttgcaagggcagggccacttgaacaaccggttgcaacccggttggaaaggcttgcgccttgtcaatttccaacggccttttgtggggcagggccaagaccgtaaacttttgaaagcgccgttgaacccg

SEQ ID NO: 303 - DNA, 380 bp, Zea mays
  Clone ID: LIB3179-002-P2-K1-F4
cggatttccggggggttcctaaaccatggttttgggcaccaaaattggcccccaaccggtattttgtccgtccatggccatagcgggggtggctgggtcctctaccattagggttaggatggaaggggggaaagggaaaaggggcgcttgcctgtggggaatattatattggggccctccttgggccccaccattgtggccattaacgccctactttattatctggtttggttttaatctggggccagccggtccattgtttgtccccagtttggtgttaaaaagtccgcaaatcctgttggtggattgggcggcgttccaaatttggtttttttaagtaaacccggttgccggtattttaatttcttcgtttacttttt

SEQ ID NO: 304 - DNA, 290 bp, Zea mays
  Clone ID: LIB3179-002-P2-K1-F7
cgggtccggatttccggggtggccccagccttccggttttggatggcaggcggccgttttagaggttccaggcttacgtcccctggcttgcgacgtattagtttttttatggggcaacctaaattaaattaactggccgtggtttaccaccgtcgggactgggaaacccttggcgttcccaaacttattggcttggcagaacatccccttttggccggttggcgtattagcaaaagggccggaacggttggcctttccaaacagttgcccagcctgattggcaattgggc

SEQ ID NO: 305 - DNA, 415 bp, Zea mays
  Clone ID: LIB3179-002-P2-K1-F9
gaagcctcaacggtggttgcgccttaacttctttttccgttctgaaaccaaaattccttaactccggcaacaaccaagttgcgacccgcccaatggccggaccagaagggttggaggcggcggcaggggccttcgtaaccggtaagaggaaggccaccggggtagccaaggcgtccgggaaaaatatggtcaaaaagggggatccgggggcggatgccacatgcggccatgcggaatggacattgacacgctggttctgttaaagaggggggctgccaaaacaggccggggttgtgtttatgggagggccatcaaagattctgcgatggaaaatactcccttttttttgaaaatggccggggatgatgaacataaggggtggtttggaactataaagctttaacctaatttcccc

SEQ ID NO: 306 - DNA, 204 bp, Zea mays
  Clone ID: LIB3179-002-P2-K1-G10
ggcaacactttttccggccggctgggttcaaatgtagaagggcttcgaacgtccatatcccgggtttgggcaaacgacaaaccggtttaggggggccttggggtccgcaaggggccaattggggcgtggaaacgttgcaaccggggctttcttttcaaccagaacgtccaaagggtgttgccgtaccatttcggggttgccccg

SEQ ID NO: 307 - DNA, 330 bp, Zea mays
  Clone ID: LIB3179-002-P2-K1-G2
aaattcaagacgaaaccaaaattcccaacctttcgcaacctaaaatttcccaatccttcttggatcaagcccgggggggaaaagccatggccgtttccgaaaccaacgacgcccccttggtggccggcaaccagccaacggaggaggaggtgccggtggaaaggcccgcgccaccggaggaccaggagggggagaggttgcgttccctgaggttcgggcagaaggcggcggcccaggccctgttgctggcggccgttttagaggatccaggtttacttccgcgtgcttgcaacgtaatagtttttttatggggcaacctaaatcaaatta

SEQ ID NO: 308 - DNA, 455 bp, Zea mays
  Clone ID: LIB3179-002-P2-K1-G3
aatttggaattattgcgtgggccgaccgccggaattggaccccgcccttgttggtttaacattccactgcctggttccactgggttccatccgccctttatccagctaagggattttctctttttcccatccataataatcctattaatccggccctccatccctggaccgagataggggccataggaggccactctttaaatggaaaaaagggggtattcagctgggccacgaaaaaaaccgaatcctttggtggctggtaatttatggccaaaaatcgaaagggccattttgaagggggggaaggaattattggtaccgtgtccccggccttttagcattttacccgcaatggtgggccatccaatcgcgattcatatgggaaaggaccatatccctattaacataccaaatcctatggtgggccgcaaatggggggaatcggggcctactcg

SEQ ID NO: 309 - DNA, 131 bp, Zea mays
  Clone ID: LIB3179-002-P2-K1-G4
aaacccgctttgtcaatcaaaatgcccgggtttaattttgagggggtcggaaacggttccacaagggggattggaaggtccatctaaaaccccgccgaagggttggccacctttccttccttgtttccatt

SEQ ID NO: 310 - DNA, 120 bp, Zea mays
  Clone ID: LIB3179-002-P2-K1-G5
gggggggcccaccccgtcgtttggttttggatcgtggccggccgttctggtgtgttccaggctaccttccgcttgcttgcaaggtcatagtttttttatgggggaacctaatttaaatca

SEQ ID NO: 311 - DNA, 478 bp, Zea mays
  Clone ID: LIB3179-002-P2-K1-G7
ccggttccggatttccgggttggaccacacccttccggttgttaagccctgaggggctggacctttcttaggaggacctgatggaaaggttggcaacgggtgtttcaatggtggcctccttgcaactggcaatctgttacccgaccttggttgttgggcccaacatgttaataatggggtccaagaatgtgctggttgttgttgccaagacagactactcgtcccaacatgctgccaggaccaaggggtccctaagggcccaaagcaggtttgttgttgccgccccggttgttgttggggactctggcgctgaagttgttccaaaggaagaaaagaaggctgcggaccctgaaaaggagtcggccaaggaattgggtttaagccttttcaacaactagagctgttgttttcggaaaacggctgcaagttttggcttttttttttataattaacaagtactgtttcctttattttttag

SEQ ID NO: 312 - DNA, 438 bp, Zea mays
  Clone ID: LIB3179-002-P2-K1-G8
ggaaataaaagcaccaaagttgccggccttttgaggcacccttgaaacctaaggcgtggttcctggtaacactggctgtaatggtcgccgtccttgcagttttgccactaacaaaagggccggaggaggaaggaggaggggggccattccccgccgtggcccccgccgaaccaggttctgggccgtcctgaaccaggggcggtttttgttacctgtttaacccgccgaatggccaatgcctgaccttttggacggcgggtggccaccaatggtgcaggcggtgcttaaggaccaccgccaacggtgggtgtaccatccggcccttgcccccttaccgttgctccaccttttttttaaatttttgtaagggctgttgtaaaactcccgttcccttcgattttttgtcaccatatttccggttccttttccttgcattct

SEQ ID NO: 313 - DNA, 464 bp, Zea mays
  Clone ID: LIB3179-002-P2-K1-G9
acacccttccggcggaagcaaggcggaagcaaaggaaagggtttttgtcaaggccgccaaacaggagcaacgggaacttttccgccaaggacaaggcggccctgaaggccaaggtccggaagtcctacaacaccccggggcaaaagcgcaaaacaaagccttcccgaaggaggaactccgccgggaacgtaaacccgttggtcccgaacttcggctgaaactccaacccgaagctgaacaagtccaaagagctgaaagccaaaaccaagaggtggtggtacaagggcccaaagggggaaaataagttcgtggaaacggattcctacatggaccttgggggtattgtctagcaaaacaaaacaaccgaaccggtcttaataaaattgacaaaagttaaaggctcccccttaaaactgtttgaagatccaaatgcaaagaaccgacattgctttttagagggaaaa

SEQ ID NO: 314 - DNA, 377 bp, Zea mays
  Clone ID: LIB3179-002-P2-K1-H1
acccttcgggaaggttctttggcttggaaccttttggggtttggttggttttaattttcaagggcccaattccaacttggccgccgaagccatgggaataacagggccaactccggacatcttggggaggcgccagtccggccaggacgtccgaacgcagaacgtgttggctggcggggcggtggccaactatggaaattcctggttgggcccggttggtttggacaggatgctaggggacgatttggtggaggttccattcactatggttggagcacccatccttaagaggttggaggtggagcatccagccgccagggttctggtggggttggctgagctccaggaccggggggtaggagatggaactacttccg

SEQ ID NO: 315 - DNA, 82 bp, Zea mays
  Clone ID: LIB3179-002-P2-K1-H12
gcggccgttttagtggttccaagcttacgtccgcgtgcttgcgacgtaatagcttttttttggggcaacctaaattcaatta

SEQ ID NO: 316 - DNA, 145 bp, Zea mays
  Clone ID: LIB3179-002-P2-K1-H2
aaattaccttttttccggttggccatggtagttggtggggctttttaacccctccttggttacctttccatttttgggtttaaattctaggtggcccactattttggcttaaaaaggggcagttttggtggggccttcaactttt

SEQ ID NO: 317 - DNA, 425 bp, Zea mays
  Clone ID: LIB3179-002-P2-K1-H3
tttccggaaggagggaactcctcctgggttggttgttgttagtagaagcttcgcccgcaacggttgatgacaactccggtttttactaccagttggttttaatgtggccggaaccttactggaggcagacaagcgctgggggctgaaggccgacaaccgggttttggccgggccgcgacttttacataacgggcttaaccgtccttaacgcaacaaccgaccctgaattgacggattgcagaaccaaagttctttacaaccttaacctgattaccggattcaaaggcctgaataagtcctggagcaacataaggtgcccaagcaccaacgggcaaagcagttggaaaaacgcctggagaaaggccggcgcctgttccggcctaagcaagaaggactacttgaggactgccctttctttccgtagc

SEQ ID NO: 318 - DNA, 339 bp, Zea mays
  Clone ID: LIB3179-002-P2-K1-H5
gccttggccgcttcttttccggttccccctctatccgaagaagcaggggcaagactgaaattggccgcggggccttcttccttggggtcctccaatttttttggcttggccgacctccgccgggcgggggggccggccattccaaccgtccaaaagaagtttggggtgggttgttcgggccgccgggccaagggggtggtggccatggttggacccggcaggtttttcgtcggaggcaactggaagtgcaacggaccaaaggactccgttggcaagctggtctttgaactgaatgctgctaccctcgaaactgatgtaaatgttgggggggctcctcca

SEQ ID NO: 319 - DNA, 239 bp, Zea mays
  Clone ID: LIB3179-002-P2-K1-H7
ttttaaaggacccaagtttacttccccttgcttgcaacgtattagtttttttttggggcaacctaattcaattcaactgcccgcggtttaacaccgtctggcctggaaaacccctgcctttcccaaactaattggcttggaagaaattccccttttcgccagttggcttattaccaaaaaggcccgaaccgttggcctttccaaccatttgcccaccctgattggcaattggaaccccc

SEQ ID NO: 320 - DNA, 447 bp, Zea mays
  Clone ID: LIB3179-002-P2-K1-H8
ttcaggtttggttctcctttcctagctggcctgcacctgcaaatctgttcgtggcctggggctcctgatttgggggaccgaaccgatggctcgcaccggccccggggtttcctgcatgctgttccgggggggggcggcccacctgttaagggggatggccacccaaccagcggcggcggcggcggcggcggccaaccaacccggagctggcccccggctgttggggcaggtgaccggccactccagcacctgtaatggccgaactggcccaatttatggttggccgtgctgaacaactggctgctagctagctggctagctggggggagtctttccggccccgcaagcagccttggcataccaccctttttgcttagctaatgcatgtccagcattacccggtggctgggctcgtcgccgtctttttctgcggcggcggcgccgggg

SEQ ID NO: 321 - DNA, 160 bp, Zea mays
  Clone ID: LIB3179-019-P1-K1-A1
gaaaggccgagaagcgctttatccggccgtacgtagcgataagagtggtgcacccgtagcggcacggcatggcggccacggcgtactccgtggcgctcctcggcggcgcacgcctgccggccgccttcctccctcgacgcagcagcgtgtgccaccacca

SEQ ID NO: 322 - DNA, 177 bp, Zea mays
  Clone ID: LIB3179-019-P1-K1-A12
acccaggcgtccgaaaaaaaaaaaaaaaaaaaactaataaaaaaatttattatttaaataaaaaaaaaaaaaaaaagggggggtaaataaacgggccgggcggtttaaagaatcaaactttactaacgcgtgcatgcaaaataataacttttttatagtgcaacataaattaaatta

SEQ ID NO: 323 - DNA, 427 bp, Zea mays
  Clone ID: LIB3179-019-P1-K1-A6
gaaacattgtgtcagtttttgcggaatttgttttgatttccaagtatgccaaaaaaaggggtgggtgctcaaaaaaaaggaaggaaaaaaaaaaaaaaaaaaaaaaaaaaaaaaaaaaaaaaaaaaaaaaaaaaaaaaaaaaaaaaaaaaaaaaaaaaaaaaaaaaaataaaagggggcgtccgcttaaaagaaccaaaattaacttcacctacaatgcaacctaaaatttttataatagggccaccaaaaaaaaaataactggccggtttttaaaaaagcgaaaactggaaaacccctggctttacaaaaaaaaatcccctagaaaaaaaacccctttaagccactggggtaaaaaacaaaaaggccccaaacaacccccctcccaacaattttcccacccaaaaagcgaaaaggacccccccctt

SEQ ID NO: 324 - DNA, 215 bp, Zea mays
  Clone ID: LIB3179-019-P1-K1-A7
aaacggggccgacccacgcttccggaatgacaaaatcaacctcccctactttctttctttacaatcccccaccttccccggcggggatttcttaatataagggggtctcccattacacccaaaactacctcaaccaccgccacatcgccctcacttcttatacaacttaccatacttaccctaccttcttctttcttatccacactcacaactat

SEQ ID NO: 325 - DNA, 408 bp, Zea mays
  Clone ID: LIB3179-019-P1-K1-A9
ggaaacccggtccgccgcacgcgtccgggtccaccccaattatttcaccagattttttttttcatgcctcaggcaacaccaatgcggtgcggggctttaaaagtatgtctgctttcaaaatctctatccagattgaagaaccagttccaaagtggaaatggcgtgattacggccgactgcatcgaaggttatccactaatcaggttacagctaggaaagcatgtttttctaagtgcaggggatttttatctggctagtcgatcctaatttttgtgtgcagcatcccaattttgactgattcacccatcattttgccgcaatcggcttaaacagcttggttccatttatgcattcagattcacttgttaaaaaaataaaaaattttattttttctatatactttatttc

SEQ ID NO: 326 - DNA, 452 bp, Zea mays
  Clone ID: LIB3179-019-P1-K1-B12
cggacaaagaaaaatcaggcggtgcactttcttttctgggctccggctgcacggtgcacggtcgttcgtgggctggcggctcaactgcggctcccggccgtcggtgatggaggcagggcacagcgggcaggtgcagcaagctcggggcatcgtggtgcaggtgagggacgggaatctggagccggcgctgtcgatcatggagcgcaggatgcggtccagcggcacggagcgcctcatccgggcgcacacccttctcgacatcaaggactcggagaaccgtttgctcgcgcttaaggagcttatgcagcgtgtccgttcccaggagctcatgctccgcaagatcgtcatcaagcagatcagaaccatggaggaggataatgcacactggtgcgatgaaaatgttaagatagcttgtgaaaaatttgctgaggaagtatgagcaaagaacagat

SEQ ID NO: 327 - DNA, 151 bp, Zea mays
  Clone ID: LIB3179-019-P1-K1-B3
taaataaaaaacactgtccttatttttacaacttcttaactgttaaaacctttctctaacccaactaaatctcctatcatttttattcccttttcaccactttacataatatccaattattcccaaacctatcatcttttccaacattttt

SEQ ID NO: 328 - DNA, 456 bp, Zea mays
  Clone ID: LIB3179-019-P1-K1-B4
cggacgcgtggggaaagagccacgcattgtttttggcttgcacaagcccggaggagcgcgagacgcgttggcggacggaatgcggctgcccctgcctaagtcagtgaacattctgctgtgatggcgaaggagtactacactacgagcagccttgtggttgggtacgcgctgtgctcgagcctgctctcgatcataaacaagtacgccgtgacaaagttcggtttcccaggcctcctgaccgttctacagtactcgacatccgctgctggtgtctggatcctcgaaaagctaggcttcctcacacatgaccccttcaacctggagaccgcaaagaagttcgcgccggcggctctcgttttttacctagccatattcaccaacacgaacctcctttgccacgccaacgttgacaccttcatagtcttcaaatccctgaccccgctcctggtcgccatc

SEQ ID NO: 329 - DNA, 440 bp, Zea mays
  Clone ID: LIB3179-019-P1-K1-B7
aaggccattcattgccgtccctgcaatttttttggaggaaacagctgctgtcgttgtgagggtttttcatgacagtttgctgaggtactcaatcccacgcatatcaaaacggttctaaggccacgttgggcttcattagtatctgtttggttccagggactaaaagtgttaagaactcattaaattactcataagaatactaaaatgccctttaccattttcccaccattactctttttccactgcattagaaataaataaggggcaaaatgtggaattaatatggcttagtcccttttagtcatcccttgagggactagatactaaagcagattactctctattttagttctactgtttagcattttggggcctaaattggactaaaatgctggtaataatttttagtctttgaaactcaacaaatcctaaattgtttt

SEQ ID NO: 330 - DNA, 460 bp, Zea mays
  unsure (1)..(460): unsure at all n locations; Clone ID: LIB3179-019-P1-K1-C10
gcgtccggcggaatctagggggcataggcatgcgaataaggcgacgaggcataacctaacccctgaggggaccttcgaccgctctggcgcttaagcaccgcttaagtgatgccttaataacaatggctgaaaaggtgctccaaagatgagctatccaacctaaaagcaaaattccgaatgatgtgctgtaaaactgtattctgtaatagcatatatttattatttttctattcagnccattttcttccctttcagcacaaacagaaaaattaatctgcaattggttctgttgcaaatgatttattattaaacaaaatggcaggctgctacttcttgggnaaaaaaaattatataatattataaaatattttttaatatatataaaaaaattatgtaatattatataaaaattttaaaatatatttaataaatttttaaaataaatatatttttatatatt

SEQ ID NO: 331 - DNA, 447 bp, Zea mays
  Clone ID: LIB3179-019-P1-K1-C11
cggcaatcgcgaccgagttcctgctgctcattttgttttctggacaagctttacttcacgcgggtgggcaagttcatggatgagcgggaccccaatatccgcggtgagctcggcgatgtcaagggcgcctcctaggaggtgaagcatttgaaggaccaggcggcggccataatgaaggcggcgcgcgccgagatcgcggcggcgcttaacaagatgaagaaggagaccaccgcggagctggaggccaagctggacgagggacgcagccgtgtggaggccgagctcgtaaaggcgctcgccaacctcgaggcgcagaaggaggaggctgtcaaggcgctcgacgcccagatcgcctcgctcagtgatgagatcgtcaagaaggtgctcccatccgcgtgatgaaaccaaaccggccctgccttatcctacgacttatagttcttgaac

SEQ ID NO: 332 - DNA, 384 bp, Zea mays
  Clone ID: LIB3179-019-P1-K1-C7
cggggctggtccggtggctccactaagaccctgggcaacttcgtcaaggcaaccttcgactgcctcatgaagacctacgggtgccttacgcctgaattctggagtcagaccaagttctccatgactccgttccagcagtacacggacctgctggcgaagcccaccaagggtcttgtgcttgaggccccaactgagacagtagaggcttaggatggtttgtgctgtctaaatgcactttctatgttatagttaagaactgttgtcaactttgggttttgttttgccctggatgttctttgttgtcaagttttggatataacagcactcttttttaatcagtgaatgctacataatcatctcaaatctcatgataatctttttttc

SEQ ID NO: 333 - DNA, 464 bp, Zea mays
  Clone ID: LIB3179-019-P1-K1-C8
cgggcggcccgggggccggctattgggctttaagccccttcttcttctttttgggtttcttcccctggcctttaaggggagggcccgggggccccagggccataagcttgttgtattccgccaccccaaccttggcggccgtttggtgggctcccggttttccaaggcccgggtccaaccccaggttggcccgggcaggccggccgttgtttgcaggtccctccgggcgcggctcggcggaaaccgcgggccggccgggggagggattttcgggcataacaattacccgggtggggacttcatgacaacaagggacaaatctccatgttggccaacctactacaccagttgaccaagccctggagctgctggggcaacacaggatctctggctttccttgggttgacgatgactggaacttggttggggtggatcaaattatgatctcctagctttggattcga

SEQ ID NO: 334 - DNA, 456 bp, Zea mays
  Clone ID: LIB3179-019-P1-K1-C9
gggccgaccaggcgtacgaactaaaccaacatcaaatcccttcctccttttttttaataaccaaccaataccctctaggggggggctcattaaaactatggccggccaaaaaaaacaaccccccaacccaaacctctcaaccactataacttacaccccatttaccatatccctctccaaactccaatttttacccattagactaacttccacaactactaccttaacccccctctaaatcacaacctaaaatctaaccgaaactatcaatttctaaaataccaaataaactatatgtcacataatcaaaaaaataaataatctcaatttaatacaacttattaaactaaaaaaccaatcatcaattaacaaaactcttctcaaataacactaattaaaccttctctatatataaacatcaacaccattcttaaccatattatttttactcatctt

SEQ ID NO: 335 - DNA, 435 bp, Zea mays
  Clone ID: LIB3179-019-P1-K1-D11
gtctcctgtcactcattctgtgggcaactgtgttaaacgtgttgtggtcattgtaacatcaggggggttcttcaggacacctgtttctcctatcaactctctcggtactgcgattgcacttgccggagttttcctgtactcacagctcaagcgacttaagcccaagccgaagacggtttaaatagggattgtattttccatctctttgtgttaatggagttaaacacttctatgtttcaggtgactgcattttaaaagatttgtgcttataacaacaacaaagtcttttagtctcaagcaagttagataggctagggttaaaaaccgaaacacctccccccaccccccaaattaaagatcagtcacatggataagtgttttccatgtacttctatttaagtctaaatctttagatatatatcatcattggaaacc

SEQ ID NO: 336 - DNA, 95 bp, Zea mays
  unsure (1)..(95): unsure at all n locations; Clone ID: LIB3179-019-P1-K1-D8
cggggaaaaaaaaaaaaaaanaaaaaaaaaaaaaaaaaaaaaaaaaaaagggttttttttttaaaaaaaagggccggcctttctggggggtccaa

SEQ ID NO: 337 - DNA, 221 bp, Zea mays
  Clone ID: LIB3179-019-P1-K1-E10
catccaacctttcataactactttcctattttatccttctatttcatctcttcctatcattgtaaatcaaaattacaccaaatgttgttatcttcacccaccaatatgtaacgttatctgtttttaaaccttcctaagacatcttatttttaccctactgattaccacccctttacagtaattcaacctatttcaataagaacccatattttacacaattt

SEQ ID NO: 338 - DNA, 477 bp, Zea mays
  unsure (1)..(477): unsure at all n locations; Clone ID: LIB3179-019-P1-K1-E5
aaaccggggcgggngggcttcctagacacgtactctttgtcctctttaactactattttatcacngcctaatccaaaactcgggttcgttgataatctaacttgcctgggcacctcaatcctcaacaaatatggcacatagccattcttagtaaacttcacatcattgtttgtcttgttatttgttccctcttttgtgggggctgctatagctccagttcgccttgaaaaaccacaggtttataacccatttccataaaactatctcaaataaaatttacaccatttccatttcccaatattgtctttcaccacattgtagataagatattcatgtctctttattgacaaaaaatttcattaatttatcacaataaacacgtatccataaatttttctatatacattcttgtacacttcaaagtttcattatatgcataactgaaatatctgctcaaaaaatttatgtattctcttt

SEQ ID NO: 339 - DNA, 438 bp, Zea mays
  unsure (1)..(438): unsure at all n locations; Clone ID: LIB3179-019-P1-K1-E7
ccggcagtggcaacaaagcaagaatttacttctgcccatctgatcattatcgtcacactgtgtccggcagttgcgcgacaccatgagtctcacacggagtgcggcggcggcggcggcggcgcccaagacgtcgtgggcctgaggtgggtcgggtctgagcgtggaggatgccaaagaaggtgatctctcaaggacanagccggacgccgacatcgtggtgctgcccgtcggctccggggtgaccgcggattatcgccctaaccgggtccgcatcttcgtcgacatcgtcgcccagacgccccacatcggctgataatatataagctagccgctatttcctttccttgccccagaacttgaaataaatatatatacgatgaaataacgcgggcatgccgaataatggatgtgtgaattctcactaattaagtaatgcat

SEQ ID NO: 340 - DNA, 416 bp, Zea mays
  Clone ID: LIB3179-019-P1-K1-E8
gagccgcaaaccctactacttatctccacctgtctgttttggtaacctcccgctcgtccacgagggccacctaatatgtgcgggtgtccctgccaagccgcctgccctaacactttcttccttcagttcccacgactccctgtcgattatcccacgccggtgatcctaaaggacaagccgtaccccgccatcggggtcctgcccgccgtctcctagttgacccctgatttatgccctaaccttgtcctaatcttcttcgacatcgattcccaaaccccctacatcggttgataatatataagctagccgttatttcctttctttgccccagaacttgaaataaatatatatactatgaaataacgctgccatgccgaataatggtattgtgaattctcactaattaagtaatgcat

SEQ ID NO: 341 - DNA, 471 bp, Zea mays
  Clone ID: LIB3179-019-P1-K1-F1
gggggttcttccttggcacgtactctttgggctctttgtctacatcttagcactggctaatgcagaactcggcttggttgagaagctcactttcctcgagagctcaggtctcgacaaatatggcacagaggcattcttagtgaacttcacagcattggttgtcgtgttatttggtgcctctgttgtggtggctgctatagctccagttcgccttgaagaaccacagggttatgatccaattccagaaaactagcgcaaatgaaatgtacagcgtatgcagttgccaagattggctgttaccacatggagataagatattcatgtctctttattgacgaagaaggtgatggaattatcacaataaagatgtagacataaatgtgtgtatatacattctgtgacacttcaaagtttcagtatatgcaaaactgaatatgctgcttcataaatgtgtgtatttgctttcatgaa

SEQ ID NO: 342 - DNA, 406 bp, Zea mays
  Clone ID: LIB3179-019-P1-K1-F3
cgggccggcccaggcgtccgcgtcggtggaaccactggctttctgatttggtcctacaccctcgctgggatcctcggggggtgctccttcctagtttacagcgccacccccctctccggctaaggatatccaatgcatgcgcttcttgcgattcgtcatgtaaaatcagggtgtctgtctataatctagcctccatggatgctcaaccttcgtcatgtaacaataatcagtgctactcttcattaaaaaaaaaaaaaaaaaaaaaaaaaaataaaaaaaaaaaaaaaaaaaaaaaaaaaaaaaaaaaatataaaaaaaaaaaaaaaaaaaataaaaaattaaaaaaaaataaaaaaaaagggggcgcccttttaaaagaatccaatttaactaccccctccttcca

SEQ ID NO: 343 - DNA, 498 bp, Zea mays
  unsure (1)..(498): unsure at all n locations; Clone ID: LIB3179-019-P1-K1-G10
cggaanncccgggctaactgcttccttccccgccgccgcctacaaccaacacttaacgtgcccccatccttttccgcctcaagtcaagtgttcacggtccatcctctcgagagtgtaggcccttctcccgaagccgcagacgcagaaaacggctctacatatggaggcgaagaagaagccgtcggcccccgccgccgtcggagccgcgccgccgccgccgggtaacgggtacttcagcaccgttttctccgcgccgactgcgggaagcgcaagtgacgcaaagcatgcggacttgtacacgatgctgaacaagcagagctccagagggcagaatggcagagatggcaaatcccacagccgccctacttacaaggatggcaaacatgctcatccaaatgagccatcagaatctccttactttggctcatccgcgcattacggtggtcgggagttctacagcagcgttttacggaagcaaccagccaatgaaccccatac

SEQ ID NO: 344 - DNA, 342 bp, Zea mays
  Clone ID: LIB3179-019-P1-K1-G9
gcatgggttcagaagctcaagtgggacgggctcaaggccttcctgagcctgcccaggcagcgtctgtactgcggccccggcaaagggaccaaggcgttcgtccggtcctacaagaacctgcacttttactggattcttggggctggccactttgtgcctgccgaccagccttgcatcgcgctgagcatgatcggcagcatcacccagtctccagccagttagaggggttttgtttatgccatacgcaaagatcaaatgaggactctcgagtacagtgaaggtcgcatatatagttgaaagccaattcagttgatcatgatacatacagttctccatcatgtg

SEQ ID NO: 345 - DNA, 440 bp, Zea mays
  Clone ID: LIB3179-019-P1-K1-H10
cccattgtttggccgagtccaagaaagcagatacagttgcaccaaattataataaccgcgttttggagtgtcgcttagcagcgatggttcttgccatcaaacttgggatggataggaaaaaagctatctcctccgttacaaccctctccgatgttgaggggctatgtgtttcttttgctgggagagaaggttcatctgatcctgcagtagctgtgaagaaacttctgcatgaggacccatatacagctggagaaatagagaaaattacaggagaaggcctgacatctgtcttccagggctctcagacgtcattggatgttataaaagcggcaaagcactacaagctatttcagcgtgcgacccatgtctactctgaagcaaggagggtttatgctttcagggatactgtctcttcaaaactcagtggggaaggcaagctt

SEQ ID NO: 346 - DNA, 459 bp, Zea mays
  Clone ID: LIB3179-019-P1-K1-H9
gctgtcccctcgctgtacacagggtgtctgtcaccgagcagcgggcagccggcaggcaatgcgatgatagtagctgctgctgcccctgcgccgccagttccagcaccgccgggcaaaccgcccttttctctctcctcctccagctcctccttctccctccgccgccgttccttcagcttgtggttctcaaacggcaacgcgcatggaagagacagcgccaccgccaccacgagcagcagggcgacaaggaggtggtggtggtccgatcccggcggcagccgagaagactacggctcctcttttctagaggaggaggacgtttacgattacgaggatgaggctgcgttccccagatttggaggggccgcggaactgttcgatgagccctggttctccaaggtatataagacttacggaatcctgctaccggtgatgctggcgtccatgcttgctgcgaca

SEQ ID NO: 347 - DNA, 336 bp, Zea mays
  Clone ID: LIB3179-020-P1-K1-A1
tagcagtgcaacaggcaagatttacctgcccttcgatcatatcgtcaactggtccggcagttcgcgacaccatgagctccacggagtgcggcggcggcggcggcggccccaagacgtcgtggcctgaggtggtcgggctgagcgtggaggacgccaagaaggtgatcctcaaggacaagccggacgccgacatcgtggtgctgcccgtcggctccgtggtgaccgcggattatggccctaaccgtgtccgcatcttggtcgacatcgtcgcccagacgccccacatgggctgataatatataagctagccgctatttcctttccttgccccagaac

SEQ ID NO: 348 - DNA, 234 bp, Zea mays
  unsure (1)..(234): unsure at all n locations; Clone ID: LIB3179-020-P1-K1-A12
ccaccacctcgccggccacactcgttttttctactagccacaggcacaggcaggctctggggctcagtccacccatcgtgggggatggcttcntccttcgccgtggcaacggtcccttcgctggcggccccggcggccaaaaagcggtccgtcggcgtcacgtacttggagggcatgaacgcctacagcggcctcaaggggctcaacatggtgaacatgctcggggtgcgcaag

SEQ ID NO: 349 - DNA, 394 bp, Zea mays
  Clone ID: LIB3179-020-P1-K1-A2
gggtgttgatggcgtcaacggcgtactcgcggccatccaagccgccagggccggcggccggagacaggagcggaccgcggctggccaaggagctcggcaggatcgagcccaagaagctgggcatcgggctggttgctggctgctgcttcgcgctgctcacctacctctcctttgcccggctgtttgccatctactcgccggttttcgacagctcgtcgtccatggtgttgaagaacatgccgccagcaacgacgacggtgccgggtacagctacaggggcgctgccggtggagcaaaaggcccaagtggaggagcagaaagaggttcgtgaccctgaggcggacccgcacatgccaaacttaccggaggtcacagaaaaggatcagcaggagga

SEQ ID NO: 350 - DNA, 175 bp, Zea mays
  Clone ID: LIB3179-020-P1-K1-A3
cccggggccccaccacctacactgcgcggtcccgctcaggcgcttcgtttcctccgagtccgccgtaaccgggcggcggtccaatcctgacgttgaggctcctccatcgcccctccttaaccccgccttgcccgcgccagacaaaccctgttctgacaaaaccgtggcgcgcccc

SEQ ID NO: 351 - DNA, 355 bp, Zea mays
  Clone ID: LIB3179-020-P1-K1-A5
agacaacttgttcaattgattctggaagagatcgatctacttttgcaccacagggtctaggatgtgttgcaactgcggatcaagctgcgattgctgctcaagctgcaagtgcgggaagaagtaccctaacctggaggagactagcaccgccgagcaggccaccgccgtcctcgtcctggcccgggagaagaaggccgagcccgaattcgtcaaggccgtggctgtttccggcaagggcccccacgcctgcttctgcggtagcagttgcaagtgctacccctgcaactgttgatcacattgatcgacggccatggatatggtttttatctatctagcttggggtggtgggtgaaca

SEQ ID NO: 352 - DNA, 234 bp, Zea mays
  unsure (1)..(234): unsure at all n locations; Clone ID: LIB3179-020-P1-K1-A9
ggtgggtggaatcttcctaaacgacttgttncattgattcttgtttagttttagcttcttttgcaccacaagggggggggtttttttcaactgcggatcaggcttcaaatgcggctcaagctgcaagtgcggcaagaagtaccctgacctgtaggagacaagcaccgccttgcaggccaccgtcttcctcggcttggccccggaaaagaaggccgctcccaatttcgacaaggc

SEQ ID NO: 353 - DNA, 448 bp, Zea mays
  Clone ID: LIB3179-020-P1-K1-B1
gaattccgggggcaaatatacctcaggaatagtgactctacttaagatctacttgctgagataggtcgtgaattgcctaaggtgggccatctcttcttctcgagtgatgctctcgagttatgcatatgccaccactctgccttaaaaagaacatctggcaatattctgaatccagccgaggagtgagcataaaaggtttagcaattaacaaataatctatgttcaatgggcatgagtgaagaataattagtaagtgcttttcactggctgacttgatagcaaagtagtgtaaaaataatggtaaaagtggttacgccttataaactgggacgtagggagtactgttatattagcaagtacaaaagcattccccgctaacactgtttgtgtattagaagtgagcagtctgtgaaatagaaagtgacatccatttgctattgttaggtgc

SEQ ID NO: 354 - DNA, 75 bp, Zea mays
  Clone ID: LIB3179-020-P1-K1-B2
actctagttgtattaatcttacgtacccatgcatgcgaggggggtcttcttcaatagggcgacgtaaattcaaaa

SEQ ID NO: 355 - DNA, 219 bp, Zea mays
  Clone ID: LIB3179-020-P1-K1-B8
gcctcccagtccctggagctcgcctttatcatcgtttagaggctgaggaagaggaggatgcgatcggtgctaaacagcagcctgccactgccgccactggctttctgagtagccggagccaaacacaaaggagggtaggaatagctggggtgactcggaagagaaagagacagtcgacgccttgttttgttgatgcttagtgtggtgacctggtggtgg

SEQ ID NO: 356 - DNA, 376 bp, Zea mays
  Clone ID: LIB3179-020-P1-K1-C1
cggcccaggcggttcgaataacactccgttttttatttgcgtcaagcggatctgatctgcttgtcctcgtgagggccacgcgccggtcgttacgtctggattttgtccacgtcaaccgaaaagctccttgctcttggtttttggggtacatccctccttgccaaaattagcgcccgggtactaggggtggtggcccccaccgggtcgtattactcaccacccggtttgtgatgtataaacgcctgctgaagttatcatgttatggcttatggatcgtttaagaatgggaaaaacctggatggactttgactcactataaaggtaaaaacaaaaaaattgggcggccggtgtaggggacccaagcttacgaacgcgt

SEQ ID NO: 357 - DNA, 331 bp, Zea mays
  Clone ID: LIB3179-020-P1-K1-C2
ctcacacactcactatacactgctctgctgcatcttgagggaagaagctagcccctccctagctatggtcgtcagcactggccaccaccgcctggtccagcctcctaaagtccaaccttcgcgggctccctgttccgcttcggccactcgcaccaccacctctgagtccgtggccgtggccacccgccgcgcctgggggggcccaatccgcccgtccatctcctcctcacccaccccgccctacgacctgacgttcttccggtttagccctatcaaggtggccatcttgtccccaacgaggaccagtctctacatggcggacattactacc

SEQ ID NO: 358 - DNA, 278 bp, Zea mays
  Clone ID: LIB3179-020-P1-K1-C4
gcgtccttgatattatggggcatagtcatccgaattttttttctaggcattacctaacccctgagagcaccttttaccgatctggcggttaagcaccctttaagtgatgccttaataacaatggctgaaaaggtgctccaaagattagctatccaacctaaaagcaaaattccgaatgatttgctgtaaaactgaatcctgtaatagcatatatttattatttttttattcagtccattttcttctctttcatcacaaactgaaaattttatctgcaa

SEQ ID NO: 359 - DNA, 342 bp, Zea mays
  Clone ID: LIB3179-020-P1-K1-D1
acgcgtccgatgcccatacatctgtggcaggcaccttgaccatgttgttctccttgttggatatggtgcttctggtttcgcccccattcgcctgagggacaagccttactggatcatcaagaactcgtggggcgagaactggggggagaacggttactacaagatatgcaggggttccaacgttcgcaacaagtgcggcgttgattccatggtctctaccgtgtccgcagtccacgcctcgaaggagtagactctggtcagcggtgataatcgagattccatttattgtgtaactatatatccctgcttgtaatccatttgtgctgtttattgatcgaaggc

SEQ ID NO: 360 - DNA, 74 bp, Zea mays
  Clone ID: LIB3179-020-P1-K1-D12
tctttaaattttcttttttacttccacgtgcatgcaacggggggggttttttatagtgtcgccgggattcaatt

SEQ ID NO: 361 - DNA, 266 bp, Zea mays
  unsure (1)..(266): unsure at all n locations; Clone ID: LIB3179-020-P1-K1-D3
gggcggggggggggtnanaaaacaaaaaattcctaattgcctcttattatctttatccgatcagctaattccaccctgggctgtctatttttatgcaagggggggccctttttaattaatttttaagaccaaggtaaattcatcatacacaagagaggggtaatgttcaattatacacgacttcttcatttagtttttttaaatacaacagaccacttgcattctttcctcctacaccaaaagccatgtttcccacgtacaagaac

SEQ ID NO: 362 - DNA, 330 bp, Zea mays
  Clone ID: LIB3179-020-P1-K1-E1
ggcgtccggaatgaaatgcaggaggaactcaccttatccttgttatcagatggtgtctcacgagacaaggtgtgaacttactactgaaagcgagctccggtctctgatgtattttatgaccagttaggcctcaacgtgtaaactttattgcttaggcctggctgtgatgttccagtgatatatgaataaactactgaacttgagacgaggatgtaatgttcagtgatatattatatgaataaactactgaatttgaggcgaggccataatatatataaaaactcataatattataaaaaaaattttaagttatgtgtttatttttttttc

SEQ ID NO: 363 - DNA, 303 bp, Zea mays
  Clone ID: LIB3179-020-P1-K1-E12
actacccagtttccaagactttcttttccttcttttccccacatgtctcctggcgcgggggattttttaaaaaggagggtggcttcaaacccaagcatactgattacagttgatgaggctctgcatcatccatacttggcttcacttcatgagatcaatgatgaacctacctgccctgcacctttcagttttgattttaagcaaccatcctttacagaagcgcatataaaagaactcatctggagggaatctttagcatttaacccaaagcctccctactaatatcaaaaggatgatgagtta

SEQ ID NO: 364 - DNA, 330 bp, Zea mays
  Clone ID: LIB3179-020-P1-K1-E2
gggcggccggaggcagatcaaggagatcccgtccgagttctatttgccttttctcccgctcgaagcctgaggccgcctggaggcgttcatcctagccctggaggctttaactgcggctactgtctaaaggaaccaagcggtaatgttggcactgtcccctccagtcagacctgcggatcaacggcggttgctccaaatctccaatactactacatatgaacggacactatttttgtgcgtttctgttgacggaaacctgagtatttctttctccttattttccctgtggttgacaaacacagacactgtaatttgtttattaaaaacact

SEQ ID NO: 365 - DNA, 219 bp, Zea mays
  Clone ID: LIB3179-020-P1-K1-E3
tgaaccccttgttcccataacggtgtcttttctagagtctactccatttaagggagggaatttccttgctacgggggatacactcatacaaatttttcgctagtgccaacggctgacaagcaaacagctattatccaattgcaaactgtgtgtaagctctgcggtggtaaatagcatccaactttgctcgttgtacttgtaagctagcatttttgtgct

SEQ ID NO: 366 - DNA, 434 bp, Zea mays
  unsure (1)..(434): unsure at all n locations; Clone ID: LIB3179-020-P1-K1-E9
gaannncggggggggtgcttccttggcacgtactctttgggctctttgcctacattttatcactggctaatgcaaaactcggctttgtggatatgctaactttcctggggagctcaagtctcgacaaatatggcacagaggcattcttagtgaacttcacagcattggttgtcgtgttatttggtgcctcttttgtggtggctgttatagctccagttcgcctttaataaccacatgtttatgatccatttccagaaaactagcgcaaatgaaatgtacagcgtatgcatttgccaagattggctttttccacatggagataagatattcaagttctctttattgaccaaaaaaggtgatggaaatcatcacaaataaaataagttcacctttaaatcgtgtgtatttaacatttctgtaaaccacttcaaaaa

SEQ ID NO: 367 - DNA, 366 bp, Zea mays
  Clone ID: LIB3179-020-P1-K1-F12
cgaaaaaaagcagccgcattggctagcatcactttttttcttttcctccacggccttcgccgggaggggggttaacttgccgtgggggggggcctccggcaaggcccgcgtgacaatgctcaagacggcggcaaaggccaagccagcggcggcttccgggagcccgtggtacggcccctaccgcttgctgtacctgggcccattgtccggtgagccactgagcttacctgactggcgagttcccgggcgacttcggttggtacaccgtttggctgtttgctgacccggagactttcgccaagaaccgggagcttgaggttatccactcccgttgggccatgctgggcgcgcttggctgtttttttc

SEQ ID NO: 368 - DNA, 322 bp, Zea mays
  Clone ID: LIB3179-020-P1-K1-F3
gcaaaccaaggcggagatcatgcaggtgctttttttatgttccccggcaaggacgtccgggacgccacctacatccttgtgcggaggtggtggtccaacaggttttacaagggcaccttttttaactggccagttggcgtcaaccgctacgaatacgaccagcttagggcaccggttggtagggtatacttcaccggtgagcacaccagcgagcactacattggctttgtccatggagcctatctttcaggtatcgactccgctgaaaattttatcaactgcacccataaaaagatgtgcaaattaccatgtccagggaaag

SEQ ID NO: 369 - DNA, 168 bp, Zea mays
  Clone ID: LIB3179-020-P1-K1-G12
gaccacgcgtccgttcattgttggtcccagtccaccaatccattttctttctcctcacattctcatacccgcggggtggtgtgtcttttataagggaacgtaaatgcaatcaaccttccgatggtttgcaaaaaagctacttgcaaaacccaacccttcccaacttaa

SEQ ID NO: 370 - DNA, 322 bp, Zea mays
  Clone ID: LIB3179-020-P1-K1-G2
cggacgcgtgggcggactcgtggggaacggttcttgtttagcctgaccatggacgagatcatggacgagtgcatgacattcttcttcgcaggccacgagaccacgtcccatctgctcacctggacaatgttcttgctcagcgtgtacccggattggcagcaacggctaagggacgaggtcctgagagagtgcggacaggcaaaccctactgtagacacgcttaacaaattcaatgagatgacgatggtgctccttgagacactgagactttacggccctgccatgcttatgcttaggaagcctacctccgacacaaggctgg

SEQ ID NO: 371 - DNA, 430 bp, Zea mays
  unsure (1)..(430): unsure at all n locations; Clone ID: LIB3179-020-P1-K1-H1
tttaaaaaaatttttatttaaaaaaaaaaaaagaaaaaaaaaaaggaagaggtattaaaaaaaataggggggggataaaaaaaaaaaaantgttattataagataaaaaaaaaaagataaaaaaaaaaaaaaagtaaaaaaaaaaaaaaaaattaataaaaaaaaaaataaatataaaaagaaaaaaaaaaaaaaaaaaataaaaaaataaataaaaaaaaatnataaaaaaataaaaaaaaaaaaaaaaaaaaaaataataaaaataaaaaaaaaaaaaaatataaaaaaaaaaaataaaaaaaaataataaaaaataaaaaaaaatatagaataaaaaaaaaaaaggaaaaaataaaaaatataaagataaaaaatattataaaaaagaaaaaaaaaaaatttataaaaaaataaaaaaaatataaaa

SEQ ID NO: 372 - DNA, 333 bp, Zea mays
  unsure (1)..(333): unsure at all n locations; Clone ID: LIB3179-020-P1-K1-H2
aaaaaanaaaaaaatatataaaaattttataaaaaaaaaaaaaaagaggggaataaaaaaaatagggaaaaaaaaaaaaatataaaaaaaaaaaaaaaataaaaaaaaaaaaaaaaaaaaaaaaaaaaaaaaaaaaaaaaaaaaataacaataaaaaaaaaaaaaaaaaaatataaaaaataaaaaaataaaaaaaaaacaaaaaacaaaaaaaaaaaattaaaaaaaaaaaaaaaaaatataaaaaaaaaaaaaacacaaaaaaaaaaaaaaaaaaatacaaaaaagacaaaaaaaaaaattcaaaaaaataaaagaaataaaaaaaaataa

SEQ ID NO: 373 - DNA, 403 bp, Zea mays
  unsure (1)..(403): unsure at all n locations; Clone ID: LIB3179-021-P1-K1-A2
attttaatccaaacaatctgacgcacggtgcaccataagacgaagtccgtcatgcgggtgacctgggaaacattgttgcaaatgctgagggcatanccgaggcaaccattgttgatacccagattcctttgactggcccaaattcagttgttgggagagcatttgtggttcatgagcttgaagatgatttggggaaagggggccatgagctcagcctctctactggaaatgctggtggaagactggcatgtggtgttgttggcctgactccattgtaggttgctcgccgggtgcccgggttgcagttgcagctacgctgttacatccttgccttggtggacttttgtcttcaatcgggttattgggacagtgacctttttgtattacttggattcattccatg

SEQ ID NO: 374 - DNA, 452 bp, Zea mays
  Clone ID: LIB3179-021-P1-K1-A3
cgggcctactggtgggctggtagccaagtataggccatccatgccgattctgtccgttgtggttcctgagctgaagacagactcgttcgactgggcctgcagggacgagggtccggcaaggcacagcctcattgtgaggggtgtcatcccaatgctgagtgccgccactgccaaggcctttgacaacgaagccactgacgaagctattggttttgccattgaaaatgcgaagacgatggggctatgcaacaccgatcaatccgttgtggccctgcaccgcatcgggatttcatccgtcatcaagcttcttactgtgaagtaggggtccaagggtgagggacaccattttgcttggtgaatttttgtgaggctgcttacgcacatcagcgtatccacagtttttcttgtgccaaagatacagactttgcgttctggtacaccttggtgttaca

SEQ ID NO: 375 - DNA, 362 bp, Zea mays
  Clone ID: LIB3179-021-P1-K1-A6
gaaaacaaataaataattaacaaaagatacccaatataatttattatgcatcatgctgggattttatttggggtgcattttgtgacagcataaaataatataaaagaaaagaattatgttaaaaatccaaagtggaatataaatcctaaaggaaaattcaggaatctagaaaaagagaagaagggaatcaactatgcaaataaaaataaatataaatataaatatgtatattatttttacacggatctgagtttataaaattgactcaaagttgaatttcataacatgactctaattcaaattagggattcaattgaaaagaaattgtttcaaacaaattattattttaaaaaattattttt

SEQ ID NO: 376 - DNA, 389 bp, Zea mays
  Clone ID: LIB3179-021-P1-K1-B3
tccggccatgccgaccgcaacgcggaggctgttcttttttctcctaaagaccctagttccatccggcgggcgcggcctttccaccgagagggctgttgttccaaccgccgtcttctgaagccacactgttaagtggatgcaggacacgaccaagaagtcgccaatggaactgatcaaccaggtacctccgatcaaggttgatggtcccattgctgtctgtaaaggggcttctgaaggtgttggacttggccacccaatcgagtacatttgccttgatctggaggcacctaatgtgtgcaaatactgtggtctccgttatgttcaagttcaccatcactaaattgggaagatactgccatctaccgttgcagaagctgatttgaggagtt

SEQ ID NO: 377 - DNA, 177 bp, Zea mays
  unsure (1)..(177): unsure at all n locations; Clone ID: LIB3179-021-P1-K1-C11
aaaaaaaaaagggaggtggaaaaaaaaagaggggggagagaaaaaaaaaaanaanaaaaaaaaaaattatttttaataaaaaaaaaatataaaaataaaaaaaaaaaaataattaaaataaaaaaaaataataataataaaaaaaaaaattttttaagaaaaaaaaaaaaataaaaa

SEQ ID NO: 378 - DNA, 368 bp, Zea mays
  Clone ID: LIB3179-021-P1-K1-C2
ccgggcgtccggtttgttatcacaccagccagtggcggttcattttgcaccaccggccccgtcagaaacccggaggggcatggtttaaacgtggagcggcctggccgtggccctggtcatgggcaccgtgctcctagggggtgccggtacgtgccacgcgggccgccgcctcgacaaactgccgccggtgcctcaagtcccagcaggtattccgagtctgccggcgccccaagtgcctgagctgccagtgccgccggagcccgagctgccaatggtgcctaaactgccgggcgtgccgttgccgcccgccgcggtgccgtaggtgcccctcgcgttgatgttggatcgttcccccgtgccgtcctttt

SEQ ID NO: 379 - DNA, 306 bp, Zea mays
  unsure (1)..(306): unsure at all n locations; Clone ID: LIB3179-021-P1-K1-D1
aaaaactaggggcttacggcatattttacccggcncgcgccgacttcctggcanntcatcataaatatattatacctatacctatacttactcacgtaccctacccgatattgcaccccgagcatatgtgaatcgcgtcgagtcactatatatcgtgttttctgcatctacatatatataccggatcaatcgcccaatgtgaatgtaataagcaatatcattttctaccacttttcattcctaacgctgagctttttatgtactatatcttatatgatgaataataatatgaccgccttgggatct

SEQ ID NO: 380 - DNA, 118 bp, Zea mays
  unsure (1)..(118): unsure at all n locations; Clone ID: LIB3179-021-P1-K1-D2
cggaaancccggggccgcccgacgcgtccgtttgtccttgatgtgctaaacgcgtgcattcaggcgcgatctgcgggccggcaagcctggtgaacgcgatgatggacctgcaggaggg

SEQ ID NO: 381 - DNA, 387 bp, Zea mays
  Clone ID: LIB3179-021-P1-K1-E1
tccgaccggcccctccaacttttccagtccgacattcttactaactccccctcccccgcccaaaccgtgggtattgaccaccgtgtgcggagccccaaagccctcaatgcctccccgactcgccctccgtgcccaccttttctcctccgcctttccgctcccaatgcgcgcgctccccttactccgcagccgcttccgttccttgaccacggcctacgctgtcaagcaggacacggccctttggacccctgcacccgtttccgccatcagtgctgccaccgacgacggctccgtctccctaatcgccgacgacctatctgacgccacgaacctcgtggactcgtacacgaacccgggccaatacctcctgatccgcgtacccttcta

SEQ ID NO: 382 - DNA, 424 bp, Zea mays
  unsure (1)..(424): unsure at all n locations; Clone ID: LIB3179-021-P1-K1-E2
cgtccgaagcagtgcaccaggcaagatttacctgccctcctttcatatcgncaactggtccgccaggggggggcaccatgagctccacggggggcggcnncnncngcggcggctccaaaacttcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcattttcgtcgacatcgtcgcccagacgccccacatcggctgataatatataagctagccgctatttcctttccttgccccagaacttgaaataaatttatatacgatgaaataacgcgggcatgccgaataatggatgtgtgaattctcactaattaagtaatgcat

SEQ ID NO: 383 - DNA, 420 bp, Zea mays
  Clone ID: LIB3179-021-P1-K1-E5
gcgtccgcggacgcgtggtctaatattggccaaattgttttattaccaaaccacgcccccattaacagcgggggtagatatgggtccttggagagtacgcctcctgaacgaccaatggttaacggcggttctgtggagtggttttgcaagaatagttaataatgagatcatcattttaggaaatgatgcataactgggtagtgacattgatccagaagaagctcaacaggcacttgaaatagccgaagctaacttgagtaaagctgaaggtacaaaagaattgtttgaagcgaagctagctttcaaacaagctaggatactaatttaggctttcaattgttttcccccatccaattgaagacaattcaaagttttttttgtatcaaaaaaaaaaaaaaaagggctgtcgttttttaagtt

SEQ ID NO: 384 - DNA, 428 bp, Zea mays
  unsure (1)..(428): unsure at all n locations; Clone ID: LIB3179-021-P1-K1-F1
ggaaancccggggcctggccggcctcacaaaagaccaaccgaccaaccaaccaaggccatttttcttggcggcggttgtgtccttctcccgggggcgagctctcccgacggggtccagctccgtgtccggcgacgacaaccaccgttcctactccgnggcgctggccatgtcggtgtcggtgcggccccggtgtcgcgcgcggtcgccggcgcggatgatgggcaacgtgaacgccggcaaggggctgttcgcgccgctcgtggtggtggcgcgcaacatcatcggccgcaagcgcttcaaccagctcaaggggaaggcaatcgcgctgcactcgcaggtcatcaccgagttctgcaagaccatcggcgccgactccaagcagcggcagggcctcatccgcctcgccaagaagaaccgagagaagctc

SEQ ID NO: 385 - DNA, 443 bp, Zea mays
  unsure (1)..(443): unsure at all n locations; Clone ID: LIB3179-021-P1-K1-F3
gggggggccgaagggaccccgtgtggttcaaggccgccccccaaatcttttcttagggcggcctggactacctggccagccggaacctgttgcacgcgcggagcgtcctgcccntcctcggcttccaggtcatcctcatgggcctcgtcgagggcttccgcatcaacggcctcgacggcgtcggcgagggcaacaacctctaccccggcggccagtacttcgacccgttgggcctcgccgacaaccccgtcaccttcgccgagctcaaggtcaaggagatcaagaacggccgcctcgccatgttctccatgttcggcttcttcgtccaggccatcgtcaccggcaaggggccccttgagaacctgcttgaccacctngacgaccccgttgccaacaacgcctggttctacgccaccaagttcgcaccagggtcttaagctagc

SEQ ID NO: 386 - DNA, 86 bp, Zea mays
  unsure (1)..(86): unsure at all n locations; Clone ID: LIB3179-021-P1-K1-F8
gaaaaaccgggccggcccacgcgtccgccactacacaacaccaattttagaacctttatgtcaccaatcatgccccncttaaactc

SEQ ID NO: 387 - DNA, 298 bp, Zea mays
  Clone ID: LIB3179-021-P1-K1-G2
ttcatcaaatgaaacgcgtgtgcttccttcttcatcctttcttccacctttcatcacttgtcaaaatactcttggcctatttcatctaacccttattaattcatctacttttcatccagggatgtattcactttccatattgcattttgttccaataaaaaataaacatgttcatctaattttttcaaaatatctttatgatcaatcacctttttaaacctttatattaaccccttaaagttacctttccctgttttttaagttttttatatatacaccactttttattcccacattc

SEQ ID NO: 388 - DNA, 315 bp, Zea mays
  unsure (1)..(315): unsure at all n locations; Clone ID: LIB3179-021-P1-K1-G4
cctcatttctccatccccttcccgccgcattttctataccgtcgccgaaaaaaatntttggcgtgattttttaccaacgtaggggtgctaaacccntnttaaattcccacacccaccaccgtaatgtcccctcccttttcctttccttctactttttcaagctcatcttttacctaaattactttttcaccgacttaattcacaaccccttccttttcacccctttcttcaatttcactttcctccacccattcagttacaatcaccatatattattctttttctcatcctttctcatttacactttccattttt

SEQ ID NO: 389 - DNA, 390 bp, Zea mays
  unsure (1)..(390): unsure at all n locations; Clone ID: LIB3179-021-P1-K1-G8
gcagatggtgtctcacgagacaaaatctttatgaactactgaaagcgatctccgnccggtgatgtattttatgaccagggggggctcaacatgtaaactttattgcttaggcctggctgtgatgttccagtgatatatgaataaactactgaacttgagacgaggatttaatgttcagtgatttattatatgaataaactactgaatttgaggcgaggccaaaaaaaaaaaaaaaataaaaataaaacaatatataacaaataaataataaaacaaaatattattcttatataaaaaattaataaaaggggcgccccttttaaaggatccaagtttacttccccgttttttcaacttattaatttttttatagggtcccctaaattaaat

SEQ ID NO: 390 - DNA, 69 bp, Zea mays
  Clone ID: LIB3179-021-P1-K1-G9
cccgggccgacccacgcttccagcactacacaacaccaattctaaaaccccatcatcaccaatcatgcc

SEQ ID NO: 391 - DNA, 161 bp, Zea mays
  unsure (1)..(161): unsure at all n locations; Clone ID: LIB3179-021-P1-K1-H12
agacgcccaacatnggttgataatatataagctagctttttatttcctttccttgccccagaacttgggatggagtatttatacgaggaaggagggcgcccatcccgaataatggatgtgtgaattctcactaattaagtaatgcataaataaacgtattc

SEQ ID NO: 392 - DNA, 468 bp, Zea mays
  Clone ID: LIB3179-021-P1-K1-H2
cggggcggccccacccgtccgccgatcccaaattcctccttcggatctcgcattcatcgcaccgcaggtgtgaaggaagggggacgcggaggaagatggggctggcgttcggaaagctcttcagccggctcttcgccaagaaggagatgcggatcctcatggtcggcctcgacgccgccggtaaaaccaccatcctttacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatctttgttgtggacagcaatgaccgtgaccgtgttgttgaagccagaaatgagctccacaggatgctgaacgaggatgagctacgtgatgctgcgctgcttgtttttg

SEQ ID NO: 393 - DNA, 413 bp, Zea mays
  Clone ID: LIB3179-021-P1-K1-H3
aggcgtcggttcggggctaacgctgagactgtccatgagtccaacaggcattacagaggtaacaaggacgcacagatagggattgcgttcgacgtgatgggccgtgtgccatatgacaatatgtttctcgacgaccaggcccaagaaaggtccatcgattataacctaggatggttcatggagccggtcgttcgcggcgactaccctttctccatgagatcattgatcaaggatcggttaccctactttaccgacgacgagaaagagaagctagtgggttcgtatgacataatggggataaactactacactctgaggttttccaagcacatcgacatctcgccaaagtactcgccagtgctcaacaccgacgacgcctatgccgcccaagagacgaaaggaccagacgggaa

SEQ ID NO: 394 - DNA, 212 bp, Zea mays
  unsure (1)..(212): unsure at all n locations; Clone ID: LIB3179-022-P1-K1-A10
ggggccggccgactctttcgccaaactgcggatagagcagcgagccatctatattancgcgagcgcaagcacgtacgtgtggtgaagtttaagttagaagaggcaccactccctgatcgatggttgcccatgcttttctttccgtccggaagttgctgggccgccccttgcatttgtccgtttttagttcgtcttcaagtaaagctcccttc

SEQ ID NO: 395 - DNA, 381 bp, Zea mays
  unsure (1)..(381): unsure at all n locations; Clone ID: LIB3179-022-P1-K1-A12
gtgtgtcaatgcaacaagaggcacgtttgatattttgagntaatcccaaaaaaaaggaagggaaaaaataaaaaaataaaaaaaaaaataaaaaaaaataaatataaaaaaaaataaaaaaaataaaaataaaaataaaaaaaaaaaaaaaaaaaaaaaaaaaaaatggggctgccctttttagggatcccaactttccttccccttcattcccacttaaaacttttttttttgggtccctaaaatcaatttcattgcccgttttttaacaactttgtacctgaaaaacccctgtttttcccaaataaatttcttttgcaacaattcccctttttccaagttgttaaattttaaaaaggccccccccctttcccttttcct

SEQ ID NO: 396 - DNA, 124 bp, Zea mays
  unsure (1)..(124): unsure at all n locations; Clone ID: LIB3179-022-P1-K1-A2
gggaccacgcgtccgggaaagcccncgctctcgctcaccaccccggtcgttcgtttgctaatccctggagcggacgggagtaaggccagccaaccaaattgtctatttactgaagggaaggagg

SEQ ID NO: 397 - DNA, 305 bp, Zea mays
  Clone ID: LIB3179-022-P1-K1-A4
ggcgatcgatagcacaaggctgcgtctgcgtgctcggccgccgcccgacccgaccggacaaggaggggaggaggcaaaaaaaaatatatagttagtcacacgcacgcagcacaggagggaggagagggattgagggataaagaaatttcgggagacaaggagagagagacagagatggagaggagcggctggacttggaggcaggcctttcactactcccgcacacagataacgatgtggtagctagctcctcttaggctaaggaaggaggtcgtggccgggatcccgccgatgatgatgacagt

SEQ ID NO: 398 - DNA, 449 bp, Zea mays
  Clone ID: LIB3179-022-P1-K1-A6
ggcgtccgtttttttttttttttttttaaaaaaaaaaggttcatttcatgtatgggaaaaaaatttttgtggggcggttaacagcaattgtacactttactagggctacatcgatccgagcgtcattcttactcgacgactcaacaaaatcctgggcgtggtaaagagtgctctacgacctcggcagtatcttgccgttatacattttgtcgagcagctgcttggcttctgggcgtcgcaggagccctttgttgtttggcaggccagttccgagacagacagggcacaccaactttccgcggccgtagcaattcgggcactcggtgaattcataaacatctttcgccctcttccgattgagggccttccatttccctgtgccaccacacatgtcgcatatcacagcaccactgcccttacagttcctgcaaacagctttttgtaccccg

SEQ ID NO: 399 - DNA, 114 bp, Zea mays
  Clone ID: LIB3179-022-P1-K1-A7
ctagccgctatttcctttccttgcccaagaactggaaataaatatatatacgatgaaataacgcggccatgccgaataatggatgtgtgaattctcactaattaagtaatgcat

SEQ ID NO: 400 - DNA, 320 bp, Zea mays
  Clone ID: LIB3179-022-P1-K1-B8
gatcctcggttgcaaagaccatatctgagcttcctttgctcaaaataccgatcaggacaagacatggctgaatcgtggttgcttacgacataccttgacgaagagctcaggatctccagaggcgatggcagcagcatctttgtgctgttcaaggagggaagtactcttctatactgagatccaaatcccgagtccatgatcgttgaagctgaaccgtgaagtagttatactgcttatgcttttctttcttatagaaatatgctccgtctcaaaataagtcaatttctagaatcacttaaagtcaaattatcttaagtttg

SEQ ID NO: 401 - DNA, 395 bp, Zea mays
  Clone ID: LIB3179-022-P1-K1-C3
ggaagaagccatcataggtgcatacccaatccttatattttcagaggatattgaccaggaggcgctggctacccttgacgacaacaagctcaaaggatcactgaagatcgctgccatcaaagcccctggttttggagagcgcaagactcattacttggatgatattgccatccttactggagcaactgtaatcagagatgaagttgggctgtcacttgacaaggccgacaattcagtttttggaacagctgcaaaggttgtccttacgaaagagtcgacaacaattgttgttgatggcagcacccagtaagaagttactaagaggtttgcacagattaaaaattttattgaggcatcagaacatgaatatgaaaaggaaaagctcaatgagagga

SEQ ID NO: 402 - DNA, 507 bp, Zea mays
  unsure (1)..(507): unsure at all n locations; Clone ID: LIB3179-022-P1-K1-C9
gaaanccggggccggccgcacgcgtccgaaaatttttcgttgtatgctaaactggagttttaaacatggaaatgctgctgaaagtggtgtatgagctgtacacggacttggttttgaaaaatccgttctatgagatggagatgccgatccggtgtgagctgtttgatcacaacctggctcagatgatccagaaggaccgtgttgcgcttctgggtcggtgaatcttgaaaactcatggtctcagcccttgaaaaccttacttttcccgttttcgacgcttggacttgctctgctggaaccttaaattctaccttgcggcactgctgtgctgtgcataaccgataacttgaatagtgtgtggctcgcttgtaatcttcttgcggtgtgatgaaatgtagagctttgcgggcataaatgccgctgcaaatagtaacaacatggaagcagcttttgttcttgcatgttttccctgcaatgagcttgagcagtttgatcagggctggtttt

SEQ ID NO: 403 - DNA, 170 bp, Zea mays
  Clone ID: LIB3179-022-P1-K1-E1
ccgaacattttttttaattccccttccccttcccaacgcgggggaaaagaccaaagtttggggggccccaaacccttaaatgcttcccaaattggccttcggggccaactttttttctacggcttttccgttccaaatgcgcgcgttcccttaattttaaagctgttacc

SEQ ID NO: 404 - DNA, 444 bp, Zea mays
  unsure (1)..(444): unsure at all n locations; Clone ID: LIB3179-022-P1-K1-F1
ggaaannccggggnggacccgggcgtccgtattaaaggaaaataaaaaaatctttaaatttatttttttggctaaggggggacctcgtgggtgggggctttagggccaaaaggggaaaaaacctatataatgatggaaaataacctaatacccaccctatggtttcgtttggtcgagaccctacctaaaaaccagtccctatgggaataaatccatctatcaaaaaggggtagatctatcataatggttgaagcacctgcatttttttctctacaaaaaaaaccggtttctaggctgtgaagcaaaacctaaggggttgtggataaaagggagggttgatagattgaaggacgaagattaagaacgatttcgggttcccatatgtatggtctatgaattacatcttaaaaaaaaagggcattgtgttaaagcttcaatttaatt

SEQ ID NO: 405 - DNA, 143 bp, Zea mays
  unsure (1)..(143): unsure at all n locations; Clone ID: LIB3179-022-P1-K1-F6
aaccgnccggattcccgccgggcgtcgcgctgttcatcttgtacaacgcgctcaagcgcttccatgggggtggtggtgccatcgtgggtgcgatggctgaccatcctcgtcgcctggggcacatcacctctatttatctccta

SEQ ID NO: 406 - DNA, 397 bp, Zea mays
  Clone ID: LIB3179-022-P1-K1-F9
ccggttataatccattatgagactatattattggtatatcttagcacaatctattttgggtccggtggattcgtaattggggccggttcggtagtggtgtcatggttaatgacttatggtgccgcatcaaaactgaaagcctcctatgaatgcgcacacaggattgtgctactcctcgatgctggtatcaaggtctctagtcatgatccattgtggaactgcattgatgtgtgaccttccgtggaacttcccttgaaataatttctatgttgtttgtccaacaatattataatattattcttttttttattgggtcgccccttttatagatcctaagtttacgtattcttgcattttacgatttatcttttttattttgttactataattttatatt

SEQ ID NO: 407 - DNA, 83 bp, Zea mays
  Clone ID: LIB3179-022-P1-K1-G11
ccttacaaaataacaaaaactcctctacctattctcccttcccaaacatttttctttcctatattgttaattcttctccccct

SEQ ID NO: 408 - DNA, 145 bp, Zea mays
  Clone ID: LIB3179-022-P1-K1-H12
gtcttgccgcgcgccatcaggtgtttgtgtcacttttctgttaagtctctctacatgtgtactggcctcgtgtaccgctcctttatagtcgtgtcgtgtacgggctaattaatatatatacgacgaataaaggatgagttcggcc

SEQ ID NO: 409 - DNA, 397 bp, Zea mays
  Clone ID: LIB3179-023-P1-K1-A1
cgcaaggtgctcaacgacaaggggtggcccgagtgcaacgtcatcgaggaggagggcccgtacgaggacctcgccggcgatagcggcctctcccgccgctgccagatcatactcggcttcctcaccttcgtcctcctcttcaccgtcttctgcctcatcatctggggcgccgcccggccgtacgagcccgaggtcatcgtcaagagcttggtgatggacgacttctacgcgggtgaaggcacggaccacagcggcgttccaacaaaattggtcacaacaaactgttctctgcacatagctgtctacaaccctgccacaatgtttggaattcatgtcacttctggccccatccacctgatgtattcagagatcccaatagcagtcggtcaggtttcga

SEQ ID NO: 410 - DNA, 236 bp, Zea mays
  Clone ID: LIB3179-023-P1-K1-A12
cggacaccatcgacaatgtgaaggcgatagatccaggacaaggagggcatccccccggaccagcagcgtctgatcttcgccggcaaacagctggaggatggccgcaccctagcagactacaacatccaaaaggagagcaccctccaccttgtgctccgtctccgtggtggtcagtaagtcatgggtcgtttaagctgccgatgtgcctgcgtcgtctggtgccctctccatatgga

SEQ ID NO: 411 - DNA, 428 bp, Zea mays
  Clone ID: LIB3179-023-P1-K1-A2
ccagccacaaaaaaggacccaagatgcaggcgctgggcctgggccgcgggtgcagccccctccatgccagccactgccgctgcaccgcttcttcctatcctccggctccaccccgtcctcgcaatcgcaacatcacaaggctaacctgcatcgccgccgtgcgcgccagcgctgcccagtccgcgcagatggaacgcaggcaggaggcgaaggttgtgaagctgcgggcggtggaggccacgcccgagtccttcgcttcgttcgggcaggtcatcggcgcctcccccgacggggacgagttcggcccccacgacgcccagctcgatctcagccgcggcatcccaaggttctacatcatgcggttgcagaaccggccgctgaaattctttaccatcacccaccacgccagcgtgacccagtgcctgggc

SEQ ID NO: 412 - DNA, 115 bp, Zea mays
  Clone ID: LIB3179-023-P1-K1-A5
ctgagaagctagctagagctagctagctccgggcgcccgcagcatggccacgaacagccaccgcattattgcgcccggcctcctgctggtcgcggccacgacgctagtcgtcgtc

SEQ ID NO: 413 - DNA, 74 bp, Zea mays
  Clone ID: LIB3179-023-P1-K1-A6
tctagttttatccaagcttacgtccgcgtccatgcgaggggatatctctcctatcgtgtgacctaaattcaatt

SEQ ID NO: 414 - DNA, 304 bp, Zea mays
  Clone ID: LIB3179-023-P1-K1-C1
gcgtcttaacaataatgactgtgaaggaggagattttattttaaaccacaaatatttaaaaaccacaggcggtggactataatcatgatgcacctatcagacatcactgccataactaactacagcaagaaatatgcacccgcctctgacctatcgctttgttttcggcatagaaagaaacacacgccttgtttctttttcattagttgctctatgataacataaaccgtctgctttcatatgaagttactgtgaatagtgcagagatatcacatggacctatataagattcaatgaatattct

SEQ ID NO: 415 - DNA, 421 bp, Zea mays
  Clone ID: LIB3179-023-P1-K1-C2
ggttggactgttctaccatctgtataaccagtttgctacaaacaccttggagcgagtggctcctctgacacatgctgtcggcaatgtgttgaaacgtgtttttgtcatcggtttctcaatcattgtttttggcaacaaaattagcacacaaactggaattggcacgtccattgccatagctggtgttgctatgtactcttacattaaggctaagattgaagaggagaaaaggaaaaagagcgcatgactgctgtgaataatattatcgagacctttctcggacacaacatcgtcgacaatcacgacctacttctatatcttgttttgtttcatcttgagtcagtcggtccattgtttgtcccagtctggtgattaaaagtctgcaaattctgtttgtggattggcagcgatacaaatttgg

SEQ ID NO: 416 - DNA, 402 bp, Zea mays
  Clone ID: LIB3179-023-P1-K1-C3
ttcccctcaactacagggaaatcagccatgattgcgttgtcggcgaagccagccaccggcggcaagacgtcttggccggaggtggtcgggctgagcgtcgaggaagccaagaaggtgattctggcggacaagccgaacgccgacatcgtggtgctgcccaccaccacgcaggcggtgacctccgactttgggttcgaccgtgtccgcgtcttcgtcgggaccgtcgcccagacgccccatgttggctaggctagagcctcagcctagaggtcgtcggtaccgtcggccatgaccacctgctatatgtcactactagtaataaagtattaattacagggatggatgcatgctcatactttggaaatcacaaattactttccttttttttttcttttttctttt

SEQ ID NO: 417 - DNA, 436 bp, Zea mays
  Clone ID: LIB3179-023-P1-K1-D1
acgtcgaccattatgggaccttacagcaccgtcgtcgccgtaagcgcatcgccggtcctgcaggcttcctcactcttgacgcgagcccgtggttcttggaggcccacggtggcggcgttgcggctttctgcttccgtgaaatgccgtcggcgggcactcaccgtgacctgtgcgctcccggagaaagaacggccggcggcattcaacatcccgcccactgctctgctgtgccccgtgcccccgccggacggcaaggaacggtgggacatcaaggaggaagatgaccgcgtcacgctgtggctccaggtgccagggctgtcggcgagcgacatcgaggtgaccaccagcgaggacgtcctcgagatcaaacgcagggtcgttgccccacagcagccggcgcccgtggacgcgcacggcgtctgcgcgttccacatcc

SEQ ID NO: 418 - DNA, 404 bp, Zea mays
  Clone ID: LIB3179-023-P1-K1-D2
gggaaccaaacatgccttaatgcaatgaaatcgatctatactatacattacatggtacatacatacacagaaaagaaagaaagaaaaacagagaggaacaccccatctggttcacatggcagcatgcaaatcataggccgagcgcgccgagcggcgtcttgccctgcccggcctcgaagtagaaggcgagcatggcaagcatggcgatgcgggcgtgcttgatctcggccagcttgagccgctcgagcttgtcgacgtcggggatgtagacgccgtccttgacggtgccggcgaggccgagcgggtcgaagaacttgtcgtccgggtagccctgcttgccggtgaagttagcgaagttctcggcagtgcggtaccagggcgtggtccactccacggtctgggag

SEQ ID NO: 419 - DNA, 309 bp, Zea mays
  Clone ID: LIB3179-023-P1-K1-E1
gccaggccctcttggggcccaccgtgatcatttttttttagtccaccgccgccgctcctctccaggggctcaatgtcaccgccagcctgcccatcgcccgacgttcctccagaagccttggcaacttcagaatcggcggaaggatcctgtgcatgcacgagtggccggctctccgtaacaagaagttggagacgctgttttacctccctccgttgtctatagacggtctggtgcatcaggtcgactaccctgctgttaacggttggatactctacctacagttgagcatggtccgttttgtgctccgag

SEQ ID NO: 420 - DNA, 430 bp, Zea mays
  Clone ID: LIB3179-023-P1-K1-E3
gaaaaaaaaaactctgcggagattgaccgacttcttttaccgcctgcgttaccgcgccgccagccggatggttgtcgttgccccccatgcatactcctccctcgtgcctgtatcggttgcgcggtctttctccggaagcacagtttctttcggtgcttcgtgccacaagtggaggaaggttccggtatggcgactccactgtgttgctgaagacgaagaggaagtcaaagattttggagtcaatatggcactatccatgctaaaaatttacaaactagaaatatcacctttactaccttcaagctgccgatatgtaccaacttgcattgagtactctatgcaggcgttcaaaccatatggtgttgtaaagggttccatcttgactgtttggagcctttgccgttgaaatacttttggtggatatgggtat

SEQ ID NO: 421 - DNA, 438 bp, Zea mays
  Clone ID: LIB3179-023-P1-K1-F1
gtcagttgctgctccccccaccttctcctcctgctcctgccctcggtttctgatcagcgaacatgggaacccgcggcgtcgccctgctgctcctcgcggcggtgctgctcctccaggcgctcctccccgcgtcgtcggagggcctggtgcgggtcgcgctgaagaagctgcccgtcgaccagaacggccgcgtcgccgcgcgcctctccgccgaggagaggcagcgcctcctcctccgcggctccaacgctctgggctcaggcggcgacgacgactccgacgtcatcgcgctcaagaactacatgaacgcgcagtactttggggagatcggcgtcggctcgccgcagcagaagttcaccgtcatcttcgacaccggcagttccaacctctgggtgccgtccttcaagtgctacttctcgatcgcttgctacttccact

SEQ ID NO: 422 - DNA, 315 bp, Zea mays
  Clone ID: LIB3179-023-P1-K1-G1
cctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatattggtcgggctcggcac

SEQ ID NO: 423 - DNA, 219 bp, Zea mays
  Clone ID: LIB3179-023-P1-K1-G5
gagagcatgagagattattgtgtccacggtgtataattcaagcaattacatgatttgattatggggattatgctattacacataggatcgatgttgtgacgctagccagcacagtatgcagttttacagccttatttcacaactactacaaattaatcacacggtagctagcgcggtgcccttgagccgtccggtcctactcattttacctttgagacc

SEQ ID NO: 424 - DNA, 281 bp, Zea mays
  unsure (1)..(281): unsure at all n locations; Clone ID: LIB3179-023-P1-K1-H1
gcgtccggccgcggcccgttcggagaggttttcaccttngtaccctggcggcagcttcgacccgctcgggctcgccttccacccggaggcgttcccccagctcaaggcgaaggagactaagaaccgccccctcgctatgttcttcaagatcgggtttttcgtgcaagctattgtcaccggcaagggccccctcgagaaccttgccgaccacattcgtcgaccccttcaacaacaacagctgggcttaccccaccaacttcgtcccccactagtgagcaagg

SEQ ID NO: 425 - DNA, 82 bp, Zea mays
  Clone ID: LIB3179-023-P1-K1-H2
gcggccgttttagaggttttcttttttacgtccgcgggcatgcgacgggatgggttttttatagggtcacgtaaattcaatt

SEQ ID NO: 426 - DNA, 581 bp, Zea mays
  Clone ID: LIB3179-028-P1-N6-A1
ataaaaggaccagttattaaagtattgtcggcgcctcggcagttttgtatatatatctattacacattacacatgtatggtagccggagcttgcattcacatatatgttcctcacccaacgaatcgacagtcgttgcactacgtacgtaattgtagatggatgatgccatgctggatacatcagcaggagaattgttggaagcaaaaggaaccattgcatgcaggagaaaagaaatgatgagataaagggaaaaaaaaggagggagagagagagaggaaccaatgcaagaaggtgatccgatcaacaggcagaggcatggccatgggtcgatctagccacggtctctactcgctgccggggggcttgtaggcgatgaagctgacgcactgcgtctgcctgacgttgtcgaagccgatgacgcggtggaaggcgtccgggtacgcggcgatggcctcctgcagctccttgtacacctgcgtggcgtcggtgcagccgaacatgggcagcttccacatggtccagtagcggccgtcgtagtagcacggggaggtggagttctcgcggtacacgaaccccagct

SEQ ID NO: 427 - DNA, 485 bp, Zea mays
  Clone ID: LIB3179-028-P1-N6-A10
ggactcaacttcttttaagtggtcacgttgtaacaaactttacggacattcaatattttagtttttggggggtttcggcaacatttttttcacgaaacaaacaaaaagggttttttttttttaaacttttaaaaaggggcaatccggggtttttgcttatttgccattgccttttttttgcaaaagcacgttggacacattactttttcaggttcaaaaaattttttacacctttttttttttggccaattttttttccccaattatgaaaactggtttgggttcaataacatcccacttgcaaaacagggggcacatgggaagtccccagtcccatgggaatttgtgcattttttttttttttggtggctgacatttttaacttggaccaaattttaagctgggttaaccccaactgggccccctgtaaatgttgccccttttgggtctacccgcctcaattgaaggggggagggcaagggcct

SEQ ID NO: 428 - DNA, 54 bp, Zea mays
  Clone ID: LIB3179-028-P1-N6-A11
cgattcttacccatttcttcaaaaaatggaaattgttgggcgcgccgttttttg

SEQ ID NO: 429 - DNA, 411 bp, Zea mays
  unsure (1)..(411): unsure at all n locations; Clone ID: LIB3179-028-P1-N6-A2
tcgcggaggttgtccacgacgaggcacacctcttcctcgcggccatggcggaaggagtagaccttcttgttgctgagcaggtgcgtgttcatcagcttcctggtctgctgccagttttcgccgagcggcgagaaggccacgtcgcangtgttgtagcggaggatgtgggaggccatggaccaacggccggaccgcgaagatgtggtcgtgggtgcgcttcacggcctcggcggccctgggcgacgacacgatcagggtggccacggccccggcccggaggaccaggaccccgtggtgcccgtccttggccaccagctcctggaccgagatgtgggtctggggcccgatgtggtgtaggtgccccacgagggggagggtgcccggcggcaagggagggagcggcggtttgcc

SEQ ID NO: 430 - DNA, 229 bp, Zea mays
  Clone ID: LIB3179-028-P1-N6-A3
aaacaagtccatccaatgggctgggatattaattaattattacaaaacagcatgcagattgtacgatgcttattattacaatatgtataatatgccaagattttccacttggacttgacaacaagagtgaatataaagaggcaggaaattacatatgcatagggaaaacagacgctgccagttcggcatttccatccaaaactgacaaaacgccaccatccggaagctg

SEQ ID NO: 431 - DNA, 275 bp, Zea mays
  Clone ID: LIB3179-028-P1-N6-A4
ggccccacttcttaactgagcattagcagttccagagtaaaaaatgttacatacacaagacatttgcgatgttgttatataatgatccaaacaggacgtgtcccgaaagatgaataatcatcccagacaggttcttgaatcgtatatatatatcacatacttgaagatacactccagatatcctgaaaggtctacgggacaagcaaaaacacaattgacacgaaagataagacatcaacaaaaatgcccgcctttcatctgctctctaaaactgc

SEQ ID NO: 432 - DNA, 265 bp, Zea mays
  Clone ID: LIB3179-028-P1-N6-A5
ggagaaaaaaagcgacagcccgaatttgcattaacaagtacattacatacacgattcctcctttgctctccaaagttttccatggtttacatacaccttgcgaagatccatgacgggggggggacacctagcagttagacactcgaatcactcgagctgagcgtaccagaccccctggatcttgacatccttgggcgccttggcccctaggtcggtgtcggacggttgcacgctttcgaagaccccgatgacctcgccggtctcc

SEQ ID NO: 433 - DNA, 467 bp, Zea mays
  Clone ID: LIB3179-028-P1-N6-A6
tttttttttttttttttttttttttttttttttttttttttttttttttttttttttttttttttttttttttttttttttttttttttttttttttttttttttttttttttttttttaaaaaaaaaaaaaggggggggagggacctttttttaaaaagggggggggggggttttttttttttaaaaaaggggtggaaaaaaaaattgggaaaaaaggttttttggaaaattttcccaaattgggggattatttaaaaaaattcgggggggccgaaggtttttcaaattttttggaaaaaaaaaaaatttttttttttaaggggtgaaaccctttttggggaaggggggttcccccggaattttcggaccggccttgtaagggaaaaaattttttttattggagggtgttttaaaggttgggaaaaaaattagaaatagcttttttttggaaaaattttttttctc

SEQ ID NO: 434 - DNA, 106 bp, Zea mays
  Clone ID: LIB3179-028-P1-N6-A7
ggaccgaaaacatctcatgtgattagaaattagaagagggaaccaaacaccccttggtactcgggaacagacatcaggaaaaaggggtacacccggtacacaaaag

SEQ ID NO: 435 - DNA, 211 bp, Zea mays
  unsure (1)..(211): unsure at all n locations; Clone ID: LIB3179-028-P1-N6-A9
accggaaaaattttccatgggtgggttataaaggggggcagggaaaaagggggttttggggnnaaaaaaaaaatgccccgcaagggggtttttacaaattccgcttagattgggggtaatcaaaaaggaatgctgggggaaatccaggtgggagggggaaaaggggcaaaaagtgggggggccaaaagcagacttagcatggggggggggg

SEQ ID NO: 436 - DNA, 552 bp, Zea mays
  Clone ID: LIB3179-028-P1-N6-B1
caggtgggttctacccaacgaaatcttttcatgagcggtagagtagactgaacatccacacaatctcgattttacatttctgtgtttggttgcctgtgggagcagaaacaggctctgcacatgtattgatcaagtatcggtctgcgtttgattgtttgtatgggacaaaaaaaacaaggcctgcatgtgtggatctgcaatccaagctaaatcaaataactttgccttcatctatggagacgcaacctagacgtgtggggccaggatgcagctatcggtatatgcgcgccggctctcatccaatcaacacgtactactggctcgaccaggcatcacgagaccttgctatagggttggccgtcatggcgaccctctcagcgaagtgcgacgatctgctcgtagaggtccctgatcttgagcccgacgatggtctggaagagccccgtgccgttgttgctgccggggacgtcggcgtgcctgagcatctggtgcgtcaccctcccgtagaacttggttgacaggttgctcaggtgggtctccacgtagatgagc

SEQ ID NO: 437 - DNA, 453 bp, Zea mays
  Clone ID: LIB3179-028-P1-N6-B3
ttgaccggtttttttttttttttttttttttttttttttttttttttttttttttttttttttttgggttttttttccgaaagaaaagaaaaagggttaaggcttgggtctaagggacaggggagggaacaaaaaagggggcttatttagggcgggggggggggagctttttaggtgggggggggatccaatcccatggaagaaacaatattacgggataaggggacgcggaagggggggggggccttttggactcccttgggggggcccttgaaccacctttgggggccggccggggcctggaaaaagaaaagctgggcgacggagacgggggccgaaaagggggggggcttggcgcccccgaagcggtccggcggccgggggggaacggacacggtgtaatacggctgggcgaagaacaagggggggggggtcccaaggacgtgggggggg

SEQ ID NO: 438 - DNA, 177 bp, Zea mays
  Clone ID: LIB3179-028-P1-N6-B4
cgctcaaactcaaaggggaaactttgcttcttatctttttttttaaggatcgacgaatcaaatgatatttttgttctaatttctgccgcttcttctccctctgaatcaaacttttttttttgcatttttgttttttcgctcaaactcaaaggggaaactttgcttcttatctttttt

SEQ ID NO: 439 - DNA, 594 bp, Zea mays
  Clone ID: LIB3179-028-P1-N6-B7
gcaactccataatgttaaaaaggttataatacaatgtcaataaaagacctaaagctcacatactcagcaggcctctctagctagtttaccatgcagtttgcaggttgcagctcaccaacatactagggttaaccgtcaataacaaatagaacgaatgttctagaccatacaacaaccaacgccggatccaaccaagggtccgcgactatctcatctcatctcatctttcccctgtccggaggtgaaagctagcagaagataccggactccgccagcgaaggcgcatggccttccttcacgcatgcccatggcgttcccatgacgacggggccagatatgggagcatagttgttttctctactgtcctgttttcgcacgcttcatgccaccgttgctgaatggagagacactccccggatgagggctgtcctctctcagggttgagttcagcattgccagctccctgagctgctgccttttgtaaagatcttgggactcgtccactggtttaagcaattcttctataatcccctgtgcttggctcagccttgcatcgatgatactggcagggaactcggcctctatcaagatatg

SEQ ID NO: 440 - DNA, 530 bp, Zea mays
  Clone ID: LIB3179-028-P1-N6-B8
gcacaaaacaaaacccatcgggacagatgatatatactgatgaaacaatctctacaccctttatagcctccgcttcaactaatgtacatataccagtacgtcacattccttagccctgagtcgattaagaacgcatcacacgaactgtcttcgagtctcggcctttcagctcggaccacatgacctgatggaccgtcgactcaacccgacagggtctggatgatggtgttgtgccatgggtcggacaggtgctgcagcaggttgtcgaagggccccttgccggtgacgttgtgctggatcaggaaggccaggaacgccagcatggccagcctcccgttggcgagctccttctccttggcctcgagcgtgggcgcgaagttgagcgggttgaagacactgccggggtagccgcactcgtgcgggggcaggctgtagctcttgaagatggggtcctggttgacgcttccggggttcttgatgtcctgccaccgccggatctccacgtagtgaaacaggatgaactcgatcac

SEQ ID NO: 441 - DNA, 383 bp, Zea mays
  Clone ID: LIB3179-028-P1-N6-C1
atattatattttattatgtatattatgttagtatggaaaataacaccatatagaattctctctacagagattagacttataacaatacagttccaaatgggacaaatgaactgaagacagcctaagttctgacatgcctgcctccttaccgacctgctcgattacagcctataaaactctgcaacctgcaaggccctgaatctatacatacagttccccttctccggtgcacgttatacaacagcacggcgcatgtgtctgtgtgcacgcacaggcatgagcatccacctacaatgccgcggcggtggcggcgccctcagcctccggcgccttgctcttcttggcggcgtcgaggaacccgacgtacaggtccgagtgccccg

SEQ ID NO: 442 - DNA, 556 bp, Zea mays
  unsure (1)..(556): unsure at all n locations; Clone ID: LIB3179-028-P1-N6-C11
cgcggggcaatacacagctggggtttctgttaaatgatgaagcactgcccagaatgcagatcacagcatatcacaataaacacagccgagtgtagaatatggttaagagtaaaaaactttagggcttgtttggatactcctatattcaccttaatccatgtgtattgaggcagattggagtgtaaaatagtttaatttacgcctcaatccacctcaatatacatggattgagatgaatacgataatattcaaacgaagcattagggggaaagcttccagaactaacagccgacctgagtgttctaagtttccttgcagcacttagcactagtgtctaatgcaatctggccctcaaatatgttaacttacaccacattcactcttgcattgcctctacctcggcctctgcctccaccgcctcggcctctgcctctgcctctgcctttgctgtctccacctctgctttcggaggggctggcaaaacctcctttaccatatcaagaaactcctggactcgttcatcttcatcacatgctntttctcgttcatccctgga

SEQ ID NO: 443 - DNA, 576 bp, Zea mays
  Clone ID: LIB3179-028-P1-N6-C12
aggaaacccaatcaggtaaattcatatccatttgttgagataaggaaatgtgagtatgtgagtggcatatgactcacacgatacactagcatatggtacaagtacaacaacttttccgcacatcgagattgtgcaaaactaatattaagattcaaacaggaaatgtcataacaaatattgcaactgctccatgaacacagcagcctactgttcctccttcatagcctcttgaaccgcctttagaactagtggcattaaatgcttgtttgttgcaataattcctctgtcacgatcaagatatctacctttgcaaaaatccaaatcgtttcctgcggcatcttttaccatgccaccagcttctgtgacaataattgatccagctgcatgatcccaaactgtttctatgtaacttttgtgcgggatgcgcagaaaaatggcaccatcaccacgtgctagggcaccatattttgcttggctatccattctaacaggaggagctcggacaccaagtttctctgcaatggagctagttaaatcacgcttggagtgtgatgcttcaaaggattcaaagaatga

SEQ ID NO: 444 - DNA, 360 bp, Zea mays
  Clone ID: LIB3179-028-P1-N6-C7
tctccgtcgtcgtccggtcggcgcgggtgtaggggcagaagcagatgtcggactcagggaagcagattgggtgctcgcaccaccggagctgcttcttgtcgtccgccgccgccgccgaagtagtcactcctctttcgccgtcgctcggaaggcggacgatggcgccgccggccggggcgtcgggtatgacgcggacagcgtcagcgaaggtggcttcaagggagagcaccagtaggacgacgatgacgctaggcgcaatgcttctcttcatggaggacatggcgcgcgggcgcggctagctagacaagaagcttcttcgtatcggttgtgttgtgttgtgtgtggttgactggttgtgat

SEQ ID NO: 445 - DNA, 590 bp, Zea mays
  Clone ID: LIB3179-028-P1-N6-C9
gaatacgatacaacaatactgcgaatctctcagcagtttcagtacagagtcgaaaaggggggaaaaagaaagaaagatatcggacgaccaaactagtaaaagataacagatcagcacataataatgctggctgctgccaagccaaattatacccaatcactaagccggcatggcatgggttgcagttgcagcggcgattgccaaagcccttcatcatccttctctccgttcatcttctatggagcagcagccagtcactgatcaaacacacacatccagcagcagcaatgcttgcaggtaacagcagagccagaggaaggtagtcctcatgtccacagtgacactcccaaccttaagccgatgccttgtcgaacttgaggggcttcaccacctcccaggtgaagtcggcgtcgtcacggccgaagtggccgtaggcggcggtcttgatgaacctgttgccgcccttcttcaggtcgaggttgatgctgatcatcccgggcctgaagtcgaagttctccttcacgatcttgaggatctccttgtcggggatcgtgccggtgccgtacgagttgacgaacacggacaggggc

SEQ ID NO: 446 - DNA, 183 bp, Zea mays
  Clone ID: LIB3179-028-P1-N6-D10
gagtaaaaaagcgacagcccgaatttgcattaacaagtacattacatacacgattcctcctctgctctccaaagttttccatggtatacatacaccttcccaagatccatgacggcggtcggacacctagcagttagacactcgaatcactcgagctgagcgtaccagaccccctggatcttg

SEQ ID NO: 447 - DNA, 538 bp, Zea mays
  Clone ID: LIB3179-028-P1-N6-D11
ttactgggaatcgaaatcttagattgatctaaagattattttgatttctttactatatttagtacaattgttatattacacatcgttttttttatagaataactacgtcctcgagctcgaggtctgaattttttcataatagtactcctactgacttcggctttagtgatgaataaattcgttttgtcgaaatccctataatgagtagcatttgctgctgccgaataaaccaactttaagatgggatacgatgctcgataaggcatgagattcagtatcataacggtttcctcgtagtaacgccagcgaatctcatctagaactctttgtgctttgaaaacagacatatgtatgcgtttttgtgctttgaaaacccgttcgaatttaagtagacgatcggttggaacttttcttgcgagttttctcagccccttcttcttctttatcctaggggtatactttaccaatttgaaacttgtcataaataagggtattacccgcctacctttactttatttgattatttgaatcctataaa

SEQ ID NO: 448 - DNA, 544 bp, Zea mays
  Clone ID: LIB3179-028-P1-N6-D12
gtcggcgacttgggccgcgtcagctcgatggccagcggcatcatgcgtgcccaggtccgtcaggaagaagatggtgcgcgaggcgtagagcgtcgcgtcctgcagctcccgcaccttgtgcacgtagggcaggaacacgtcgtggtagtccaggatgaacagccgcttcgccgccagcgcctgctccacggtcagcgcgccgttcatctgcttctccaggatctccttggtgatggcggactccgctggcccgtacacctccgggtccagcttgctcttgatggggaactcagtcagcagctggatgcacagcgggttgagccccgcgatcgtctgcctcgcgaactcctcgtccttgaaccacgagaaccggtccctctctatcatctccggcacctcgaagcggaggacgtggtcggtggtgtcctccaccagcttgaccatgcgcgggacgacggtgcggatggcgtcgaacccggtctgcggcggcagcgggatgccgtcgctgtagagttcgtcgatggcggggaagtgcgggaagcgc

SEQ ID NO: 449 - DNA, 247 bp, Zea mays
  Clone ID: LIB3179-028-P1-N6-D2
atattttttttttttttttttttttttttttttttttttttttttttttttttttttatttttgtttttttttttttaggaatagtaagtataataaaagggagaaaaaaaaattttttttgcttaaataagggggggggggggaaatatttttttataggggaaaaaaaaaaaagggagaaaaaaaaaagggaaaaaaggttttttaaaaggagggggagaaaaaaaaaaaaaagaaaaaaagaaa

SEQ ID NO: 450 - DNA, 416 bp, Zea mays
  unsure (1)..(416): unsure at all n locations; Clone ID: LIB3179-028-P1-N6-D3
aaggacaacaagctcaagtaggaagtatgaaaaaagtctgatcatttttaatgttgcggatggtccatccagagttcaagtcctctactataggatttttattttttactnccggactttttcaaacaagttcagtttaatctagatacaataggagtcacacaagtctccgcattagggtcttttatcggagtccagcgcaaggcagtcttgttacactagattttagtacatcacgggcaatgctcagcatcacaagctatataatcatcacaaagcatccatccttttgtctgcttttatcttcctaagtggcagcccggattacggcaacagaaattcctttgttccatggaataaggtaggctgacagctacccactgattatcgcttgatgggaagcacggccgtgcctt

SEQ ID NO: 451 - DNA, 151 bp, Zea mays
  unsure (1)..(151): unsure at all n locations; Clone ID: LIB3179-028-P1-N6-D4
aaaaattatttttttttttatttttatttttaaaaaattattttttaattttttttttttttttaaaaaaaaaaaaaaaaaaaaaaaatttttttattatttttaaatattnntaatnatnaaaaaaaaaattaatttttttttaaataaa

SEQ ID NO: 452 - DNA, 398 bp, Zea mays
  Clone ID: LIB3179-028-P1-N6-D5
agcagcaggtatagaggtagccaatgcaaggccatgcttgcaacaatggatacatcacatccagcagagaaaactggaaagcaaaggaaccatggccggggaaaagaaaaaaaaaaggaaaaaggaaagaagaaaccaagcaagcaaagggttcggtgaccccgaagcaaaaccgaacgacagagacgacgcatggcactagctagctactagctcacgcaggagctatagctagccggcggggggcggccggcgggcgcggtctaatcgctgcccgggggcttgtaggcgatgaagctgacgcactgcgtctgcttgatgttgtcgaagccgatgacgcggtggaaggcgtccgggtaggatttgatggcctcctgcagctccttgtacacctgggt

SEQ ID NO: 453 - DNA, 141 bp, Zea mays
  Clone ID: LIB3179-028-P1-N6-E1
aaaaaagggcccccaggttttttttttttttttttgggaacggggtttttttccaaaaaaaaaaaggggggggggggggttgaaaaaccattttttagttccccaatttttttccaatcatagaaaataatgtttaaatgg

SEQ ID NO: 454 - DNA, 120 bp, Zea mays
  Clone ID: LIB3179-028-P1-N6-E12
ggcagggaaaaaggcatcgttaatttctgacgagaaatggcattccattttccattcagggaaccaacccctccgaaatagccaaatgggcccggcataaaaagcccccccccccatttt

SEQ ID NO: 455 - DNA, 416 bp, Zea mays
  Clone ID: LIB3179-028-P1-N6-E3
aaacgttggaaaaaggcggtttaagaaaagaggaggaagaaacaagaagacaaaaaaagggacaaaattttggggttttttcacaaggggggttttacaacatcttttaaaagagaaccagaaacagaacaccataatgagcaccaagatactgttttgcagaggatgggccagtagaggagccgagtattagggggccacaagcattggccaacaacaagggtcccattacaaactacagcgaactgacaaccaaaatgaaaaaacgggggaaaaaaaaaaaatgaactaaaaggtgattccaaaaaaaaggggccggaaaaaggtggccggccggagtaagcgaacgaaacttgcaagataggagggggttaaaagggtgggggaatgaaggttatttgagatttctggggaaa

SEQ ID NO: 456 - DNA, 547 bp, Zea mays
  Clone ID: LIB3179-028-P1-N6-E5
tgagctataaaaacactacaaaagcatcaatactgcaaccatctcaaccctgacgagaaggcactgactttttttataataaaaagataactaaggactgtctagagtctatttccagatattatcgtgcacattacaaaccaatttcggcaaaacgtcacacagggagtgagtggtaggcagcaagcctggataaggaggtccaccaatcaacacataagcattgccgcctacccatatccagcttagccatcccgttccttctttccatcagtactcggacggtgagatgacgtcgtcgatcttaaggatcatcttaaccacctgggtggcaagcaagatctgttgctgcttgccaatcagggtctcgaagacgttctgttctttcatgtcggtggtgccaacgtcgttgcagtctatgccgaagtgggggttgctctccttgacttgttgagctttaaccgcagttaaggtatcaattggggacaaaccactgttttcggccaacgctagtggaacagcatctaatgcatcaccgaatgacctg

SEQ ID NO: 457 - DNA, 341 bp, Zea mays
  Clone ID: LIB3179-028-P1-N6-E6
aacccaagggaattcgatcgattcatcattgaacaacaaggcaattaagataagacgctgctggcgtcgatcctcctctctgcttgccgcactcaggcgtccacgacctcgtcgtccttgtacgcaatcatcaactcctcgcgcaacggcggcgacatggtcccgtccacggcgttgggcctgcccagggccttgagcgccaggtgcgccgccttctggccggagatcatcatggcgccaaacgtcgggcccatcctgggggcgccgtcaatctcggcgacctccattccggtgacgatcatgccgggaacgacctcgcgcgtgaggcgcacgatctcgtc

SEQ ID NO: 458 - DNA, 476 bp, Zea mays
  Clone ID: LIB3179-028-P1-N6-E7
ggcatgggagttgctctaaaccttgggattaaatcttggaatttaaaatatactcagtttggaacagagaaaagtacatacatgcatgcatgcatgcatttttttttagctagaattattgagacgacacgttttattgatctcctgcgcgggcggtactgcatgtggttgcacaagacgacgggccctggcggggtgtagctagctagaattataggagggcatcctccttgggcgtctcgatgaccacctcggaggtggggtacccagcgcaggtgagcacccagccgtcggcgacctggttgtcgttgaggaagctctggtcggactggtcgacggagccggagaccaccttgccggcgcaggaggagcaggaccccgcgcggcaggagaagggcaggtcgatgccttcctcctcggggaagtccattatgtagacgttgtggggcacctgcagttccaccttccccttcggg

SEQ ID NO: 459 - DNA, 371 bp, Zea mays
  Clone ID: LIB3179-028-P1-N6-E8
aaaaaaagcgacagcccgaatttgcattaacaagtacattacatacacgattcctcctttgctttccaaagttttccatggtatacatacaccttcccaagatccatgacggggggcggacacctagcagttagacactcgaatcactcgagctgagcgtaccaaaccccctggatcttgacatccttgggcgccttggccccgaggtcggtgtcggacggctgcaccctcttgaagaccccgatgacctcgccggtctccgggttgctcttggggaccctcaacgtgatgttgccggtggaggaggcggcgttcttgatgttctccttctggagctcctcctcgtcacctttgcccccgggggggagcgc

SEQ ID NO: 460 - DNA, 456 bp, Zea mays
  unsure (1)..(456): unsure at all n locations; Clone ID: LIB3179-028-P1-N6-E9
ggggggaaaaccaaaacctgtaaagatgggcaaatcgggggggtacaaagcaggaagcaacagctaatacatgaatgggtttcgaccgatagctagcttaattaggggacggggattttgcccaccattccgggttcttgatgggggttgcaaaaaaaaccctaggttccccgcccggggagggggaccgaataggtttcccccggccccttgagggaccccccccgggaaaacttggggggggtaaccccccttggaaccctttttttgtaaaaaaccaccttgggcgggaagcccgcgttgtttttgaaagggatgggggcccccgccttgacgggaaaatgggtgggcttaaaaaccagccccccgttncctggccccaagaaaaccttctgggccatgggacccccggaaagcagggcgctggcaacacttgccaccgggggggggcccggg

SEQ ID NO: 461 - DNA, 381 bp, Zea mays
  Clone ID: LIB3179-028-P1-N6-F1
cccggggccaaaaaaaaaaaaaatttttttaaccggaaaaaaaaaaaaccaggggggttttaaggagaaattttttaggggaaaggggacggttttcaaacaggggggcctttttcccaccaaggggagggaaaaaacctgagaaaaaaacccgggaaattcggggcggggcccgggaggggaaaaaattttccaaaaaggggggggaaaaaaagggggggaaaaaaaaggaaaaaggggttcccggggaaaaaaggttaccccttaaaaatcccaaaaaaaaaacgggcgggaaaaaaaaaggaaaaagccggggggcccaaaagggggaccaaccacaaattatttggggcccgcaaaacgccccatttaaaaaaggaa

SEQ ID NO: 462 - DNA, 574 bp, Zea mays
  Clone ID: LIB3179-028-P1-N6-F11
attttctcttgtttttctttatttgtttttttgccgtgatgtaatgtaacgtaaccgagcactgtcacttgttgaccctagcggtatcctctatattacccccatctctctgttttacactgtacagtacagatgctcttggtcccatgtatagggatgaccactcggtcggtctacatcagctggttccccacggggtcaacggtgaagtgcaggtgcagggatctctccacgatcgggcggaacttggacgcccacatatccttgtactcctcgctatccatgatgggaaacggattactgcagcatgactgtactcgttatccggacgatccaaacagcagccacatgttgcctgcacaatagaagcgctgcattggctgatcaacttgtcaagagacgctaatgcgtcctccgttgcctctctagacgcagtcttcaagaaagacaccagcagcataaactcgacgccgtagttaaaatcctctcccctgcgaaagagaggtataatgtcgtcttccaccttggactcgaaatctacagaaaccgagccgtgctcgtcgacaactttgga

SEQ ID NO: 463 - DNA, 513 bp, Zea mays
  Clone ID: LIB3179-028-P1-N6-F2
taacccttttttttttttttttcagcacgcgttcttacatcacagagggggtggtaagtaatacaacctgctgctccgaaccacacctagtacacgtccgctaactttggcatgcagggagtacccaaaaaaacaagaggaggatttttacagtggagtggacacacccaaactgacgaccggccgtggcccgacgcgacgagcagtcgatcgttcgagcaaaaaaaagcggagtggctggtgcaacttgcaagcaagaaggcaagggagcagcagcgcactagtattagtatggtacagcagcacgtcgtagactcgtacatgtgcacgtcgtagtatataggtgtataggtacagtacagtacagtccgtgcggggcggattgcaggcagagcaaaacgagcaacgccggcggtacggtggcctctcgccgcttcacttgggtccccagaacagcaggtgcatcaccttggccgtcttgccgtggccgtggaggtggtcctcgcgcccgcg

SEQ ID NO: 464 - DNA, 516 bp, Zea mays
  Clone ID: LIB3179-028-P1-N6-F4
atacacgtacggcgccgtctttatttgctatatagatttgattacgcaacagtcgacaaactttgaaggggaggacacgattacacgaaggggcttattggaaagttgaaataagaagacaaacgacaagttcacaaataaccaatcgctggacgacagtcgtctggccctcgtttcttaacttcacgtacttgcttataattaatcaaatgacatccagagaaagcgcatcacgagcaggcactggccaacgacctccacatctgtcctccataatgatgcaaccggcattactcgcacagaacccaatattgtcgacccaacccgagtcaacgcagcgattaaaatggtattttccggtggcggtttcgcagcaccatttgcctctagcttcagcctgctgggactgctcaaggacaagacccaggacgagcacgatggcgacgaaacagcacctgagctgccctgttttgccttccattattgagacgaagacctgttcttagctggtgatgc

SEQ ID NO: 465 - DNA, 502 bp, Zea mays
  Clone ID: LIB3179-028-P1-N6-F8
gaaactaaaaagtttttttttactggacatgttgccggaatggccatgccacgaaatgtaattacaagcaggattagctttatcattattgcaacaagaggcaccttattccttactcgaaaagtcgaaagtaaacgaagctagcgcacaagagcacgaaatacttcatggtagcacagctgcactgcacaggtgcatgcgcgtccttccctaaacgcctcagtgccccgagagcacgcttggaatcgcatcacatactggcgtcgtcgtccgcgtcgaagagcatccagatctcgttgaccctgccggtgaactcgaagggcgagttgtactgcgcgacggtgtagggcgaggccgggtcggccctgcgcgcgtcgttgacggcggcggcccaccgggtgccctggaggctggcctcgagccgcgccgcctgctcgcactgcttctggtggatggcaggatgagggggtagcggagtgagatgaggtctggtcggacgcgt

SEQ ID NO: 466 - DNA, 481 bp, Zea mays
  Clone ID: LIB3179-028-P1-N6-G5
gggccggggcaccaacaacaacaccccggggggggggccaaaaagggggggggggggcaagccatgcccccccgggcccggggggggccccggggattccgggccgggccccggggggggccccgctttccccaaagggggggggataagggggggggggaaacaggggcaaagggggtccccgggggaaaaggggatccccccacaattccccccaaaaaacgggccgggggcaaaaaggggaaagccgggggggcccaaggggggggcccccccccaataatgggggggggccccccggcccctttccaggggggaaacccggggggcccgggggattaaagaaaccgcccacccgcggggggggggggtttgggtattgggcccccgggggggtttttttttcacccggggggcggggaaccgggggtggcccctccccccccggccccgaaagggggggaaaaaggggccccccccg

SEQ ID NO: 467 - DNA, 542 bp, Zea mays
  Clone ID: LIB3179-028-P1-N6-G6
ctggaaaagccaaaacctcttataatttggaactgaggggatacatcagtaaggaagatgagaaatgcatcattaagctatactttgacatttcgcataccaagcacatactccaaagttaaaaatctaatgactggtgaaataaattatcgaacaaactcatcatcagagtcatcataatcactgtcttcatactcctcactctctacctcatccacagatgcattcatgtcagaagaatcctcaccctccatttcctcaaccccaattgtatcatacttcatgcgctcatcaaatttggcatcagaacagttaagaagccatgcaagggagcatgtgaggcccttccgggacaccatctcatgccgaggcctcacagtcgactcgatgccatatgtgaagaatgcgggaaactcaaccagctcctccaaatccctctccatctcattcttgaagtattcaaaattcatcctcattatatctatatttagtgcgagcagttgggggcatgccacaaccattttgctcacttgagatagcat

SEQ ID NO: 468 - DNA, 288 bp, Zea mays
  Clone ID: LIB3179-028-P1-N6-G8
gatgattccaaacaattgtcttctttctcgtaatgattattgaactctcctaagaacctccaacagaaacaaatgaactcttccaccacgtgaacgtggaatttctataaatgtaaaaaaaacaaatcaccctagagtccaaaactgcagtcataaaagaaattccaggcacgggttttctacgacttttgctttgatttctgcttcttcaactccaatgttgcccccaatccaactggttggttggcaggtgcaggtggcacgttgatatctgcagacttcgcatcg

SEQ ID NO: 469 - DNA, 414 bp, Zea mays
  unsure (1)..(414): unsure at all n locations; Clone ID: LIB3179-028-P1-N6-H1
ttacccttttttttttttttttttttttttttttttttttttttttttttttttttttttttttttttttttttttttttttttttttttttttttttttttttttttttttttttttttttttttttttttttttttttttttttttttttttttttgttttttgggngttttttttttgggggggatttaatantttttttttggggggggggggggttttttttttttaattttttttttataaaggttgggggggagggagaaaaatatgggtttttttttttttttttaaggttttgggggtttgtggggntgtttagaaaaatatttgggntatttttgggtttttttttgtgggtttttagattaaggggtgggagaatgattattttttgggtagttttttttttt

SEQ ID NO: 470 - DNA, 324 bp, Zea mays
  Clone ID: LIB3179-028-P1-N6-H11
ttacgaccaacacgagcaaattgcatcgcaccactatatgtttactaacgcaaatacacactatgaagcttttattacgtgaattctgttttgatgcaaatggaagtaaaactcatagacctcacagtagaggcctattgatctcattcagcttgtagcagctactgcatacatcaaagaactgtctaaagcacactattactcaccatttgccaacactggtgtagattgctttttggcatactttctgctctcactgcggttggtcgtcttgtctgtttttgtggccgagtggatgcccttttggctcaggaaactcggttg

SEQ ID NO: 471 - DNA, 523 bp, Zea mays
  Clone ID: LIB3179-028-P1-N6-H2
taactttttttttttttttgaggcaatttgtaggctaggagtaagagatggaataaagcaggacagcttgtgttttacatccaaattattattatccatcacatctggcaggttttttttttcagtaggactcaacaccagctttttcagtagatctgcagttgacgtctaaccacacctcattgacacggccaatgatgcggaatggactgctgtactgtgcaaccgagtaagcgctcttgctggagtagtctgtggagttagcccatggtgaccggctcaggctcatggcgagcttctcggcttcctcgaccacgttcttgtcccgtgcacgacccgagaagctcctcgctgcgacgcagtggcctggccaccgatctagatgcaggttcagctctgggagaggaaccggaggggaagcctggaacttagccggcaggtacagccggacggagtaggccgaggagcgcataggccctgctcctggaaccacactcgtgagcacaggggtggtcatcctgat

SEQ ID NO: 472 - DNA, 280 bp, Zea mays
  Clone ID: LIB3179-028-P1-N6-H5
ttttttttttttttttttttttttttttttttttttttttttggggttttttggtaagttgggtttgtttttgttaattttggacaggggggggaaggggggggaaggagaaaaaaaaaaagggatagtaaaaggggggggggaaaaggaaaaaaaaagaagggggaaaaaaaaaaaaaaaaaaaaaaaaaaaaaaaaaaaaaggagagggaagaaaaaataaaaaagaaagggagggaaaaaaagggggggaaataaaatgaattggggggggggaatt

SEQ ID NO: 473 - DNA, 437 bp, Zea mays
  Clone ID: LIB3179-028-P1-N6-H6
aaaaaaaaaaaaaggggggggggggcatttttcccgttcagaaaaaaggggggggggggaaaaaaaaaaaaatttgaaggggggaaaaggggggggaaaaaaaaaggggggcaaccccaaaaaaaagggggggtttcgcccgggggccccttaaaatgggggggggggtttttgccccaaattcgggttttttggggggggtcaaaaaaaaaacccggggtcccccccccggggggggggcccccccccgggggtccccccggaatttccggcccgggccccgggggggcaccaatttttcctaaaggggggggtaaaaaaggggggggaaaaaaggggaaaaagggttcccgggggaaaaaatttttcccccaaaaaaaccaaaaaaaaaaaaggcgggaaaaaaaaaatggaaaaccggggggccctaatggggg

SEQ ID NO: 474 - DNA, 433 bp, Zea mays
  Clone ID: LIB3179-028-P1-N6-H7
gggaatcaaaaggtccccaccccaagtatatataggggttgcaaaagttttggagcagggttagagggggccaatgcaagggcatgattgcaacaaggggtacatcacatccagcaaaaaactgggggaaaggaaaggaaccatggccggggaaaagaagaaaaaaaaggggaaaaggggaagaagaaacccagccggcaaaggggccacggggacccgaagcaaaaccgaacgacagaaaccacccatgggactagctactagctcacgcaggagctagcttgctagctagcccgggggggggggccggggggcccggtttaatccctgcccgggggcttgtaggcgataaaactgacccactgggtttggttgatgttggcaaaacccatgacccgggggaagggcgccgggtaggatttgatggccccct

SEQ ID NO: 475 - DNA, 554 bp, Zea mays
  unsure (1)..(554): unsure at all n locations; Clone ID: LIB3179-027-P1-K6-A1
cccagcgtccgcgcttctcctgggattgtcgacacgaacgttgcaagagatcttcctaagattgtcgtagccgcgtaccatttgattccctacttcatatttgacgctcaagaaggttctaggagtgcactgtttgcagcatccgatccccaagtcccggagtactgcgagacgctcaagtcggaggactggccagtttgtgcctgcattaactatgactgtagtccgatgaatgcgtctgaagaagcgcacaatctggagacctcgcagctggtctgggagaagacactggagatggtcggccttccgccggatgccctggagaagctcatcgccggagaatcagttcagtgccgttacggacaacaggatacaacttaactttttagttagcagnttagaggtggtttgttcggttgttatgncattttgatcctaaatttgcagggaggaaaacacagggaagggagnaaaaagaatntgttgacagctcccccattatttgactattcctaatcaatnatatacttgagacagaaattaagagataaaaa

SEQ ID NO: 476 - DNA, 527 bp, Zea mays
  unsure (1)..(527): unsure at all n locations; Clone ID: LIB3179-027-P1-K6-A10
cccggggtcgctgtctgcttcggcgccaccgccgccgccgcttcgtctccccagcagctttggcgctggtggtcgaccgtggaattgctgcgactccgctatcaaggacgcctccctgccggcgtggcgctgcaacgacgtggtggacaagtgctccgccgactgccaggactgcgaggcgtcgccggccggcgacggcttcgtctgcggtgactttatcttaagcctgaccgagcccccggtctgcacaccgaggccgtgggactgctgcgacagcgtggcctgcacaagggactacatccccaactgcatgtgcctggacaaggtggagtcgtgctcgagcaactgcgaacggtgcgagtttcagaatcattcggaccctcctcgcttccaatgccgngacatcttccacggctctcctggtcccaagtgctggacatggttcagttcgggcaacnagctcagctcagctacttgctaaaagttgcgtagcgccgcgcgcgcggctacttgcttgtttacgtacg

SEQ ID NO: 477 - DNA, 637 bp, Zea mays
  unsure (1)..(637): unsure at all n locations; Clone ID: LIB3179-027-P1-K6-A2
cccgggcgcagnacttctcggngggcgggctggnctacctgggtgaaccccaacctggtgcacgcacagagcatcctggccatctgggcgtgccaggtggtgctcatgggcttcgtcgagggctaccgcgtcggcggcggcccgctcggggaagggctcgacaaggtgtaccccggcggcgccttcgacccgctgggcctcgccgacgacccggacaccgccgccgagctcaaggtgaaggagctcaagaacggccgccttgccatgttctccatgttcggcttcttcgtgcaggccatcgtcaccggcaagggccccatcgagaacctctttgaccacgtcgccgaccccgtcgtcaacaacgcctgggcattctcttcgaacttcgtccccggcaactaactgtctgtgcatcgccgnacatgtgttctaccatcagttccattcattcgttcgtcctttcgtcgagcgaacagngtggtcttctcntgactctaccngttcagatcgtgggcgtgtagtatttgcaccagttcgtctttgctcatgatcgttgtgtgctcatcaatcaatgtcaaatgcttgcctgcttttagccgtcggtgttaatcttttctctgtccctgttttggccttt

SEQ ID NO: 478 - DNA, 658 bp, Zea mays
  unsure (1)..(658): unsure at all n locations; Clone ID: LIB3179-027-P1-K6-A3
ctcactacgcgaccgctagctactccgatcggatcctgaccacgcccgcctaccaggccaccaccaccaccaccacccacaaatccccatggcgaggcgcatcgccgtggcggcagcgttcctggcgctggccgtggtggctcccgccgcgctggcgcaggctcccgggcccgcggcgacgcctagcgggccgccgaacgtgacggcgatcctggagaagggcgggcagttcaccatgttcatgcggctgatgaaggagacgcagcaggacacgcagctgaacagccagctgaacagctcgtacgccagcagcggcggcgggtacacggtgttcgcgcccaccgacaacgccttcaacaacctcaagcccggcacgctcaactcgctgacgcagcagcagcaggtggcgctggtgcagggccacgtcctgccccagttctacagcatggactccttccagaccgccagcaaccccgtccgcacccaggcctncggccgcgacgggccctacacgctcaacatcaccgncaccgccaacaaccaggtcaacgtctcctcgggcgtcgccgaggtcaccatcaacaacgcgctcagcgccgtcaagcccctcgccgtctactccgtcgacaggtgctcctgcccctggagctgttcgggg

SEQ ID NO: 479 - DNA, 279 bp, Zea mays
  unsure (1)..(279): unsure at all n locations; Clone ID: LIB3179-027-P1-K6-A4
cccggntgcttggtctcagcaatctctaactttcatgcgatgtcactaaatacctgttattaaagatgaatatactgatacataaaagagatgatgacagatttggaagtggaatgttgtttgcttataccgcagttttcgactatcttttgatttcttctgttagatcttgtaaagcattgcagcatggtgtggcatgtacctgtgttgccttctattcgcttctgttaactcatgaaagcattgacttcaatacctgttaattgtttccatggcttc

SEQ ID NO: 480 - DNA, 472 bp, Zea mays
  unsure (1)..(472): unsure at all n locations; Clone ID: LIB3179-027-P1-K6-A5
cccgggngtcagccttcatccgcctgacaatcccccggnngcagcgactagtaccgcgcccccgccggccgccccccgccggcttagctagctatgctagctcctgcgtcgaggctagtagctagtgccatgncgtcgtcntcttgtcgttcggtttctgcttcgggtcaccgtgtaccctttgcgttgcttggtttcnttctttccttttttgccttttttttgtcttctttntccccggcgcatgngtgtcctttgcttnntccagacagttctctgctggatgtgatgtatnccacttgttgcaatcatgngccttgcattggctacctctatacctgctacaaaactactgcaacgcctatatatacttggggtgaggaacatgtgaatgcaagctccggctatcatatacatgtaatatggatacaaactatatatataaatccgccgaggcgccgacaatactata

SEQ ID NO: 481 - DNA, 441 bp, Zea mays
  unsure (1)..(441): unsure at all n locations; Clone ID: LIB3179-027-P1-K6-A8
ncggccgcctcgccatgctggccttcgtcggcttctgcgtccagcagtcggcgtaccccggcaccggcccgctggagaacctcgcctcccacctcgccgacccgtggcacaacaacatcggcgacatcatcatccccagatcaatctccccttgagctcagctcagctgctggttgctgtttcctgtgtacgactaggccctgcctgtacaacgagcgacgacggtgacttcccgcccggaaattaaaccctcgtaatgtaaagcttatgttattaagtagcggctactctgggagncttgtctgtatcaaatataaactggtttgttagctgaatcccaaggttatttctgagcctaaccaggggaaatttagctcaaaacggngaaaatacatacgagacctttgataaccctntttttttttntntttttttttnntt

SEQ ID NO: 482 - DNA, 336 bp, Zea mays
  unsure (1)..(336): unsure at all n locations; Clone ID: LIB3179-027-P1-K6-B1
ggaatcggctaacnnctcggcattttccccctcgagtgacatttgggcaggtgtccataaaattgttgtaaatcactactttctctagagcctttttttcatactatatataatgtcaaagttcgaagttccgaanccnngggtgggggggggtgtggacttatcttacctttnnncnaaanttttttgggaattttttttttttttttgccctttttttctgtncccgggctttcttgtttgttttttttataaaaaaaggggggggcttttttttgtgttctgtccctttctttttttttttttttgggggcgccncccgggtgtttttttttt

SEQ ID NO: 483 - DNA, 664 bp, Zea mays
  Clone ID: LIB3179-027-P1-K6-B10
cccgggcctgcagggacctcgtcggcggccctccaggccacgcgcgacggcggccggacctggatcaccgtgcagcccgtggagggcgccttcgtcgtcaacctcggcgaccacggccacctcctgagcaacggcaggttcaagaacgcggaccaccaggcggtggtgaactcggagtgcagccgcctgtccatcgccacgttccagaacccggcgcccgacgcgacggtgtacccgctggccgtgcgcgacggggaggcgcccatactggaccatcccatcaccttcgccgagatgtaccgccgcaagatggcccgcgacatcgagctcgccaggctcaagaagcaggccaaggccgacaagagtgccaacaaggagttcgccgactccaagcctctcgacgccattcttgcctgatatggtagggggggcgcgcgactaccgtaccgatccgttgctattgctgcgtgtgatttcatgcatcatctataagaacatatatagctacgtgcgaccgtgtggtgattaattaaggtctgaataaaataatggccgcacaaaactaggaagcgatcgatagatcaccccagataaatgtatgtgcgttcccttttctttgaagatgtgtaatttttcaacgtgcggttccagatatgcatggact

SEQ ID NO: 484 - DNA, 511 bp, Zea mays
  unsure (1)..(511): unsure at all n locations; Clone ID: LIB3179-027-P1-K6-B11
ccccacccgccgcgccaacaaggggcgcaacgccagnacccccgtgcccnnctccagctcggnaaaacccccccngacgaggcccaccgccagcgcgaccgcccnctctcactcacnntcactccgcncnngcccggcccnngccgcgcgnaggcncnnggtcctggtaacacggtctngcgccgcgccctcgtacccccatgccgtgaacgcgccgggacgccggccaacnncgagccgcagctcgtcctcgtccgcgccaccannnatgcacttccnncctcgccgcgccgcccgctcgccatnnggccgcgccnnggcggtcnngcccgccctttcgcctcgctcccgtgggcttcaccccgccttcgacccctcttgcctgctggcctctctgggtaccggtaggcgtgggtcacgtgccgcgccggttgcgtgcggtgntgggcgcgcgtgcttggctgcggtgtccgcccgtcccggcggcctttctgcgccggccgggggttgc

SEQ ID NO: 485 - DNA, 71 bp, Zea mays
  unsure (1)..(71): unsure at all n locations; Clone ID: LIB3179-027-P1-K6-B2
gctgaatagccgnacttgtgaaatatggaagagatcaaatttgatggtttcaaagcgatggataccatatt

SEQ ID NO: 486 - DNA, 688 bp, Zea mays
  unsure (1)..(688): unsure at all n locations; Clone ID: LIB3179-027-P1-K6-B4
cccggggggaaggaacaaacaaagggtttacaaagcagagaacctgctaaaaaacacaaacacaataccaaagagctagatggcgaaggaaccggccacattcaaaggccctagctaggtatatggaacctaggcccctagcatcagccataagtccataacccaacaaactgattcatcaaggaagctcctttgaagccttcccaaagaaggggaatccccatcaaagaccaccctgttacgatgaagccatatacaccacgcccctaagatgatgacactgttaagccccttttttgtgcttttctgcacactgatcttaaatttcgaatttccttatggctgaattctctttagctccctcttcctcttctcttggcttcttttgactttgtaaagtctgttttccttagtcttaataaaattttgctctaggggtttcccctacaacatttatacgtaaaaaaacaaagccttttcatgcggtcaaacacatctcttcattttgtattctgataacaatgtgccaaaagcttgaaggaaatgtctatatgttaaggaatatattgcttggaccaggaaattatttcagtagatgtttccttgactgatgatattctaaagtgcccttttgattagtattttcataactcttactnttgcctcttcttttgtttcttttgcctca

SEQ ID NO: 487 - DNA, 634 bp, Zea mays
  unsure (1)..(634): unsure at all n locations; Clone ID: LIB3179-027-P1-K6-B6
cccccctcccagtgctgcccaggtaagtcggcggcggcgatgacaacgcgcttcaagaagaaccgcaagaagcgcggccacgtgtccgccgggcacggccgcatcggcaagcacaggaagcacccgggaggtcgcggtaacgccggtggcatgcaccaccaccgtatcctcttcgacaagtaccatccgggctacttcggcaaggttggcatgcgttacttccataagctccgcaacaagttctactgccccgcggtcaacatcgagcgcctctggtcgatggtgcccaccgacaaggcggcggaggccggcggcgacaaggccccgcagatcgacgtcacgcagttcggctacttcaaggtgctcgggaagggggtgctgccgccaaagcccattgtcgtcaaggccaagctcatctccaaggtcgccgagaagaagatcaaggcagcaggcggcgccgtcgtgctcaccgcctaggtttcagtccttgttcgcctnctggttttgaaatctatatctgaactgatagtgctttcctgtctcggcaatttgtgttaagaaaacctgtagttttaaaatatgtggttcctgcctgtttggcagtgcttatgcgggttttgatgccagtcatatc

SEQ ID NO: 488 - DNA, 601 bp, Zea mays
  unsure (1)..(601): unsure at all n locations; Clone ID: LIB3179-027-P1-K6-B8
nccagcgactcagcgagcgagnagcgcacacactgcacgcagctagctaggagcagcagcagcggcggcgatggcggcctccatnatctcctcgtcagctctggcggtggcgcctcaggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagccttcatggatgctcaaccttcgtcatgtaacaataatcagtgctactcttcattacataattttgatgctatttatat

SEQ ID NO: 489 - DNA, 476 bp, Zea mays
  Clone ID: LIB3179-027-P1-K6-C1
tttcgctcagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagagatatttctgcctccctatcgagggtcgtccccgatggcctttggtcgcagaccatctttgctgcttgtctatgctgagaataaatgtgaacggtgcccctggacgctggatccatgctggttttggacacggttgtctttttgtgtttaacttatctgctgccgtcctgtaacgaattcgctaagttttagttcttttgtgctttgttaagaatataaacaatgaggtttcaattttggtggcgccatccggtctgattgcgtac

SEQ ID NO: 490 - DNA, 550 bp, Zea mays
  Clone ID: LIB3179-027-P1-K6-C10
atggaggcaaaacaggcagctcaggtgctgtttcgtcgccatcgtgctcgtcctgggtcttgtccttgagtcccaccaggctgaagctggaggcaaatggtgctgcgaaccgccaccggaaaataccattttaatcgctgcgttgactcgggtttggtcgacaatattgggttctgtgcgggtaatgccggttgcatcattatggaagacagatgtggaggccgttggccggtgcctgctcgtgatgcgctttccctggatgtcatttgattaattataagcaagtacgtgaagaaacgagggccagacgactgtcgtccagcgattggttatttgtgaacttgtcgtttgtcttcttatttcaactttccaataagccccttcgtgaagtgtcatccccttcaaagtctgtcgactgttacgtatacaaatctatatatcaaataaagacggcgccgtacgtgtgtatatgtctctatttctgatcttgcagtcgtttgcttaatcaattgttctgtcactattttatctaataaaattgcacgtacgc

SEQ ID NO: 491 - DNA, 115 bp, Zea mays
  Clone ID: LIB3179-027-P1-K6-C12
aaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaggggcgggccggttttag

SEQ ID NO: 492 - DNA, 345 bp, Zea mays
  unsure (1)..(345): unsure at all n locations; Clone ID: LIB3179-027-P1-K6-C2
ttggggaaatcctagnagtagcacagccaaaattggagccatttccgttgggcaaggacaccgacctaccagtttaaacactcaaatgatgcaatctacaggaagaatcacgagacacttgaaaaatcaagacaaatagtaagtgtgtgggcgagcagtagtctattaactaaataaaatgctgtgtggagcatattataatcgcatatttccccaataatattgtgttgttaaacctgaggcttgataattatctgacgagttgtaataatagccttggtcttcctgttgcatgtatgtatgtatgtattngngctaaggaataaaaattgtggctttgcgggt

SEQ ID NO: 493 - DNA, 95 bp, Zea mays
  unsure (1)..(95): unsure at all n locations; Clone ID: LIB3179-027-P1-K6-C3
ntatatatatatgcatgcatgcatgtacttttccctgttccaaactgagtatattctaaattacaagatttaatcacaaggtttagagcaactcc

SEQ ID NO: 494 - DNA, 145 bp, Zea mays
  unsure (1)..(145): unsure at all n locations; Clone ID: LIB3179-027-P1-K6-C5
gccactgtactcatgnaagnatattggatgggttgtgtccaccgcctgtgttgggcgtggattgttgtagacttgcagtgatcttgctcgataagcttgtacagttcagtacagacaccacattgaaaccatatagatacaggat

SEQ ID NO: 495 - DNA, 559 bp, Zea mays
  Clone ID: LIB3179-027-P1-K6-C6
ctctcctctgccgccgtcaccgccccttccttcgccgcaccagcgccagcccgcgccgtggtcagaaggaggtccttcaccgtgcgcgcctctctccgcaaggccaccggcaccgccgccgtggcaatggctgccagcgccctgcttgccggcggtgccatggcccaggaggtgctgctgggcgcaggcgacggcgggctcgtcttcgagcccagccagttcaccgtcaaggccggcgacaccatcacattcaagaacaacgccggcttcccgcacaacgtcgtcttcgacgaagacgaggtgccgagcggcgtcgacgccaccaagatctcgcaggaggagtacctcaacgcgccaggcgagacctactccgtcaccctcaccgtgccgggaacctacggcttctactgcgagccgcatcaaggagccggaatggtcggcaagatcaccgtcaactaattaagctagctatcgatcgatatccattcatgtattagctgttgcttcctgctttgtactccgccgatctgtccatctctacatgttttcgtcttcacac

SEQ ID NO: 496 - DNA, 632 bp, Zea mays
  Clone ID: LIB3179-027-P1-K6-C7
cggccgcgtggggttccccggcgactacggctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactaccttggcaaccccagcctgatccacgcgcagagcatcctcgccatctgggcctgccaggtcgtgctcatgggcgccgtcgagggctaccgtattgccggcgggccgctcggcgaggtcgtcgacccgctgtaccctggcggcagcttcgaccccctcggcctggccgacgaccccgaggccttcgccgagctcaaggtgaaggagctcaagaacggccgcctcgccatgttttccatgttcggcttcttcgtccaggccatcgtcaccggcaagggcccgctcgagaacctcgctgaccacatcgcttgcccagtcaacaacaacgcatgggcctacgccaccaactttgtccccgggaactaagctcaacggctctgctatgcaacttcattgtctttcg

SEQ ID NO: 497 - DNA, 378 bp, Zea mays
  Clone ID: LIB3179-027-P1-K6-C8
cggtaccggccattcccgggtaaggattcgtaccttgcttgctttgctatggggccggggcggagtaaaaaattctttactggacatgcgagagcatggtggcggtggagcggcggctcaaggagatgggcatcccgtacgtgcagcgctgcgtggaggagggcggcatcaacgtggaccagatcttcttccacgacccggacgccttcatgatcgaggtctgcaactgcgacaacctccccgtcgtcccgctcgccgccgccgccgaccagcgcgcgcctgccgtcctcggggcctgcaagcgggccgcggcggtcggcgtcaagcagcagcagcagcaaagcagcgccggcggcgtgccttcttccgccgccccag

SEQ ID NO: 498 - DNA, 429 bp, Zea mays
  unsure (1)..(429): unsure at all n locations; Clone ID: LIB3179-027-P1-K6-D1
gngcgacgcgcagtggcacaanatcgaggccggcgtggcaacggcggcggcgctgggcgccggcggctacgcgtaccacgagcaccgcgagcagaaggaggcccactacgagagcaggcagcaggagcacagggtgccgcacgggcacgggcacgggcacggctactcctactactgcgactgaaacgactgatcatcccatcgatcgagatatgcatgcagaactcgatatatatacggcccctagcgccgtacacgtgcgtgcgtgtaagtaaataagagcaaacgtcgtcacgtgtgtgttgctcgatcactactccatcgatctacttattatcgtctgcaaataacgactaagcgcatgcttctgcagcgtgtaacgatccatcactgttactatatctaatgatgcatgcatgcaattaagct

SEQ ID NO: 499 - DNA, 469 bp, Zea mays
  unsure (1)..(469): unsure at all n locations; Clone ID: LIB3179-027-P1-K6-D11
ctccccccctcccgcgcggntcacagacaggctcacggtcacggccggcctcccaattcgcaacctcgcctctgcctctcctcctacccctccgaaaagcaagctccggccgggccgccaccaccaccgcgcgcgcgcgcacgcgctcacacacacacacacagacagacagacagagacgcacggtggttcggggtctcccttctgccaggcgcacgaggagccatggcgcagcgcgacaagaaggaggagcccacggagctccgggcgccggagatcacgctctgcgccaacaactgcgggttcccgggtaacccggccacgcagaacctgtgccagagctgcttctcggcgtcgaggtcgccgtcgtcccctacctcctcctcctcttccctggcgtccgcggcgtcgcagccgaggccagcagcgctcgtcgtagacgcggcagcggtggaggcgctggccgctc

SEQ ID NO: 500 - DNA, 296 bp, Zea mays
  unsure (1)..(296): unsure at all n locations; Clone ID: LIB3179-027-P1-K6-D6
gcgtgctcgaaggaccttctgntggcatcggntgaccacctcggtgtgagaagccaatgacaatgagtcaagtgcggttcatacactggtagacgaagaatcttctgtcagctccttaaatcagaggctaatatcttgaggaggctagctgcaggtggagatggggaagtccaccattgtttcctggactctgtccctcttattcatgtgtggctccacggtttcagattcgccgaaaccgtcattaccggttaccacgcatggaaatgcgaaatctacagaccatatttgcatct

SEQ ID NO: 501 - DNA, 654 bp, Zea mays
  unsure (1)..(654): unsure at all n locations; Clone ID: LIB3179-027-P1-K6-D7
gttngagggcgggtacaagnacgacttgatcgggctggagttcgagccgtgatgccagggcagccgaagctgaccggcgagtacatcatcaccgagatgatggggctgagcctgaacactccagtggctggacctcgccatgatcttcgtcctcctcttcgcctaccgcctcaccttcttcgtcgtgctcaaggtgaaggaggccgctgcgccatacatccgcgtcgcctacacacgattcaccgtcaagcgtctcgagcggcgcgcctccttcaggaagacgctggccatggcgtccatgtccaagcggcacaacccgccgcaccccatggccatccaggaaggactcagctcgcctatgccgtactgagctgagccgaggcgaaggagagagcggagggagacggaagtggtggtcgatatcacagttacttgtggatgtgcttacagatttgtccgttccattgtttagtttgtcagagagcgttgtcaaagataccccacgcgatagtcggtcttcagagcattcgtttcactgtaataactctgaacaccatacacatacaagatagtgctgctgtgcgtacttgtttttttttgtaaacatgaaaccaggcaatgatccttatattaagaaagtcacgcagtcaaaaa

SEQ ID NO: 502 - DNA, 662 bp, Zea mays
  Clone ID: LIB3179-027-P1-K6-D8
tcccggggccaaagaccaaaggcatcaccgccgcgccgacgatggcagcctcgctccaagccgcggccaccctgatgcagccggccaagatcggcggccgggcgccctttgcctcgctgccgtcccgcccgtcgtcgcaactcgcctgcagggcgttcggcgtcgacgccggcgccgccaggatcacgtgctccctgcaggacgtcgccagcaggtgcgtcgacgccgcgaagctcgccggcttcgcgctcgccacctcggcgctcctcgtctcgggcgcgagcgcggagggcacgcccaagaggctgacctacgacgagatccagagcaaaacgtacatggaggtgaagggcacgggcacggcgaaccagtgcccgaccatcgacggcggcgtggagtcgttcccgttcaaggccggcaagtaccagatgaagaagctgtgcctggagccgacgtccttcaccgtcaaggcggagggcatcgccaagaacgccccgcccgagttccagaagaccaagctcatgacccgccttacgtacacgctggacgagatcgagggcccgctcgaggtcggctccgacggcacgctcaagttcgaggagaaggacggcattgactacgccgccgtcaccgtgcagctcctcgggggcgagcgcgtgccg

SEQ ID NO: 503 - DNA, 343 bp, Zea mays
  unsure (1)..(343): unsure at all n locations; Clone ID: LIB3179-027-P1-K6-D9
cgccgccctttttccaatgccaaatcgacgacctatgtattaaaaaaagngnaaatttttntggattttgaagnaaaaaataaaaggaattctatcaatttttattttccatttatttagttagtttttcttaatgaaattgaaattattaactaacagagcaaacacaaataaagaaacaactttgctgaccatgatagatttttatctagttggaagagtcctcttaatattcatctagtcttatataagtttgggtatatagaaatacaaacagaaaagagaggatagaggataggctcattacataaaaaaaaatatggaaatagccataatacataac

SEQ ID NO: 504 - DNA, 423 bp, Zea mays
  unsure (1)..(423): unsure at all n locations; Clone ID: LIB3179-027-P1-K6-E10
nacaagcagntttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatgccgaataatggatgtgtgaattctcactaattaagtaatgcataaataaacgtattca

SEQ ID NO: 505 - DNA, 514 bp, Zea mays
  unsure (1)..(514): unsure at all n locations; Clone ID: LIB3179-027-P1-K6-E11
agcacaggttgtcaagcaggagagttgtctcgagccacacgtgagagcaccaatgcagaagggaggcttccaatcatacatcatctggctggttcttccggtggctctgctcctgcttctctgtgttgggacatatggatgggtatgaaatctatcctggtgcggngcaaggcatgactttttgcgcacatgggttcttggcgtcaacctggtgtgctgtcttctgtacataacctgtggcatcctttcaacagccgtaccctgcagtaagacatcccggcattgccaaggcagctgaaaaataaataaaaaaaacacgaggtagaaatgacaaggtggaaaagagcgaggtgtgttattgttggttttagtacatcgttgtcttcttttactgttgttgtagatgtcttgctaatgttgncgctgttgtgtcgnngccnttcaagcccagggctgtccagtttattncctactgtaatgtcgcatgagcgagaccctgttagacgggtgcgct

SEQ ID NO: 506 - DNA, 338 bp, Zea mays
  Clone ID: LIB3179-027-P1-K6-E12
gtcaccggtttgggcccgctcgtggaacctcgctgaccacatcgctgacccagtcaacaacaacgcatgggcctacgccaccaacttcgtccccggcaactaagctcaacggctatgctatgcaacttcattgtctttcggatcggagagggtgtacgtacgtggattgattgatgctgcgagatgcatgtgtgtcttttgtttcacgttgccttgcataggcaagtcgagatgatgagttggcgttgtccactaagatgaaccatgtttgtgcaacaaaaaaatttttgggcggccgcttttgtgttccaagctgccgtacgcgtgcctgcgtcgtc

SEQ ID NO: 507 - DNA, 272 bp, Zea mays
  unsure (1)..(272): unsure at all n locations; Clone ID: LIB3179-027-P1-K6-E2
gtgcgcattgactgtttgttaaagagttggaatcggctaatttctcggcattttccccctcgagtgacatttgtacagctatccataaaattgttgtaaatcactactttctctagagcctttttttcatactatatataaagtcaaagttcgaagttccaaaaaaaaaaaaaaaaaaaaaaaaaaaaaaaaaaaaaaaaaaanaaaaaaaaaaaaaaaaanaaaaaaaaaaannnnnaaaaaaaaaaaanaaaaaaaaaattttttttttt

SEQ ID NO: 508 - DNA, 414 bp, Zea mays
  Clone ID: LIB3179-027-P1-K6-E5
acgagctccgcctgcgcgtgcgcggcggtagcgctcgcgtccttcccgtccgccgcctccacctccgccccttcccgcgtctcggccagcagccaccgcggtcagcggcactccagggccgccaccgtcagatgttccagcacgtcgcccaacgtgtcccagggcgcgccggcgccggcgccgcccaagccgcaaatcgagctcgagttcgtcgggccgaagcccggtgccgacggctccttcccggtggaccgggcggaggcggccagcggcgagaagctcctccgtgacgtcatgaacgagaacaagatcgagctctacgccgcatacggtaaggtgatgaactgcggtggcggcggaaggtgcggcacttgcatcgtcgagataatcgatggaaaggagctcctgaatgag

SEQ ID NO: 509 - DNA, 629 bp, Zea mays
  Clone ID: LIB3179-027-P1-K6-E9
cttcaaaattatgtgtggaacgaacaatagtttgcagtacacccgaccgaaacacaatatttcatcgattccttccttgtcttctcacctctgacgattctgtttctgaaatctgcttcctgcaaaatggttccatggtcacggaattcgccatggtcagagtcagagagagagagagagagtcgtactggtcgtcacctgtcgaagattttcggtgtctcctgagccacagctgctgctgctgctggaaccatggagatggaggccgtggagtcgcacggaggcgccgggcgccggacgcccaagagggatcgcggcatctcctgggcctgcgtcttcatcctggcgagtaactgcttccagttcatcgcctacttcgccgtgtcgacgaacctggtgaactacctcaaggaccgcctgcaccagggcagcaaagccgccgcgaacggcgtcaccaactggatgggcacgagcgccatcacgccgctcgtcgccgccttcctcgccgacgccttcctcggcagatactggaccatcgcgctcttcctggtcatctccgtcctggcctacgtggtgctcacggtgagcgcggcggcggcgcttgagagcgcggccttctacgcggggct

SEQ ID NO: 510 - DNA, 646 bp, Zea mays
  Clone ID: LIB3179-027-P1-K6-F1
cccgggcctggccctagtcgcggtcgtctcactgggctacggtgccgttgtgtatgggtgagataggggtttggggggttttctcactgtccggtgcctgtcttacctgttaccctcgtaggtcgagtttttttagattgtcacagtttcatgtgcaatcttgaaacccttgatatctgaaatttacctgccttaccaaatccatatatccttaaaaatgtttgtcacattccgaaccatgtaacctagtatatgtatgcgatacgcaggtggcatttcgcactaaggtgttccatccaaacatcaacagcaacgggagcatttgcctcgacatcttgaaggaccagtggagtccggcactaaccatctccaaggtgctgctgtccatctgttccctgctgactgatccgaaccccgacgaccctttggtccccgagatagctcacatgtacaagacggaccggcacaagtacgagaacaccgcgaggacctggacccagaggtatgccatgtagtattttctctacctggcctttggggtcgctgctgcgttgtgttgccgggacctggacgtgcctccatgtattcgttctatccttcctgtataatgatgaaccgaattgggtttgcagtacagtgccccgtg

SEQ ID NO: 511 - DNA, 622 bp, Zea mays
  unsure (1)..(622): unsure at all n locations; Clone ID: LIB3179-027-P1-K6-F10
ccccgcgtccngtccaatgtcacttgctctccctccaacagctaattaaggccggtcatccctcttctagctcgtttcattatccatggcggaggagaagcaccaccaccaccacctgttccaccacaagaaggacgaggagcaggaggagcagctcgccggcggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaacaccacttcttcggctgattgatcctaccgtatcgtcgtccctccccgtgtgctacgcgtgcgtgtgttagagagatatttagcgccccgcgtgttgtgcccgcgtacgtatgtatgcgctcgtgtgatg

SEQ ID NO: 512 - DNA, 497 bp, Zea mays
  unsure (1)..(497): unsure at all n locations; Clone ID: LIB3179-027-P1-K6-F11
gtgctgtcttcttcatcctcctcatcttctaacccaatatcatacatttcttctataaattcatcaagcgctttctcaatgacacaagcatcaccggttacaccttccatgtcagaccttctccacttcaccaatacttcatcactacttgaatcactcatgccttccaatcccacatctattgaatcaagatcaatttctgaattttcagattctagcatggcgaacagatttcggggtttcattcttacaacagtgcaccaatcttttnncnnngnaccattgacataaaatacctgctcagcttgtgaaccaagaatataaggctcatctaaatagcacaaccgagttttatcaatatcaataattccatactgatccctttggtcgcctctcaggttttcatttggtagttgttcgcagggaaccatatgagaanngcaatgtcaatcaggtgtttgccaataataattgggtggtttctgctcttgctctga

SEQ ID NO: 513 - DNA, 480 bp, Zea mays
  unsure (1)..(480): unsure at all n locations; Clone ID: LIB3179-027-P1-K6-F12
ngataagacgacttgtttcattgattcttgaagagatcgagcttcttttgcaccacaaggtcgaggatgtcttgcaactgcggatcaagctgcggctgcggctcaagctgcaacaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccanggatatgactattatctatctagcttgtggtggtggttgaacaataataagcgaggccgagctggctgccatacatatgtattgtgtggtgtgcgagagagagagagaaacagagttcttcattttgctatctctctctctgcatgtttggcgacagcctttgtgctca

SEQ ID NO: 514 - DNA, 536 bp, Zea mays
  unsure (1)..(536): unsure at all n locations; Clone ID: LIB3179-027-P1-K6-F2
gtngaccggncagnggnagnangnanagagaagtagagaacgcccgccacggcgccgccgacgccccacccggccgagccgaaaccgagactgcatcctccttcgcggcgcgccgagatgagcggcatgagcctctcccatcgtctccctcccgccgcggcggcggtggacccctactacgtgtatgcggcgcacccggacccacagcggcagggcgtgctcacgctcttcgtcgcggggctccccgacgacgtgaagccccgcgagatccacaacctcttctcccaccgccccgccttcgatcactgcctcctcgagtacaccggccgtggcaaccaggcggttgcttttgtgacgttcttcacccatgaggcggccctgtcggcaatgagttccctaaatggaacaattnttgatccggagagtggcgaccgtttgcacattgagctagctaaatcaacttcacgcagacctcgtggaggtgtcgaaggctaccgngttattgacaaacgggcttacaaaaaagaaggaaatgc

SEQ ID NO: 515 - DNA, 239 bp, Zea mays
  Clone ID: LIB3179-027-P1-K6-F4
cgcccacctccggctcttctcgaaccaatcaagagcggaaagaaaaagattttgtcaaataatgaagaggtccttaccgtttgaattatcctcctttaaatggattgctctaatcttccctactttccttaatgactgcaacgattttctccttttgcgaattccattttatttgaagtatattactatcatatacattatctaaatcgatccactttaaataaatagaaaaatcgaag

SEQ ID NO: 516 - DNA, 315 bp, Zea mays
  unsure (1)..(315): unsure at all n locations; Clone ID: LIB3179-027-P1-K6-F5
nnaaaaaaaaaaaaaaaaaaaaaaagaaaaaaaaaaaaaaaaaaaaaaaaaaaaaaaaaaaaaaaaaaaaaaaaaaaaaaaagaggggggagaaaaaaaaaaaaaaaaaaagggggggcccgtttttgggggtccctttttttcttcccccttgttttcttccgtggtgcgtcttttttttagcgctccccttggggggggtgccttggcccttccctttcccaacgccggtgcctgggaaaacccctggggttcccccccttattcgcctgggggaacgtccccccanccccccctggtttattttcgaggggg

SEQ ID NO: 517 - DNA, 347 bp, Zea mays
  unsure (1)..(347): unsure at all n locations; Clone ID: LIB3179-027-P1-K6-F6
cgnagtaagtagtaaaattaaaggacctagggatgtggaatcgctgaagaacttcgtgctgaatgaagctgagaaagcaggtgaggcaaagcttcaagctgattgaggcaggggagtttcagcaagcatgtggcgtagacaaggaacaatgctttgcaacattgtcttctatcctgtcatttacaaagccaatttacaggaaagaaatgaccttatgaccccgtatcagagtattcctcttcgaaagtaactccgaatcagttcatagaagctgtactccattccatagtttttatcacattgacaaactctccgaatcagttaatagaagctgtactccattccat

SEQ ID NO: 518 - DNA, 226 bp, Zea mays
  unsure (1)..(226): unsure at all n locations; Clone ID: LIB3179-027-P1-K6-F7
cccgggnngtttcttctttttctttcttgtgtactccagtggnnactcccnngtgtgcaaacacgnaanagtgnngctgtttgacaccagnannattaattgttacttcctccgtctcagattataatatanttttgatctttttagataaaaaaaaaaaaaaaaaaaaaaaaaaaaaaaaaaaaaaaaaaaaaaaaaaaaaaaaaaaaaaaaaaaagaggaaaag

SEQ ID NO: 519 - DNA, 498 bp, Zea mays
  unsure (1)..(498): unsure at all n locations; Clone ID: LIB3179-027-P1-K6-F8
gnaaggccgccaccgcagcgccgctgggtgccccctcagcctccaggtgttgcgatgccagaagcagcagctgccatacgtcaaccaaaggcccttccaaagcagccctccagcgatgcctctgaggcagctggtgagatgcaggtgaatggttcaagtgcatcggatgctgtgactgaggttcctgttaatggtgctactganagtgatgctggacgcagtgagatccaagaacaatcagtggcggcctaagtgaaaccaagaccagctaagaactgggaagcaatctaagagagattcaggatctctagtacatctgggcggtttgtcatacatctctgaataacgtctgtatcagaacagcggggcaaccacaccgatgggtacccgtaataatgcaataagtagcagatagtttctgcatttagattaatgctacnngtacacaggagaacatatcaataatatttctatggctgttcgattgagggtgcttaa

SEQ ID NO: 520 - DNA, 416 bp, Zea mays
  Clone ID: LIB3179-027-P1-K6-G1
tcgaaaaaaaaaaaaaaaaaaaagaaaaaaaaaaaaaaggagaaaacaaaattaaataaacaaagaataaaaaaaaaatagcatgtaatatagatgaacacctaatataaatatcactgaaataaaatttaataaaaaggggtactgggaaaaacgatggactggagcaaaccttgagttgccttgacaacaatttgccttgtttatacatgtggcctttatacagatgaggccggcaccgattgaccctcccaacattggggtaacctagagtgtgtgacatggctataatgccctgtggcggcgcatcctgttcggcgggtgtggtgcatacgggaagggtgcctactccaattgttaacgctatagtggccagtcctttaggtccatttccttcctctctcttcccgtccttt

SEQ ID NO: 521 - DNA, 675 bp, Zea mays
  unsure (1)..(675): unsure at all n locations; Clone ID: LIB3179-027-P1-K6-G10
nnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccctttttggggttccaatttttcttcccctttttttccccttttttgttttttttttggggcccctaattataatttcttggcccttttttttcaacctttggtttgggaaaaccctgggttttccccattttttgcctttttcgcccttcccctttttcccgttttggttttttgcgaaagggcccctccctttccccttttccacccttttgttcccttttgtggttttttgtcccccccctttatggttttttttttctgggggtttttgtttttttccctccttgtttccttttttttttctttgcctttttcgcccctttttttttctttttcttcttttcttttttcgcccctttcctcttttttttccctcttgctctttttcttgtggtttctttttttgtgttctgctcttttttgttttttttttctctttctctttctctttttttttttgtgtttttcctttttttcttgtttggtctctcncctctttttttctgttttttttctttttttttcttttt

SEQ ID NO: 522 - DNA, 91 bp, Zea mays
  unsure (1)..(91): unsure at all n locations; Clone ID: LIB3179-027-P1-K6-G11
gnttcctagtgttgcctgcacttctacctttcagggnagactcattttcttaagcctgtatatgtattgcagagataccggcggcaaatct

SEQ ID NO: 523 - DNA, 567 bp, Zea mays
  Clone ID: LIB3179-027-P1-K6-G12
aaagaaccctcaactgatttcatggttgcaaaaacatgtaagtgaacacaggctcgcaaagtatctccacaaagtacaaaagagaaagctatatttctctgcttatgagtaacattaaccctacacaccgcttcatatactttcagactgacagaaaataaatacatttgatttgaagactcatgagaaaatacaaatatctgtccaatagtatgaatgatctggatccttttgtaccgcaagaatgctacaccacaagacgagcagcaaaagatgtctgtggtgaaaggagatcatttggtagtttctcaacacgtaattctgttatactgggaaactctcctctgcaaagggttgatctaatgccttatggaataaagatttccatcaaattttgtgacagcttcatttggctttggggtttctgatctttcttctctcttcttcttttccctatccacgtattccttgagaagttccttggcttgaaccagctttgagagattgttgcggtcaacatcaaggtccctatccacccttctttttttgatttttagcgcaccgcaa

SEQ ID NO: 524 - DNA, 351 bp, Zea mays
  unsure (1)..(351): unsure at all n locations; Clone ID: LIB3179-027-P1-K6-G2
ccaattgagnaaatcctagaagtagcacagccaaaattggagccatttcccttcgacaaggacaccgacctaccagtttaaacactcaaatgatgcaatctacaggaagaatcacgagtacacttgaaaaatcaagacaaatagtaagcctattgtcgagcagtagtctattaactaaataaaatgctgtgtggagcatattataatcgcatatttccccaataatattgtgttgttaaacctgaggcttgataattatctgacgagttgtaataatagccttggtcttcctgttgtatgtatgtatgtatgtatttgagctaaggaataaaaattgtggctttgtgggtt

SEQ ID NO: 525 - DNA, 161 bp, Zea mays
  Clone ID: LIB3179-027-P1-K6-G3
ggattgggtccgattcggtgttggtgctagatccagaagtgtacgtttaatttatgttattaccagttaaccaaaaaaaaaaaaaaaaaaaaaaaaaaaaaaaaaaaaaaaaaaaaaaaaaaaaaaaaaaaaaaaaaaaaaaaagggcgggcggttttaga

SEQ ID NO: 526 - DNA, 127 bp, Zea mays
  Clone ID: LIB3179-027-P1-K6-G5
ggaaaagtcaggcctccgttgtgagttctcaggaaaaaggtgccactgcccaaactgacggggagagacctgcttactcatgcctgagtaatctccacacccgaggcaattgccaccccaagttttg

SEQ ID NO: 527 - DNA, 616 bp, Zea mays
  Clone ID: LIB3179-027-P1-K6-G8
cccctctcgtgtcgtggcgacgactggggggctgtcgctgccgccctacgtcaggtggccaggtcgtattagggcacttcgccggcgacgagtaccacaaggcagtggacactttctctggtatcagaggatcaatgtccaattattatgatgactacgatgacattgacgggatggaggatgattatgatatggatgatcccattgatgacatggtagacgagcagcaagggattagggattctgatgtggaagataatgattatggacaaccaaatgataagatcccagatacttcatcagcagatgcaagaaaaggaacggacattcaaggaataccctgggagcagataaacataacccgtaaaaaatacagacagtccagattagaacagtacaaaaattatgagaatgtacctaactctggagaagaagctatgaaggattgcaaaccaacagagaaaggtgggatatactatgagtttagacgaaatactagatcggttaaatcaactattctacattttcagcttattaatttcgtgtgggcaacgtccaagcacgacatctacctagtttcttcatttcttaattcgtcactggtcagcattgagtg

SEQ ID NO: 528 - DNA, 638 bp, Zea mays
  Clone ID: LIB3179-027-P1-K6-G9
aatcaccaaatcagccctcgcgtttctcccttcccccggctcccggcgtctctgcgctgcggccgtacggcgatgcggtggctatcgaggctgctctctcaagccgtcgccgccaggagggcctccgcggcggcgaggtccaacactagtctcgtcaagggaggatcccacgggttcgctagtggcggcagggatgggtcaccggaggtgcctcgggagtggttgcggaagctgtgggtagacgagctgaagaagcagaaggaagccgcgaggagatggggcgtcggctcatcattagaggttgcaggagcgaccgaggaggcaccgtcaaggagctatcagtacgaatacagcggctctaaccccgtggaggccaaactggctccgcttcttgcaagagctaacctcgtcattgccagggatattgagtgggcaaacatcatgtttgcttttgagcaggagagcaggtatatcataatggacccactctttccacaatctccagtaggttttattcgagagaaagcaacatcatctttagacagctactcagaacaagacggccatttgttgcagaaataactgatgctatgggtaacgagatatttaaggttcgccggccattttggtggatcaac

SEQ ID NO: 529 - DNA, 555 bp, Zea mays
  unsure (1)..(555): unsure at all n locations; Clone ID: LIB3179-027-P1-K6-H1
tctccagtnngcgtggcgcccccggntccgagcaccctcgccgtgctaccatgcgccagcccccccntcgccgccggnacaaaccatgtgtcnccttataccttccgagccggcggccagggtctcgccgtcgccccggtccgtgcggcggactcgtcctctccgcccaccgtgcccgcctccgcggccggcaaggctgtcgtcccggacgacgagttctccctcgccaaggtctctttcggtgtgatcgggctggggcttgggctctcgctcctgtcgtacggattcgggtcgtatttcaacctgcttcctggttcggagtggtcagctttgctgctaacctacgggtttcctctcacaatcatcggcatggccttgaagtatgcagaactgaaaccagtaccctgcataacctacgctgatgcctttgctctaagagaaaagtgtgctacccctattctgaagcaggtcaggagtgatgttacacgttttagatatggtgatgaacaacacttggatgaagcactgcagagaatctttcaatatggttttggg

SEQ ID NO: 530 - DNA, 268 bp, Zea mays
  unsure (1)..(268): unsure at all n locations; Clone ID: LIB3179-027-P1-K6-H2
aaaaccggattttcatggtcatnngtatgggcaccctatttgaggtcagaatcttcctccaacaacccattgaaatgcggaattatttcgatgcttgaccgtgatgttcaaatgttctaagtcccatcagnanatcaaggnatttgcgttggaagcaggtggagtaaggcttgtctgtctgatgtatttacgtgtgttcaaacaagnaatagtcatcatcacgttatcgagcagtccagcctgtaagcttggtcttggtctctatcac

SEQ ID NO: 531 - DNA, 482 bp, Zea mays
  Clone ID: LIB3179-027-P1-K6-H5
ctcctaatgaacagattctactggggattggtctggggttcactaatcaggtaacttatacttgaatcagtactaaacagggcacatatatttagctcaaaacaccataaatcggttgagcagtactccctttgtcacacattataggtcaatttagttttgaaggaaacaaaggcctaggtatggtcaatctagcacattcaagtagagaagattttttaattgcttataacatgatatatagttcaagaaatcagcacaacagtttcatgctggatgaatgttgtaatatctagatattggaaattaaatgtattgtgcagtaagtctagcatgaactcagaaaatcctgtgtggctatgaaatcagtatcagacttgagatcaagtatttcattgagttggacttggtggttaaaaacaaaggcttcttgtggatgtcatttgttcagctcccaagttggctactagatcgctaaagtt

SEQ ID NO: 532 - DNA, 309 bp, Zea mays
  Clone ID: LIB3179-027-P1-K6-H6
gtcatggtaggcctcccgattgatgagttctcaaggaagaagatggatgccactgcccaagagctgacggaggagaagacgcttgcttactcatgcctcgagtaaattctaccacatccagagagcaattgccaccccaatgttttgaataaaaaaagaaactccaactccattcatagattgtcactcagaactgctgcacgtcgcagtgcaggcgtgttgctggcttcgcccagcttctttttttgcctgtgatttgcacgacatttatatttattgaaatcttgcagaatcgcttgacgatgaatt

SEQ ID NO: 533 - DNA, 485 bp, Zea mays
  unsure (1)..(485): unsure at all n locations; Clone ID: LIB3179-027-P1-K6-H7
gttttatggcttgttgatcaggccgtcttcgctcgctgaccaccaccgcctcgctcgtcgagcatatagccatgccatggcaagcacaggctcagagggatagataggtccagtgcaagcgcgcaggcatcgtcatccagggagggtggtggcccgtggtccacatcgatgcgatgccggttcacgttgcgctcctcgccgtgccggcggtggccgctgggttcctgcaggcgttccagttcgcgttcctgctgtggcccttcaacctggcgctgccgctggcgcgccacctgccgcacgcgtgcatcgcgttccgcggggtcgcgtccttgtacggagccgagctgcggcggtacgcgggcgccgccgcccgggccgccgtgcccgtgctgcagccgccgagccaccaccggtacgcctcgctccgcgccgtgcagcagcgggcgcacggggntgccgtcgtcgcgcacgccatggtcgcgctc

SEQ ID NO: 534 - DNA, 637 bp, Zea mays
  unsure (1)..(637): unsure at all n locations; Clone ID: LIB3179-027-P1-K6-H9
gcaagctcgntctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggaccatgtggaagctgcccatgttcggctgcaccgacgccacgcaggtgtacaaggagctgcaggaggccatcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctctgcctgttgatcggatcaccttctt

SEQ ID NO: 535 - DNA, 447 bp, Zea mays
  Clone ID: LIB3179-027-P1-N6-A1
atctcttaatttctgtctcaagtatataattgattaggaatagtcaaataatgggggagctgtcaacaaattctttttctcccttccctgtgttttcctccctgcaaatttaggatcaaaatgacataacaaccgaacaaaccacctctaaactgctaactaaaaagttaagttgtttcctgttgtccgtaacggcactgaactgattctccggcgatgagcttctccagggcatccggcggaaggccgaccatctccagtgtcttctcccagaccagctgcgaggtctccagattgtgcgcttcttcagacgcattcatcggactacagtcatagttaatgcaggcacaaactggccagtcctccgacttgagcgtttcgcagttctccgggacttggggatcggatgctgcaaacagtgcactcctggtaccttctgcgcgtcca

SEQ ID NO: 536 - DNA, 177 bp, Zea mays
  unsure (1)..(177): unsure at all n locations; Clone ID: LIB3179-027-P1-N6-A10
ttggnatcctctaaacggccccccttgttttttttttttttttttttcttcttttttttttctttttttttttttctctttttgtcttcctttgtttttctgtctctcctttttctttggcgcctccctgccggcgtcgcttctttttcttcttgctgggccngtgctctgtcgtct

SEQ ID NO: 537 - DNA, 267 bp, Zea mays
  Clone ID: LIB3179-027-P1-N6-A2
aaaaatgaatggcacaggccatcgattgattgattcatccactggtgacgattcatgcgtttgtgcttagtttacattgaccgctttcagcaggcagcctttgacattgtttggtgaggacacatcgatcatgagcattcgccggctggtgcaacttctacacgccttcgctctgaacctggtgggtgccggggagaccacactgttcactcgtcggtcggccgttcttatggttggatcttgtggtggttcccttgttcggctttt

SEQ ID NO: 538 - DNA, 524 bp, Zea mays
  Clone ID: LIB3179-027-P1-N6-A3
gcagtatcaacagcggcaggcgcataaattgaatcacataagccaatcttacaaaccaccaatagtacaaattaaagaaactagcgagatgaaagaagtttaaataaacagagagaaagaaggggaagggaacccgggcatagcattctcatcttcaactagcttgtcgtccgtccgtccctagaaacgacgcacggtctcactctcacaacagacagccaaggacggcggcgaggccggcgaagctccagccgacgaccctggcgccggcggcgcccgtgggcgcggcgtcgtcggaaccggccgacccggagggagcgtccgaggacccgcccttcttgggcttcccctgggacgcggcgggcgcggcggcgggcgccttggccccgaacagctccaggggcaggagcaccttgtcgacggagtagacggcgaggggcttgacggcgctgagcgcgttgttgatggtgacctcggcgacgcccgaggagacgttgacctggttgttggcggtggcggtgatg

SEQ ID NO: 539 - DNA, 305 bp, Zea mays
  Clone ID: LIB3179-027-P1-N6-A5
tatagtattgtcggcgcctcggcggatttatatatatagtttgtatccatattacatgtatatgatagccggagcttgcattcacatgttcctcaccccaagtttatataggcgttgcagtagttttgttgcaggtttaggggtggccaatgcaaggccatgattgccacaatggttacatcacatccagcagagaactgctggaaagcaaaggaaccatggccggggaaaagaagaaaaaaaatggtaaaaaggtaagaagaaaccaagcatgccaagggtccacggtgacccgctgctaaacc

SEQ ID NO: 540 - DNA, 385 bp, Zea mays
  Clone ID: LIB3179-027-P1-N6-A8
tcgctgccgcgtctttagctggatccctaggcggccgcccgtggggggtttttttttttttcttcttttttttttttttttttttttttttttttgggttccagggcccggtgtcttttctcccctttgggcccatttccccggggtgggctccggaataaccctgggattctgcttcccaccccggtggggttgggtgccgccccggctccccgggttgccggttccttgtgcccttggcggccccttccggggggttagtttcccggcgggggggtccccccgtctctcgttgttccggcggggccttgtcgttccccgggtgccgccccccgtcgctggcctgtctctccgggggggttggtcctggggtgctggtttcccc

SEQ ID NO: 541 - DNA, 515 bp, Zea mays
  Clone ID: LIB3179-027-P1-N6-B10
gcacacctctaacgtcttgcatattcaacaggggatacaaaagaattacaatgcactccggtccagtccatgcatatctggaaccgcacgttgaaaaattacacatcttcaaagaaaagggaacgcacatacatttatctggggtgatctatcgatcgcttcctagttttgtgcggccattattttattcagaccttaattaatcaccacacggtcgcacgtagctatatatgttcttatagatgatgcatgaaatcacacgcagcaatagcaacggatcggtacggtagtcgcgcgccccccctaccatatcaggcaagaatggcgtcgagaggcttggagtcggcgaactccttgttggcactcttgtcggccttggcctgcttcttgagcctggcgagctcgatgtcgcgggccatcttgcggcggttcatcttggcgaaggtgatgggatggtccagtttgggcgcctccccgtcgtgcacggccagcgggtacaccgtcgcgtcgggcgc

SEQ ID NO: 542 - DNA, 201 bp, Zea mays
  unsure (1)..(201): unsure at all n locations; Clone ID: LIB3179-027-P1-N6-B11
gcacgcgttcgtaagcttggnacctctagcacggccggcctagatttggggttttttttctttttctcttttttttctttttttttttttgtgcccttttgcttcttcccccctccttccgctgtgggggcttttggttttttcttctctccctcttcctttttttcctccctcctctctctttttgcgggcggggggggg

SEQ ID NO: 543 - DNA, 73 bp, Zea mays
  Clone ID: LIB3179-027-P1-N6-B2
atatgggatccatcgctttgaaaccctcaaatttgatctccttccatatttcacaagctggggcttgttcaac

SEQ ID NO: 544 - DNA, 263 bp, Zea mays
  unsure (1)..(263): unsure at all n locations; Clone ID: LIB3179-027-P1-N6-B4
cacgcgttcgtgaagcttggcatcctctacaggccgcaggttgtgtctgcaactcaatgacaccatagcacgcgaacgcatngaagtaggcatggctcatggcaaagatccaacgtcctgtgtgtaattccaacacctctcacattttgcaccatcctcacgagtcacaccaatccatatgactccagtgcgtgtgttccgggactttcctgtgtctggtacagttcttgtaatctttccctttggggttggctgcctatcgt

SEQ ID NO: 545 - DNA, 427 bp, Zea mays
  unsure (1)..(427): unsure at all n locations; Clone ID: LIB3179-027-P1-N6-B6
ttttagcgaggatagnatttaattgatgtgaaatatttgatatgaactcggcattcataaaaccgtcatgaagccacttgtcccaaacagggcagggaaccacatattttaaaactacaggttttcttaacacaaattgccgagacaggaaagcactatcagttcagatatagatttcaaaaccaggaggcgaacaaggactgaaacctaggcggtgagcacgacggcgccgcctgctgccttgatcttcttctcggcgaccttggagatgagcttggccttgacgacaatgggctttggcggcagcacccccttcccgagcaccttgaagttgccgaactgcgtgacgtcgatctgcggggccttgtcgccgccggcctccgccgtcttgtcggtgggctccatcggcctgaggcgctcgttgttg

SEQ ID NO: 546 - DNA, 409 bp, Zea mays
  Clone ID: LIB3179-027-P1-N6-B8
atatatatagcatcaaaatttgtaatgaaagtagcactggttattgttacatggacgaagttgagcatccatgggggctagcttatagacagacaccctggttttacatgacgaatcgcaagaagcgcatgcattgggtatccttagccggagggggcgctggtgttgtagacgaggagggcgccgccgccgaggatcccagcgagggtgacggcccagatcagaagcccagtggttccaccgacgtagacgtcgccggtgggagaccagtcatcctcgttgtagattgggctgtatccgtcgacgttcgcgccgtacttgtcgacgaactggtacacgcccttgcccttgccctttctcccgttggcgtcgacgtcgacggtcaggccacccccaatcccgtagggct

SEQ ID NO: 547 - DNA, 550 bp, Zea mays
  unsure (1)..(550): unsure at all n locations; Clone ID: LIB3179-027-P1-N6-B9
aaatggtatccaacgctttgaaaacatcaaattgatctccttccaatttcacaagctgcggctagttcagcactccatttgcaagctgctttgataatttcattaccttcacgagcaagatcgcgcccttcgttacgagcttgtacacaggcttctaaagccacacgattagctgctgcaccaggtgcatttccccaagatgtcctaaagttcctccaccaaattgtaatacggaatcatctccaaagattcggtcagagctggcatatgccaaacatgaatacccccanaagccaccggtataacacctggcatggatacccagtcctgagtgaaaaagaaccgcgagaacgatctttttcaataaaatcatcgcgcaataaatcaacaaaacctaaagttatttcgcgttccccttctaacttacctactactgttaccggatggatatgatctccccccgacatacgcaatgctttagctaatacacggaaatgcataccatgatttttctgtnctatcaataactgcatgcattgctcggtgaatg

SEQ ID NO: 548 - DNA, 554 bp, Zea mays
  unsure (1)..(554): unsure at all n locations; Clone ID: LIB3179-027-P1-N6-C10
tgcgtacgtgcaattttattagataaaatagtgacagaacaattgattaagcaaacgactgcaagatcagaaatagagacatatacacacgtacggcgccgtctttatttgatatatagatttgtatacgtaacagtcgacagactttgaaggggatgacacttcacgaaggggcttattggaaagttgaaataagaagacaaacgacaagttcacaaataaccaatcgctggacgacagtcgtctggccctcgtttcttcacgtacttgcttataattaatcaaatgacatccagggaaagcgcatcacgagcaggcaccggccaacggcctccacatctgtcttccataatgatgcaaccggcattacccgcacagaacccaatattgtcgaccaaacccgagtcaacgcagcgattaaaatggtattttccggtggcggtttcgcagcaccatttgcctccagcttcagcctggtgggactcaaggacaagacccaggacgagcacgatggcgacgaaacagcacctgagctgccctgttntgccttccat

SEQ ID NO: 549 - DNA, 96 bp, Zea mays
  Clone ID: LIB3179-027-P1-N6-C3
ggggggggctctaaaccttgggattaaatcttggaatttaaaatatacccagtttggaacaggggaaaatacatgcatgcatgcatatatatatat

SEQ ID NO: 550 - DNA, 144 bp, Zea mays
  Clone ID: LIB3179-027-P1-N6-C5
atcctgtatctatatggtttcaatgtgtgtctgtactgaactgtacaagcttatcgagcaagatcactgcaagtctacaacaatccacgcccaacacaggcggtggacacaacccatccaataatctttcatgagtacagtgtc

SEQ ID NO: 551 - DNA, 573 bp, Zea mays
  Clone ID: LIB3179-027-P1-N6-C6
gtgtgaagacgaaaactgtagagatggacagatcggcggagtacaaagcaggaagcaacagctaatacatgaatggatatcgatcgatagctagcttaattagttgacggtgatcttgccgaccattccggctccttgatgcggctcgcagtagaagccgtaggttcccggcacggtgagggtgacggagtaggtctcgcctggcgcgttgaggtactcctcctgcgagatcttggtggcgtcgacgccgctcggcacctcgtcttcgtcgaagacgacgttgtgcgggaagccggcgttgttcttgaatgtgatggtgtcgccggccttgacggtgaactggctgggctcgaagacgagcccgccgtcgcctgcgcccagcagcacctcctgggccatggcaccgccggcaagcagggcgctggcagccattgccacggcggcggtgccggtggccttgcggagagaggcgcgcacggtgaaggacctccttctgaccacggcgcgggctggcgctggtgcggcgaaggaggggcggtgacggcggcagaggagagcggtcgcgtgggtcga

SEQ ID NO: 552 - DNA, 571 bp, Zea mays
  Clone ID: LIB3179-027-P1-N6-C7
aaccagcagggaaacaaaaaccaccactattgcacaaacatggttcatcttagtgtacaacgccaactcatcatctcgacttgcctatgcaatgcaacgtgaaacaaaagacacacatgcatttcgcagcatcaatcaatccacgtacgtacaccctttccgatccgaaagacaatgaagttgcatagcatagccgttgagcttagttgccggggaccaagttggtggcgtaggcccatgcgttgttgttgactgggtcagcgatgtggtcagcgaggttctcgagcgggcccttgccggtgacgatggcctggacgaagaagccgaacatggaaaacatggcgaggcggccgttcttgagctccttcaccttgagctcggcgaaggcctcggggtcgtcggccaggccgagggggtcgaagctgccgccagggtacagcgggtcgacgacctcgccgagcggcccgccggcaatacggtagccctcgacggcgcccatgagcacgacctggcaggcccagatggcgaggatgctctgcgcgtggatcaggctggggttgccaaggtagtc

SEQ ID NO: 553 - DNA, 358 bp, Zea mays
  Clone ID: LIB3179-027-P1-N6-C8
ctggggcggcgtgaagaggcacgccgccggcgctgctttgctgctgctgctgcttgacgccgaccgccgcggcccgcttgcaggccccgaggacggcaggcgcgcgctggtcggcggcggcggcgagcgggacgacggggaggttgtcgcagttgcagacctcgatcatgaaggcgtccgggtcgtggaagaagatctggtccacgttgatgccgccctcctccacgcagcgctgcacgtacgggatgcccatctccttgagccgccgctccaccgccaccatgctctcgcatgtccagtaaagaaattttttactccgccccggccccatagcaaagcaagcaaggtacgaatcctt

SEQ ID NO: 554 - DNA, 429 bp, Zea mays
  Clone ID: LIB3179-027-P1-N6-D1
agcttaattgcatgcatgcatcattagatatagtaacagtgatggatcgttacacgctgcagaagcatgcgcttagtcgttatttgcagacgataataagtagatcgatggagtagtgatcgagcaacacacacgtgacgacgtttgctcttatttacttacacgcacgcacgtgtacggcgctaggggccgtatatatatcgagttctgcatgcatatctcgatcgatgggatgatcagtcgtttcagtcgcagtagtaggagtagccgtgcccgtgcccgtgcccgtgcggcaccctgtgctcctgctgcctgctctcgtagtgggcctccttctgctcgcggtgctcgtggtacgcgtagccgccggcgcccagcgccgccgccgttgccacgccggcctcgatcttgtgcctctgcgcgttcgcc

SEQ ID NO: 555 - DNA, 384 bp, Zea mays
  unsure (1)..(384): unsure at all n locations; Clone ID: LIB3179-027-P1-N6-D11
gggcggccagcgcctccaccgctgccgcgtctacgacgagcgctgctggcctcggctgcgacgccgcggacgccagggaagaggaggaggaggtaggggacgacggcgacctcgacgccgagaagcagctctggcacaggttctgcgtggccgggttacccgggaacccgcagttgttggcgcagagcgtgatctccggcgcccggagctccgtgggctcctccttcttgtcgcgctgcgccatggctcctcgtgcgcctggcagaagggagaccccgaaccaccgtgcgtctctgtctgtctgtctgtgtgtgtgtgtgtgagcgcgtgcgcgcgcgcgcggtggtggtggcggcccggccggngcttgcttttcggtggggt

SEQ ID NO: 556 - DNA, 602 bp, Zea mays
  unsure (1)..(602): unsure at all n locations; Clone ID: LIB3179-027-P1-N6-D6
ttttttttttttttttttttttttttttttttttttttttttttttttttttttttttttttttttttttttttttttttttttttttttttttttttttttttttttttttttttttttttttttttttttgtggggggggggtgttttttttttttttttttttttttgggggggtttggggtttgggtttntgttttttttgtgggttggnnggttttgtttgggttttggggttttttgtttttggtttttgttgtttttttttgggtgtttgttttttttttttttgggggttttttgttttttgttggtgggttttttgttggggtttttttttttttttttgggggggggggtgtgggttttttttttgtttttgtttttggggggttttttgttttttgttttgttttgtttgggggtggtttttttttttgtngtttttggttttttgtggggttttgtgttttgtttttnttttntttttttttggtttgggtttttgtttgtgttttttttttttttttttgttgtgggttttttgttttggtgtttttttgggtggttttttttttgtggtttttttttttttttntaat

SEQ ID NO: 557 - DNA, 462 bp, Zea mays
  Clone ID: LIB3179-027-P1-N6-D7
ggactgggggactttcttaatataaggatcattgcctggtttcatgtttacaaaaaaaaacagtccccacagcagcactattttgtttgggggtggggttcagagttattacagggaaacaaatgctctgaaaaccgactatcgcgtggggtttttttgacaaccctttttgacaaactaaacaatggaacggacaaatttgtaagcacatccacaagtaactgggatatcgaccaccacttccgtctccctccgctttttccttcgccttggctcagctcagtacgggataggcgagctgagtccttcctggatggccatggggtgcggcgggttgtgccccttggacatggaccccatggccagcgttttcctgaaggaggcgccccgctcgaaacccttgacggtgaatcgtgtgtaggccacccggttgtatggcgcaccggcctccttcaccttggg

SEQ ID NO: 558 - DNA, 594 bp, Zea mays
  Clone ID: LIB3179-027-P1-N6-D8
aaaaaacgacagcccgaatttgcattaacaagtacattacatacacgattcctcctctgctctccaaagttttccatggtatacatacaccttcccaagatccatgacggcggtcggacacctagcagttagacactcgaatcactcgagctgagcgtaccagaccccctggatcttgacatccttgggcgccttggccccgaggtcggtgtcggacggctgcacgctctcgaagacgccgatgacctcgccggtctccgggttgctcttggtgacgctcaacgtgatgttgccggtggaggaggcggcgttcttgatgttctccttctggagctcctcctcgtcacctctgcccccggcggggagcgcgacggcgttgtcgtagccggtggagccgccgcggcccttggggtcgaggaaggaggagccgcggtagctgggcacgaggaagggcccgccgaagctctcgggcttgccggtggcgacgagctgcttgacggtgaagaggaacggcacgcgctcgccccccgggagctgcacggtgacggcggcgtagtcgatgccgtccttctcctcgaacttgagcgtgccgtc

SEQ ID NO: 559 - DNA, 340 bp, Zea mays
  Clone ID: LIB3179-027-P1-N6-D9
gttatgtattatggctatttccatatcttttttttatgtaatgagcctatcctctatcctctcttttctgtttgtatttctatatacccaaacttatataagactagatgaatattaagaggactcttccaactagataaaaatctatcatggtcagcaaagttgtttctttatttgtgtttgctctgttagttaataatttcaatttcattaagaaaaactaactaaataaatggaaaataaaaattgatagaattccttttattttttcttcaaatccaaaaaatttctcttttttttatacataggtcgtcgatttggcattggaaaaagggctgcg

SEQ ID NO: 560 - DNA, 424 bp, Zea mays
  Clone ID: LIB3179-027-P1-N6-E10
tgaatacgtttatttatgcattacttaattagtgagaattcacacatccattattcggcatgcccgcgttatttcatcgtatatatatttatttcaagttctggggcaaggaaaggaaatagcggctagcttatatattatcagccgatgtggggcgtctgggcgacgatgtcgacgaagatgcggacacggttagggcgataatccgcggtcaccacggagccgacgggcagcaccacgatgtcggcgtccggcttgtccttgaggatcaccttcttggcgtcctccacgctcagcccgaccacctcaggccacgacgtcttggcgccgccgccgccgccgccgcactccgtggagctcatggtgtcgcgaactgccggaccagttgacgatatgatcgatgggcaggtaaatcttgcttgtt

SEQ ID NO: 561 - DNA, 468 bp, Zea mays
  unsure (1)..(468): unsure at all n locations; Clone ID: LIB3179-027-P1-N6-E11
gcacgcgttcgttaagcttggnacctctagaacggccgccctggggggtgtttttttttttttttttttttttttttttttttttttttttttttttttttttttttccggaaacagggttccaccgggcccttttttttttcggggggtccgattttcggcgcccccgtttaaccggggctcgcttttggggcgggcggggggggaataaaacgggccgccctgggcttggtttgcccctccccacccgggccccccttggccgggcatttcccccacccgttaaaggagacttccttgttcttaaccccacaataacccccctggcttttttccccctgggcgtttctccccctggggtttttttttttttttcccgctgccttggcgctgccggggtgtctttctgccgggtccggcttgtggagggttccccccggttatgtcccgctgcccgcccccccggtt

SEQ ID NO: 562 - DNA, 329 bp, Zea mays
  unsure (1)..(329): unsure at all n locations; Clone ID: LIB3179-027-P1-N6-E12
gcacgcgtactttagcttggntcctctanacggccggccgttgttgggtgtttttgcacaaacatggttcatcttagtgtacaacgccaactcatcatctcgacttgcctatgcaatgcanacgtgaaacaaaagacacacatgcatctcgcagcatcaatcaatccacgtacgtacaccctctccgatccgaagggcagggaagttgcatagcatagccgttgagcttagttgccggggacgaagttggtggcgtaggcccatgcgttgttgttgactgggtcagcgatgtggtcagcgaggttctcgagcgggcccttgccggtgac

SEQ ID NO: 563 - DNA, 136 bp, Zea mays
  unsure (1)..(136): unsure at all n locations; Clone ID: LIB3179-027-P1-N6-E2
ggtggggggggggttggtggtttntttttttttggttttttggggttggtttttttnntttttttttttgttttgtgtttntttttttttttggggggtggttttntnnttttttttttttttttttttttttttt

SEQ ID NO: 564 - DNA, 611 bp, Zea mays
  Clone ID: LIB3179-027-P1-N6-E5
gtgaaaacagcttatatactgtggaccgaagcccaacttgtttttttgtttacagatatatatcccaacatgccctgccttcttgttttttttgtttacagatatatatcccacatatatactgtggaccgaagcccagacttgcaaactagtatcagagaactggtcacaagcgatatgacgaggtgattctgtctcttctctaatgcacagggcatggcgttttagtgacatacaactggacgatcaatcatccaccaacgtggtgctgcactgcacggtcatctcttccactggggcagccgttggaccacaaccttgccagagttctctttgttgcctacaatagtctggcaagctagcctccatgagtctggtttcttcttcaggtaccgattctcggtgttcgtcctctcattcaggagctcctttccatcgattatctcgacgatgcaagtgccgcaacttccgccgccaccgcagttcatcaccttaccgtatgcggcgtagagctcgatcttgttctcgttcatgacgtcacggaggagcttctcgccgctggccgcctccgcccggtccaccgggaaaggagccgtcggcaccgggcttcg

SEQ ID NO: 565 - DNA, 606 bp, Zea mays
  Clone ID: LIB3179-027-P1-N6-E9
ccaagtgaagtgtctttgaattgattgagatcggcagtacatttcacgagatcgttcagggatggtctttatagatacatacactatactagtccacagtcttcttgtatgtgtaccatcgtgcgatgagcaggtagacgccgaagtttccggcgcagagcatggccagcagccagaagaagttgtcaaggtgcgcccggttgatgtcgtcggggatccagccatcccgcccgccccgcgcggtggcgcgcgccaccacggtgacgagcgcggagctgacgtagttcccgagcgcgaaggacgtcatggagagccccgagcagaggctccgcatcgcgtcgggcgcctggtcgtagaagaactccatctggcctatgaacgtgaacacctccgacgcacccaccaccacgtactgcggcacctgccagaagatggacagcggcaggtactcgccgtccccgccggcgcccgtgttggtgtcgtacatgtcgtggcgcgcgataacgcggcgccgcgccacctccagcgcccccgcggcgagcatggcggcggtgagcacgacgaggcccacgcccatgcgcgccagctgcgtgaacccgcggtcgt

SEQ ID NO: 566 - DNA, 321 bp, Zea mays
  Clone ID: LIB3179-027-P1-N6-F1
ggcctgcagcgccatccgacgcaaaatggttccaagtaccagttttttttgacacttgagaattacagcttccaagtgacacaatacagcagcattcagcaccacacgcggcactgtgctgcaaacccaattcggttcatcgttgtccaggaaggattgaacgaatacatggaggcacgtccaggtcccggcttcacatcgcgtcagcgaccccaaaggcctggttgtggtagtgctgcatggcgtgcctctgggtccaggtcctcgcggtgttctgttgcttgtgcctgtccgtcttgtgcctgtgtgctgtgtgtgggg

SEQ ID NO: 567 - DNA, 606 bp, Zea mays
  Clone ID: LIB3179-027-P1-N6-F10
gaaacgtaaacaactaaacatgtaagtaaatcagagttgcatacattttttcggtcctcgtaccacgatcatacacaagcacatgcatacacacacgtatacatacgatagattacgtagccacgcttattcgtgcatcacacgagcgcatacatacgtacgcgcgcacaacacggcgggcgctcgatatcactctcacacacgcacgcgtagcacacggggagggacgacgatacgggaggatcaatcagccgaagaagtggtgcttcttctcgccgccggcctcctcggcgtccttgtggtccttcttcttctcgtggtgctcgtggaaggcgaagccgccggagccgacggccgccgccgccgcgacctcctcctcgatcttgtggcggtgcgcgtgctccgggtccttctttgcctcgtgcttctcgtagagtgcgaaggcgccggcggcgatggcgccggcctcgccgaggtgctgcttgtgcttgtgctgcttctcctccttcttgtactcgtcgtactcgttctcgcccgtggacacgacctccgtcaccgtggcctccgtgtactcggcggactcgccgtacccgccgccggcgagct

SEQ ID NO: 568 - DNA, 367 bp, Zea mays
  unsure (1)..(367): unsure at all n locations; Clone ID: LIB3179-027-P1-N6-F11
gtggggggntttttnttttttttttgtgggggggggggtttttttttttttttttttttttttttgttttgttttgttttttttttttgtgttttttgggggggttttttggtttttttttttgttttttttttttttttttgttttgggtggttttttttttgtggttttttttttttttttgntttttttttggttttttttttttgtttttgtgttttgtngtgtttggttagttttttgtggggttgtnttgtgtttttttttttttttttttttgttgtttttttgtttttttttttttttttttttgtttggttttttttgtgttttttttttttgttttttgtttttttttgtttttttt

SEQ ID NO: 569 - DNA, 432 bp, Zea mays
  unsure (1)..(432): unsure at all n locations; Clone ID: LIB3179-027-P1-N6-F12
cgtttcttaacttggnatcctctaaacggccggcctgttttggtgtttttttttttttttttttttttttctttttttatatatatagggtcaaatcatatcatcgtgggcccattaatttttggttcccgcggacccaatcgggtcaacccacattcctgtggacccccgtccctgtgcccaaaggctggcgcccaacctgccgngggggagattgcaaactggagaactctgtttttctctctctttcacaccccccacatttcctttgtttggcagcccgctcggcctcgctttttattggtcaacccccccccccggctcggtcggtggtcttcctttccctggtcgtcgttcggtgtggtccgccgttgctggggtcgcccttgcggctgctccccgttccgccggcgtgggcggcctcgccggcct

SEQ ID NO: 570 - DNA, 398 bp, Zea mays
  unsure (1)..(398): unsure at all n locations; Clone ID: LIB3179-027-P1-N6-F2
gaaaccaaaggggttctcatgatttaaaaaaggggttttgtttaatggcctaccggacaaatagcccccctttgggttctcacccccccctgggtaaaacgcccaaacaaggagcttcccccagctccctgggcaggggtgcccaccgggagcccccccgaagacagacaggggatgcccctgccaatccttgcaggccaacaacttaacttttccccattttcgaccttgcgtccccaatgggcaatccatccttttcagaagatgcccgtccagggccctggggtcttttcatagccggggggggcgattcaatatccgtnaaatcagcaaaagcttcagggtttcccccccggggaccccttttaagaacatgaaaaccacgtccctcgggtaaa

SEQ ID NO: 571 - DNA, 259 bp, Zea mays
  Clone ID: LIB3179-027-P1-N6-F4
ctttcgattttttctattttatttaaagtggatcgatttagataatgtatatgatagtaatatacttcaaataaaataggaattcgcaaaatggagaaaatcgttgcagtcattataggaaagtatgggaagacttagagcatatcctatttaaaggaggatgaaattcaaatcaggtaagggatccttccttctattgatttgatcaaaattcttttttcttttcctgtctctctgatttgcgtttcgatgaatgagc

SEQ ID NO: 572 - DNA, 309 bp, Zea mays
  Clone ID: LIB3179-027-P1-N6-F5
ggggggggggggggttttttttttttttggtttttttttttggttgggtttttttttgtttttttttttttttggggggggggttttggggtggtgttggggcgagttttagggggggggggttttggggttaaatgggggggggcttttggggggggtttccttccttttggtgggggggcctcttttgggttttttccttggggttggtggggggggggtgttttttttttgtttggcccgtgtgtgggggggggtgggtttttttttgcgccccggggggttttttttttgtcctcgggggggggg

SEQ ID NO: 573 - DNA, 388 bp, Zea mays
  Clone ID: LIB3179-027-P1-N6-F6
cgtcctgccgcgtactaagctggtcctctagacggccgccttttttttttttttttggaatggatcagcttctttaactgattcggagagttgcatgtgataaaaacttggaatggatcagcttcttgaactgattcggagtactttcgaagagaatactctgatacggggtcataaggtcatttctttcctgtaaatggctttgtaaatgacaggatagaagacaatgttgcaaagcattgttccttgtctacgccacatgcttgctgaaactcccctgcctcaatcagcttgaagctttgcctcacctgctttctcagcttcattcagcacgaagttcttcagcgattccacatccctaggtcctttatattttactacttcttcg

SEQ ID NO: 574 - DNA, 126 bp, Zea mays
  Clone ID: LIB3179-027-P1-N6-F7
ctaaaaggacaaaatttttataatcgggggcgggggggggaaccaaaaaacccggggggcaaacccccccccttggggggggccccccggggccccccgggggcccccagaaagaaagagagaaac

SEQ ID NO: 575 - DNA, 518 bp, Zea mays
  Clone ID: LIB3179-027-P1-N6-F8
aagccccctcaatcgaacagccatagaaaattattgatatgttctcctggggacaaggggcattaatctaaatgcaaaaactatctgctacttatgggattattacgggtacccatcggggggggtgccccgctgttctgatacagacgtttttcagaggtgtatgacaaaccgcccagatgtactagagaacccgaatctcttttagattggttcccaggtcttagctgggcttgggttcacttaggccgccactgattggtcttggatctcactgggtccagcatcacttgcgggggccccattaacaggaacctcagtcacaggatccggtgcacttgaaccattcacctggatttcaccagctgccttaaaggcattgctggggggctgctttggaagggcctttggttgacctatggcagctgctgtttttggcattgcaacacctggagggtgagggggcacccagcggcgctgggggggggggctttccgggcgcgggggtcgacccggga

SEQ ID NO: 576 - DNA, 54 bp, Zea mays
  Clone ID: LIB3179-027-P1-N6-G1
cggggggggttttttttttttttttgtttgggtggtgtggtcctttcgttcgct

SEQ ID NO: 577 - DNA, 601 bp, Zea mays
  Clone ID: LIB3179-027-P1-N6-G10
ttttttttttttttttttttttttttttttttttttttttttttttttttttttttttttttttttttttttttttttttttttttttttttttttttttttttttttttttttttttttggggggcggggggggggggggggttttcggggggggtcctggggggggtacacttttttttataggggggttttttaaagggggggggtaaaagggaaaaaaggggtatcgggggaaaaatttttttccgccaaaattcccaaaaaaaaaaaggggggaaaaaaaaaaggaaaaaggggggggggaaaaggggggggtcaaacaaaaaaaaaggggggggggcccagggccgtttttcggggggaaaaacggggggggcccttttttttaaaaaaggcccaaaccggggggggggggggtttttttttttggcgcccgggggtttttttttttttcgcgggggggggggaaaagggtgttggcttcacacccttcgccccggagagggttctgaacggggcccccatttgtttgccccccagggggaaaaatttttttttgggggggtaaaggggggataaaaaaagaggggtttttgggg

SEQ ID NO: 578 - DNA, 90 bp, Zea mays
  Clone ID: LIB3179-027-P1-N6-G11
agatttgccgccggtatctctgcaatacatatacaggcttaagaaaatgagtctctcttgaaaggtagaatgcaggcaacactaggaatc

SEQ ID NO: 579 - DNA, 334 bp, Zea mays
  unsure (1)..(334): unsure at all n locations; Clone ID: LIB3179-027-P1-N6-G12
tgcggcgccgtcgtgctcagcgcgaggtctcggcggggctcgggctcggtggtgcgctgcgtcgccacggcgagtgatgtcccacctactgttggcgaaacaagttgaacttccttaagtcatacaaacgcccaatcccaagcatttacagtgcggggttacaagaacttctggtgcagcaacacctgatgagattcaaaggaacctatcagtatgatgctgtgtttgctcttggattcgtctctgtctttgttctgctcatggaagggtacccccgcttcgtggcccgggtttccatcttcatggcgtctctttcngcttttactgaagatcc

SEQ ID NO: 580 - DNA, 90 bp, Zea mays
  Clone ID: LIB3179-027-P1-N6-G3
gggggaacgggggataacaaaaattaaacggacacattctgggtctagccccaacaccgaatcgggcccaatcccgggcgcggggggggg

SEQ ID NO: 581 - DNA, 233 bp, Zea mays
  Clone ID: LIB3179-027-P1-N6-G4
cgtcctgcacgctcgtagcttggtccttaggcgccgccttttttttttttttacaaaaaccaccctttgccaaactgttctcttagtgtcacgccaactatactcgcttgcctatcatgcaacgtgaacaaagaccacatgctctcgcacatcaatatccactcgtcacccttccgtccgaaagacatgaattgcatagcatagccgtggcttagttgccgggacaacgaccg

SEQ ID NO: 582 - DNA, 152 bp, Zea mays
  Clone ID: LIB3179-027-P1-N6-G5
caaaacattggggtggcaattgctctctgggtgtggtagaatttactcgaggcatgagtaagcaagcgtcttctcctccgtcagctcttgggcagtggcatccatcttcttccttgagaactcatcaatcgggaggccttgaacgattttcc

SEQ ID NO: 583 - DNA, 328 bp, Zea mays
  Clone ID: LIB3179-027-P1-N6-G8
acgggccaacatttattaattcaattatctttgcaacttaatatcctgattagggataaccacctaatttatgctgacaacattcagagcactggggtacaccaaaaggcggggggggaacacccgtttggatccacatcaaaacagggggtcaagatacgagttgttgtacaggcggccaaattgtagcaggctgccttacattctttcccacacaccaacgaaaagcgtgtcagtgtttgggctggacggtgtgccggattttttgccaaagaagtccagctcctgccttttgttgctgtcactctttacgttgttgttgtgccca

SEQ ID NO: 584 - DNA, 463 bp, Zea mays
  Clone ID: LIB3179-027-P1-N6-G9
aaagaaaaaaaatcccttttaaaaaaaaaatcctgtttaccaaataagggggaaggggggggtaaatgattgggttttaacaattttaaaagccccttattttaaaaacttgccctttggggaaaaggggggccccaaaaaaaggtttttccttggggggggggggggggggttaatttggttactttgggggtttaaaaaacgggaggccccaacccccttttttaaaaaagaaatccctgtccaaggaaattgggggggaaaaaaccactgcccttttagggaaagggagggggggaaaaaaatggagttttttaaaattttttgggggggaaaaattgggggtttgccccttataaccaaaccggtttggatactggccaaaatccgggaaggggttaaagccggggcccctccaatttccaacaatttgggccaaaatttttttttttttttccccccg

SEQ ID NO: 585 - DNA, 503 bp, Zea mays
  unsure (1)..(503): unsure at all n locations; Clone ID: LIB3179-027-P1-N6-H11
gcctgggttttgttttttaataataattttntctacatttccattaaaaaactttacaaatatatatataaacaatatatgtatgtatacattaggggtaaaaaatgagagtactgttaagttgtactatctggcgaacaatcgaaaaatgagctcaaccctgcagagtccagacaaggatggagccagctgagtcagtgtatgcattttccgggcacccgccacgagaaaccctgcgcgttgccagcggcggcgcgcgctctgtaggtcttccagtcctgtagcacgttcttgaggtcgaagagcttgttgtccagccccacgcagcagttggcgtgcatggtggccaccctgtccaggtcgtcgccgtgctggctgtacccccctgtgacggccgtgtccaggaactgcacccgggcgccggcgttcccttccttggcgatcctgtcggagacgtactgctcgtggtggcccgggtaccttgcgcgcggcgccttgccgtg

SEQ ID NO: 586 - DNA, 430 bp, Zea mays
  Clone ID: LIB3179-027-P1-N6-H5
ggggcaaccttggcggcctagtgccccactggggggcgggacaaatggcctccccaaaaagcccttgtttttaaccccccagtcccacccaagggaaaccctggccccaaggctggtcccggtttcatagcccccccgggttttcgggggtcatgcctgacttaccggccaatacctttaatttccaatttctggattttccaaccttcctcccccctgaaaccggggggccggtttctgggcccttttttcagggtttaagcaattaaaaaatcctccctccctgaaggggccggatggccccaccccaggcctttggttccctcaaaaccaaattggcccttaatgggggccaaaggggggcccgcccaacccctttatgggggtttgggccaaaatttgggccccggttaggcctggttcaaggtta

SEQ ID NO: 587 - DNA, 235 bp, Zea mays
  Clone ID: LIB3179-027-P1-N6-H6
agcacgcgtacgtaacttggaccctaacggccgccttgtttttttttttttttttttttttttttttttgttttttttttgtgtggggttgcgcggtccctgttttctgcggccttccggccgccgggggcgggcgtgccgccccgccgcctgcccgggggggggggggggttggggggggggggtcctttttttcgcccgggggggctgcgccccggcggggggccccccgggg

SEQ ID NO: 588 - DNA, 491 bp, Zea mays
  unsure (1)..(491): unsure at all n locations; Clone ID: LIB3179-027-P1-N6-H7
acgaccgttcgctgattagtagcttcaaatgacatactgtacagaattgacatggtctatgcctatcgcaatgtagttcaagatactagtactagtagtcacgacttcaacaggaggcacatcaagcaactcgaattccggtcttgtacacactgaagctcgccacaggtccatggtgaagaaacaaactagacacctcagctgacgaaggtagggaggaagaacaggtatatattgttttatttacactcgggacggcatgctaaaaggctgaggaatcgcccggaagtgcgcccggagtcgcgatgcaagcggccggcatcagtnggagatgtcgacgagcgcgaccatggcgtgcgcgacgacggcatccccgtgcgcccgctgctgcacggcgcggagcgaggcgtaccggtggtggctcggcggctgcagcacgggcacggcggcccgggcggcggcgcccgcgttccgccgctgctcggctccgt

SEQ ID NO: 589 - DNA, 553 bp, Zea mays
  Clone ID: LIB3179-027-P1-N6-H9
ataaaaggaccagttattaaagtattgtcggcgcctcggcagttttgtatatatatctattacacattacacatgtatggtagccggagcttgcattcacatatatgttcctcacccaacgaatcgacagtcgttgcactacgtacgtaattgtagatggatgatgccatgctggatacatcagcaggagaattgttggaagcaaaaggaaccattgcatgcaggagaaaagaaatgatgagataaagggaaaaaaaggagggagagagagagaggaaccaatgcaagaaggtgatccgatcaacaggcagaggcatggccatgggtcgatctagccacggtctctactcgctgccggggggcttgttggcgatgaagctgacgcactgcgtctgcctgacgttgtcgaagccgatgacgcggtggaaggcgtccgggtacgcggcgatggcctcctgcagctccttgtacacctgcgtggcgtctgtgcagccgaacatgggcagcttccacatggtccagttgcggccgtcgttgttgctcggggtggtgg

SEQ ID NO: 590 - DNA, 331 bp, Zea mays
  Clone ID: LIB3179-028-P1-K6-A1
gcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcatgtggactacctgttgcgcaacggctggataccctctct

SEQ ID NO: 591 - DNA, 274 bp, Zea mays
  Clone ID: LIB3179-028-P1-K6-A10
ggcgcttccacgcgcccaagcagcccgcggcgctggtctggccggccatgtcctgcctcgcggcgccgccggctgcaccgccaaaggcgggggagcgcatgctccgcgccgccgctcctttgcgctcgccttcgccgtgccggggcctgcattacgcggtgcgggggtctggagggcgagaagcctggtgcggccggccgtagctggcgctgctgcggtgcttcccagctggacgagatcagggcctcccgtcgacggtggccttttcagcttt

SEQ ID NO: 592 - DNA, 408 bp, Zea mays
  unsure (1)..(408): unsure at all n locations; Clone ID: LIB3179-028-P1-K6-A2
ctcgncaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaggggcaagccgccgctccctccctcgccgccgggcaccctccccatcgtggggcacctacaccacatcgggccccagacccacatctcgctccaggagctggtggccaagtacgggcacaacgggttcctgttccttcgcgccggcgccgtgcccaccctgatcgtgtcgtcgcccagcgccgccgtggccgtgatgcgcacccacgaccacattttcgcgtcccggccgtggtccatggtctgccacat

SEQ ID NO: 593 - DNA, 230 bp, Zea mays
  unsure (1)..(230): unsure at all n locations; Clone ID: LIB3179-028-P1-K6-A3
cagcttccggntggtggcgttttgtcagttttggatggaaatgccgaactggcagcgtctgttttccctatgcatatgtaatttcctgcctctttatattcactcttgttgtcaagtccanagtggaaaatcttggcatattatacatattgtaataataagcatcgtacaatctgcatgctgttttgtaataattaattaatatcccagcccattggatggacttgttt

SEQ ID NO: 594 - DNA, 309 bp, Zea mays
  unsure (1)..(309): unsure at all n locations; Clone ID: LIB3179-028-P1-K6-A4
cgggccactttttgtnntgatgtcttatnnctttcgtgtcaatnntgtgtttttgcttttgtcccgtagaaccctttcagggatattctggnnagtgtattctnntcaagtattgtgnatattatattatacccgattcaagaaaccctgtctgggnnatgattatttcaaatctttcgggnacacgtgccnntgtttggatcattttatataacaacatncnngcaaatgtctnntgtgtattgtaacaaattttttacnntctggaacctgctaatnngctcagttaagaagtggggncctnannna

SEQ ID NO: 595 - DNA, 317 bp, Zea mays
  unsure (1)..(317): unsure at all n locations; Clone ID: LIB3179-028-P1-K6-A5
cccggggtcaacccgggggccggcgaggtcatcggcgtcttcgagggcgtgcagccgtccgacaccgacctcggggccaaggcgcccaaggatgtcaagatccaggggtctggtacgctcagctcgagtgattcgagtgtctaactgctaggtgtccgaccgccgtcatggatcttgggaaggtgtatgtataccatgngaaaactttggagagcagaggaggaatcgtgtatgtaatgtacttgttaatgcaaattcgggctgtcgcttttttactcaaaaaaaaaaaaataaaaaaataataataataataaaaa

SEQ ID NO: 596 - DNA, 222 bp, Zea mays
  Clone ID: LIB3179-028-P1-K6-A6
aacggagcgtccaggccatgaaagatggatggctgacttggcgcagagcctgggaatgcctgcgggcctcggcgatggtctcaagtgatgccgcaattcgggaaagctttccaataatcctttttcctcaattttgtatgctagccgtgtgagtagtaagcataaccccttctcgacctctcataagaagtgtacttgtgagcacttgttttctttcaaatt

SEQ ID NO: 597 - DNA, 105 bp, Zea mays
  Clone ID: LIB3179-028-P1-K6-A7
cttttgtgtaccgcgtgtacccctttttcctgatgtctgttcccgtgtaccaaggggtgtttggttccctcttctaatttctaatcacatgagatgttttcggtc

SEQ ID NO: 598 - DNA, 337 bp, Zea mays
  Clone ID: LIB3179-028-P1-K6-A8
tctccatctagctccctaactgcaccggccgccacaccaccccgaccggaccctccacaacaatggccaccgtcctgggcagcccccgcgcgccggccttcttcttttcgtcgtcctccctccgcgccgcgccggcgcctaccgccgtggcgctgcctgcggccaaggtgggcatcatgggccgtagcgccagcagcaggcgcaggctgcgcgcgcaggccacctacaacgcgaagctgatcacccccgagggggtggtggtgctgcaggtgcccttcgacttgatcatactcaaccaggccgaggaggactgcatctacctgaccaacttcctgcc

SEQ ID NO: 599 - DNA, 66 bp, Zea mays
  Clone ID: LIB3179-028-P1-K6-A9
gtccagccatggacatatgccgacgaggtaaaaaaaaagtctttgttggtattcatacagttatgc

SEQ ID NO: 600 - DNA, 475 bp, Zea mays
  Clone ID: LIB3179-028-P1-K6-B1
gcggccttcacggtgcacacgagcgccgccacctcgccctactcgccggcgggcacggccatccttctccgaagccggagtcgagcctaccccaccgccaccatccgcgtgtcgtgctcgaagacggtggtgatcggagtggcggcggactcagggtgcgggaagaccacgttcacgcggcgcctggcgagcgtgttgggcggtggggcggagccaccgagggccggccggaacccgggctccaacacgctcgtcagcgacaccaccacggtgatctgcctggacgactaccactcgctggaccgggccgcgcggaaggcgaagggcgtcacggcgctggacccgaaggtcatcgacttcgacctcatgtacgagcaggtgagggccatcaaggagggccgcgccgtcgagaaacccgtctacaaccacgtcaccggccttctcgacccgcccgagttcatcaccccgccgaaca

SEQ ID NO: 601 - DNA, 435 bp, Zea mays
  unsure (1)..(435): unsure at all n locations; Clone ID: LIB3179-028-P1-K6-B12
gttacatcaaggtggtgaagtacatcaaccatgctggaaacgctgatactcgaccctcagtgtttgtgagcgcaacagccattggctattatggtaccagcngaaatccatagctttgatgaatcaagtccctcgggcaatgactacctagctgaggtgtgcagagaatgggaggccacggcatgccaagtaaaccaggaggatgttaggcttgtacttctccggattggggttgttcttggcaaggacggcggtgctctagcaaagatgatacccctttttatgatgtttgctggtggtcctctggggacgggacgccaatggttttcttggattcatctggatgacctagtcaacctcatctatgaatctcttacgaaccctacatacaaaggtgtaatcaatggaactgcacctaataccgtgcgtttcgct

SEQ ID NO: 602 - DNA, 168 bp, Zea mays
  Clone ID: LIB3179-028-P1-K6-B4
aaaaagtaagagcaagtttcccctttgagtttgagcgaaaaacaaaatgcaaaaaaaaagtttgattcagagggagaagaagcggcagaaattagaacaaaaattcatttgattcgtcgatccttaaaaaaaagataagaagcaaagtttcccctttgagtttgagcg

SEQ ID NO: 603 - DNA, 210 bp, Zea mays
  unsure (1)..(210): unsure at all n locations; Clone ID: LIB3179-028-P1-K6-B8
ctccatctcgnccgtcgctcaccgggnaagctacgctacgacgaagctggcgtccgtcaccgcccgcgccccggtcgcggccctgcgcccgtcggcgtctctcaagtcgtcgtcgtcgtcggcggcggccttccttggccactctagccgtcttgtccgcactgttaccgtgtcgtcgactaggcgcagcctaaaggcggtggccaaggg

SEQ ID NO: 604 - DNA, 365 bp, Zea mays
  unsure (1)..(365): unsure at all n locations; Clone ID: LIB3179-028-P1-K6-C1
cggggcactcggtcctgtacgtcgggttcctcgncgccgccaanaagtagcaggcgccggaggctgagggcgccgccaccgccgcggcattgtaggtggatgctcatgcctgtgcgtgcacacagacacatgcgccgtgctgttgtataacgtgcaccggagaaggggaactgtatgtatagattcagggccttgcaggttgcagagttttataggctgtaatcgagcaggtcggtaaggaggcaggcatgtcagaacttaggctgtcttcagttcatttgtcccatttggaactgttttgttataagtctaatctctgttgagagaatgctatatggtgttattgtccatactaacattctctt

SEQ ID NO: 605 - DNA, 333 bp, Zea mays
  unsure (1)..(333): unsure at all n locations; Clone ID: LIB3179-028-P1-K6-C11
nggcaaatgcaggtgtccttacaaacttcgaagtccttgacttcttgcggtcaagaggtgccaaaattgacccaatgggatgtttgggggctgttgctgtatcagagtgtaaggtgtatgagtatatcttaaaaacccctgcttgcaaccagacaagggaatccatttatgaatttgtgaagagaagtgagggtttcaggcttgcagaggctgataagttaaatgttatcaactggagaccatcctcacctgccgatgcctatgcgatgatagaataatgtgggaaacgattttccagggatgaacgagcagaatcatgttgatgaagatgaa

SEQ ID NO: 606 - DNA, 560 bp, Zea mays
  Clone ID: LIB3179-028-P1-K6-C12
ggggacagtatgcagttgcacttggactacttgatgagggcaaagttgttctgggtgtgttgggatgtccaaatcttccattaaaatcaacaaacaagaacaatagcagctcttttggggatcgaataggttccctcttttttgctacaattggttgtggagcgcaagttgaggccttagaaggatctgagccacaaaagattagtgtttgctccaccaataatccagttgacgcctcattctttgaatcctttgaagcatcacactccaagcgtgatttaactagctccattgcagagaaacttggtgtccgagctcctcctgttagaatggatagccaagcaaaatatggtgccctagcacgtggtgatggtgccatttttctgcgcatcccgcacaaaagttacatagaaacagtttgggatcatgcagctggatcaattattgtcacagaagctggtggcatggtaaaagatgccgcatgaaacgatctggatctttgcaaaggtagatatcttgatcgtgacacgagaattattgcaacaaacaagcatttaatg

SEQ ID NO: 607 - DNA, 507 bp, Zea mays
  unsure (1)..(507): unsure at all n locations; Clone ID: LIB3179-028-P1-K6-C2
ccttggcctnatttctctggcactatattanntctgttcctcccattcanacctgaanagatatnnccggttgctgcnnttttcttatcattgcaacggtntcgtggttnntccttctcaactttggncgtgtactatnngctactagggctgcacttaggtcttacattttccaatggagctcccctgttgcttttcattacatngcttcgtgacactatttgctttggtcattgctataaccaaagatctccctgatgttgaaggagatcgcaagtatcaaatatcaactttggcaacaaagcttggtgtcagaaatattgcattccttggatctggtttattattagcaaactatattgctgctattgctgtagcttttaccatgcctcaggctttcaggtgcactgtaatggttcctgtgcatgctgtccttgctggtggtttaattttccagacatgggttctggagcaagcgaagttcagaaaggttgctttttcgcagtt

SEQ ID NO: 608 - DNA, 186 bp, Zea mays
  Clone ID: LIB3179-028-P1-K6-C4
gtggggctactcgcaggggtcgtcgacctcgctgacatctgcgccaaccagtggaagtgaagcgttgcattgtaatagcactttgtaactcctcaccctccacagggctttgggattcaccccgaaatgactcactttcggtgaaattcacccgtttcggcgaggtcgtccgaaggggaagatatt

SEQ ID NO: 609 - DNA, 194 bp, Zea mays
  Clone ID: LIB3179-028-P1-K6-C5
aaaaatattttgatcaaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccacttt

SEQ ID NO: 610 - DNA, 342 bp, Zea mays
  Clone ID: LIB3179-028-P1-K6-C6
cccgggttcggtcggtaacgcacgcagcggcggcggcgcccgggagtgaggagagagtctgcaggatccagcaggccgagggaggagtcagcggcgggccggagtaatatgagcggcaacggcgccgaagaggtggtcgatgcggcggtgaaggccggcaggacgatcatcgactgggacggcatggccaagttgctcgtcaccgacgaggcgctcaaggagttcgccgccctccgccgcgctttcgatgacatcaaccaccatctccccaccaagttcttccatgatccccatccttttgattgggaggtctacataataggtattggatcaaatatggtg

SEQ ID NO: 611 - DNA, 220 bp, Zea mays
  unsure (1)..(220): unsure at all n locations; Clone ID: LIB3179-028-P1-K6-C7
cccgggnatcacacctgtcaaccacacacaacacaacacacccgatacgaagaagcttcttgtctagctagccgcgcccgcgcgccatgtcctccatgaagagaagcattgcgcctagcgttatcgtcgtcctactggtgctctcccttgaagccaccttctctgacgctgtccgcgcaatacccgacgccccgggcgggggcgccattttccttctttt

SEQ ID NO: 612 - DNA, 203 bp, Zea mays
  Clone ID: LIB3179-028-P1-K6-C8
caagagtggggctacaccaaccgcgtcgtcgacctgatccgacacatgttcaagacccagtaagagagaatatttctgcctccctatcgagggtcgtccccgcatggcctttggacgcataccatccttgctgcttgtctatgcttcgcataaatgtgaacggttcccctggacgctggtaccatgcttgccctgaacacagt

SEQ ID NO: 613 - DNA, 348 bp, Zea mays
  Clone ID: LIB3179-028-P1-K6-C9
ccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcaccttcgacgacgtgggccttgacgccgaccgctgcaaggtgctggtgaacatcgagcagcagtcccccgtcatcgcgcatggcgtgcacgggcactttacgaatcggcctgaggagatcggctcgggcgaccagtgccacattttttgtgtctccac

SEQ ID NO: 614 - DNA, 166 bp, Zea mays
  Clone ID: LIB3179-028-P1-K6-D1
tcgtccggtgcgcctggcaaacccacggaagctatcccgacccgctgccgctggcgctgacgctgcccctcgccctggtcgcgctgctcctgccggccgtccgtggtgccgcggagactccgtagtgcacgacggtgcacgcggtgtcgggcttcgcggtgcggct

SEQ ID NO: 615 - DNA, 188 bp, Zea mays
  unsure (1)..(188): unsure at all n locations; Clone ID: LIB3179-028-P1-K6-D10
ccgcagnatccaggggagtcccgtacgctcagctcgagtgattcgagtgtctaactgctaggtgtccgaccgccgtcatggatcttgggaaggtgtatgtataccatggcaaaactttggagagcagaggaggaatcgtgtatgtaatgtacttgttaatgcaaattcgggctgtctcttttttactc

SEQ ID NO: 616 - DNA, 500 bp, Zea mays
  unsure (1)..(500): unsure at all n locations; Clone ID: LIB3179-028-P1-K6-D11
cgtattcttatcgatactggnaactcagagcatagggggggaaagtcgatttatggatggaatcaaatacgcagtatttacagaaagcgtcttcgtttattgggaaagaatcaatatacttttaatgtcgaatcgggattcactaagacagaaataaagcattgggtcgaactcttctttggtgttaaggtagtagctgtgaatagccatcgactacccggaagggtagaagaatgggacctattctgggacatacaatgcattacagacgtatgatcattacccttcaaccgggttattctattccacttctagatagagaaacgaactaaaggagaatacttaataatatggcgaaacatttatacaaaacacctatcccgagcacacgcaagggaaccgtatacaggcaagtgaaatccaatccaagaaataaattgatccatggacggcaccgttgttgtaaaggccttaacgccagaagaatcatccccgcaggc

SEQ ID NO: 617 - DNA, 354 bp, Zea mays
  Clone ID: LIB3179-028-P1-K6-D12
gcgcttcccgcacttccccgccatcgacgaactctacagcgacggcatcccgctgccgccgcagaccgggttcgacgccatccgcaccgtcgtcccgcgcatggccaagctggtggaggacaccaccgaccacgtcctccgcttcgaggtgccggagatgatagagagggaccggttctcgtggttcaaggacgaggagttcgcgaggcagacgatcgcggggctcaacccgctgtgcattcagctgctgactgagttccccatcaagagcaagctggacccggaggtgtacggtccagcggagtccgtcatcaccaaggagattcttggagtaagcagatgaacggcgcgctg

SEQ ID NO: 618 - DNA, 92 bp, Zea mays
  unsure (1)..(92): unsure at all n locations; Clone ID: LIB3179-028-P1-K6-D2
cggtaccggcattcccggggnaaaaaaaattttaaaaaaaaaaaaaaaaaaaaaaacaagaagaggaaaagggaaaaaaaaaaaaaaaagaa

SEQ ID NO: 619 - DNA, 440 bp, Zea mays
  unsure (1)..(440): unsure at all n locations; Clone ID: LIB3179-028-P1-K6-D3
ngggcgcggccgtgcttcccatcagcgataatcagtgggtagctgtcagcctaccttattccatggaacaaagggatttctgttgccgtaatccggactgccacttaggaagataaaagcagacaaaacgatggatgctttgtgatgattatatagcttgtgatgctgagcattgcccgtgatgtactaaaatctagtgtaacaagactgccttgcgctggactacgattagtgtccctaatgcggagacttgtgtgactcctattgtatctagattaagctgtacttgtttgactatgtgcggaagtcttgagttacactcctatagtagaggacttgaactctggatggaccatccgcaacatttatcatgatcagacttttttcatactatctacttgagcttgttgtccttnannaaaacttcnnnnnnnnnnnna

SEQ ID NO: 620 - DNA, 451 bp, Zea mays
  unsure (1)..(451): unsure at all n locations; Clone ID: LIB3179-028-P1-K6-D4
cttaccttcacgtgagctccccctttggcgagttcatgcacattattccccacaacttgctgagcgatgaacgtatgtgagctcactcttgctgtctcacaccccccccacaggtcaagaacaggtactacaggatgaggcgcttggaggatgctgtgacgagttcgtgagaggtctaggtcgtcgtctcccagtcaactttggtttgctggaccgttgtcttcttataatgtaattatttattttgtaccaaactccgattatatagtaaagatgcgacattcgatcctgtgccatgattcanaataaataagaaagaaataagaataaaaaataagcaagtacttgaagtttcttaaatcgttggccccgtcgtactgtggggcagcccttggtctttgcgtgaacttgncgtttcgccttcttctttcagcttgcccacaggcccctc

SEQ ID NO: 621 - DNA, 186 bp, Zea mays
  Clone ID: LIB3179-028-P1-K6-D5
ggcagccaggcagacatggcgcccaccgtgatgatggcctcgtcggccaccgccgtcgctccgttccaggggctcaagtccaccgccagcctccccatcgcccgccgctccttcagaagcctcggcaacgtcagtaacgtcgtgaaggatccagtgcatgcaggtgttgccggcctacggcaacaa

SEQ ID NO: 622 - DNA, 234 bp, Zea mays
  Clone ID: LIB3179-028-P1-K6-D9
tttaactcgaactccatttcttagacatagatatacgttctgaacattcttcaaaatcaattaacacacagggtgatatagcactcacctagtcgatactatacagcacaggcacaggcacaggtacactggctgagtacgatcgatacgattggatttccgatcaggctcctttatgacggggtcgcaagttggtagacggtttacgtacggccccgcacaataccatacgag

SEQ ID NO: 623 - DNA, 284 bp, Zea mays
  Clone ID: LIB3179-028-P1-K6-E1
ctaataaggtaataaggggcgacgaaatggctccaacgaccgccaccaaggtacgacagtggctacggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgcctctgccgccgtcgacgtcgccctccgtcgacgccatcccggtggtggacctcttcgcgacgcgccgcgaggacct

SEQ ID NO: 624 - DNA, 338 bp, Zea mays
  unsure (1)..(338): unsure at all n locations; Clone ID: LIB3179-028-P1-K6-E3
gnaaacatttagaaacacttttcgttaatttgattttttatttccatttttagatttagctagtctgtacactgttgttggaaatgggtccgctgttgttggtcgatgcttgtggtggccaataatactacacccaactataccaggctctgcaatggcgaatcatggtgcacattatggtgctctgttgcgggaagaattgtagctgatgttgtacttatatactggcaaaaaggccccagaaatgtaaaaatgtatcgatatgctgacatcttaaaccctattttggattcgtgctctttcctatggatgaaggtgtgcgccatttaggggttgtt

SEQ ID NO: 625 - DNA, 304 bp, Zea mays
  unsure (1)..(304): unsure at all n locations; Clone ID: LIB3179-028-P1-K6-E4
gttcaagaaagactaccagctgttgcagganagngtaagagagacttacgaacatagtgttcgcatgctggagagagtggagagtggagactagagttgcgaggacttgtagtgatgtgcttgcttcacagtcacagggttgtcgattgttgtgtacggattgagatgtcgaagatttctcctgccaatgtgatgctgtcctagatttaaaaaaaaaaaaattaaaaaaataaaaaaaaaaaaaaaaaaaaaaaaaaaaaaaaaaataaaaaaataaaaaaaaaaaaaaaaaaaaaattaaaaa

SEQ ID NO: 626 - DNA, 352 bp, Zea mays
  unsure (1)..(352): unsure at all n locations; Clone ID: LIB3179-028-P1-K6-E5
cttgngnaggcgtcaaggtagcttttgaccacctataactatctccgaaagtttgagttcagtgcagacaacattgaacccctggtccagacctgcatgacaactctatcctcaaagatgttaaccgttgcaagcgggcgttggcagagattgctgtcaaagcagtacttgcggttgcagatttggagaggaaggatgttaacttggatctaattaaagtagaaggcaaggttggtgggaagctggaggacactgaacttgtatatggaattattgttgacaaagatatgagccatccacaaatgccaaaaagaattgaggatgctaagatagccatcttgacatgcccatt

SEQ ID NO: 627 - DNA, 359 bp, Zea mays
  unsure (1)..(359): unsure at all n locations; Clone ID: LIB3179-028-P1-K6-E6
catgnaaccactacacgcagtccttcatggacacaccgtcatggaggccaaggtcgtggtcagctcctgcggccacgacgggcccttcggcgccaccggcgtcaagtaggctccaggacatcggcatgatcagcgccgtgccggggatgaaggcgctcgacatgaacaccgccgaggacgatatctttctcctcacgcgcgaggtcgttcccggcatgatcgtcaccggaatggaggtcttttagattgactgtttccccagccaccgccccgacgtttggcgccatgatgatctccggccagaaggcggttcacctggcgctcaaggacctgggcaggcccaacgccggggacgggac

SEQ ID NO: 628 - DNA, 225 bp, Zea mays
  Clone ID: LIB3179-028-P1-K6-E7
gcccgtgtcgtgtagtgtccagtcgcagcagctagcgcccggccggccagtcgagtgagtccatcctccatcgccatccaatggccgccaccgccctgagcatgagcatcctccgcgcgccgccgccctgcttctcgtccccactcaggctcagggtcgcggttgccaattttttgagggcccccatgcggcgccagctgctgctcgcgcaggccacctacaacg

SEQ ID NO: 629 - DNA, 199 bp, Zea mays
  Clone ID: LIB3179-028-P1-K6-E9
cctggcctccctctcctctgccgccgtcaccgccccttccttcgccgcaccagcgccagcccgcgccgtggtcagaaggaggtccttcaccgtgcgcgcctctctccgcaaggccaccggcaccgccgccttggcaatggctgccagcgccctgcttgccggcggtgccttggtccaggaggtgcttctggtttcaggc

SEQ ID NO: 630 - DNA, 403 bp, Zea mays
  unsure (1)..(403): unsure at all n locations; Clone ID: LIB3179-028-P1-K6-F1
gttaattcctaagttaattccctgagctggtggaaataagccgactcggtggagagctgtcgacttctcaataaataattgctgcatgaaaaccacgatggtttatgttattcaaagtcttatatatatataatggattagtaccggngaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaagggggggcccgttttagaaggacccaactttccttccccttgtttgccaactttaattttttttttggggccccctaaatcaaatccactgcccgttctttacacaccttcgttcttggaaaaacccttcctttccccattt

SEQ ID NO: 631 - DNA, 411 bp, Zea mays
  Clone ID: LIB3179-028-P1-K6-F11
cacgcttatcaccactcccatctccatccaaaaccataaaaaaaaccagtgcgagctgaagcatccaggctctggaatcatcgtcgggatgtctgtgccagcatcagcccaggtgcctcacaccatacgatctgctgggagctgctgcttcaggtcgtcgcatcaactatctgcgcagaatctgggccgacatcgcaggtggcgggggaccggaaagaagaagatcctttccacccgtggcgtgcccgagtccaggaacggtgcgcatcctggtggccttactaagagaaggaaggtcgtggagcacatcatcctgctcagagccaagcccaacatcttatacgcttaatagaaagacatgctggactacctatacacatcgcaggaccagatgcgagggatactcaccgg

SEQ ID NO: 632 - DNA, 96 bp, Zea mays
  unsure (1)..(96): unsure at all n locations; Clone ID: LIB3179-028-P1-K6-F12
tcccgggtcgnacccacgttcgtccggaacaaaaaaaaaaaaacccccaaaaaaacaaaaagaacaaaataaaaataaaaaacaataaaaataaaa

SEQ ID NO: 633 - DNA, 434 bp, Zea mays
  Clone ID: LIB3179-028-P1-K6-F2
gcgagccccgtaagcgggtttagttagaggctacgggcggtcgggcgcggcggcggcggcggccatgagcagcgggagcgagagcactaccgccagcaggtggcccgagctggccacgctgcgcgccctggcgcgcgacgccgcggagcagctgcggctgccgcgggccggcacgtcggcgtcggcgtcggcgtcgtcgtcgccgtggcgcgggcgcgaggaccacctccacggccacggcaagacggccaaggtgatgcacctgctgctctggggacccaagtgaagcggtgagaggccaccgtaccgccggcgttgctcgttttgctctgcctgcaatccgccccgcacggactgtactgttctgaacctatacacctgtattctacgtcgtgcacatgtcctagctttcgacttgctgtttgtgccgtact

SEQ ID NO: 634 - DNA, 520 bp, Zea mays
  unsure (1)..(520): unsure at all n locations; Clone ID: LIB3179-028-P1-K6-F4
cccagctccggctcccactaanacagtcttcgtctcataatggaggcaaaacaggcagctcaggtgctgtttcgtcgccatcgtgctcgtcctgggtcttgtccttgagcagtcccatgcaggctgaagctagaggcaaatggtgctgcngaaaccgccaccggnaaaataccattttaatcgctgcgttgactcgggttgggtcgacaatattgggttctgtgcgagtaatgccggttgcatcattatggaggacagatgtggaggtcgttggccagtgcctgctcgtgatgcgctttctctggatgtcatttgattaattataagcaagtacgtgaagttaagaaacgagggccagacgactgtcgtccagcgattggttatttgtgaacttgtcgtttgtcttcttatttcaactttccaataagccccttcgtgtaatcgtgtcctccccttcaaatttgtcgactgttgcgtaatcaaatctatatagcaaataaagacggcgccgtacgtgtat

SEQ ID NO: 635 - DNA, 322 bp, Zea mays
  Clone ID: LIB3179-028-P1-K6-F8
accagaccttaaataaccccgctaccccctcatcctgccatccaccagaagcagtgcgagcaggcggcgcggctcgaggccagcctccagggcacccggtgggccgccgccgtcaacgacgcgcgcagggccgacccggcctcgccctacaccgtcgcgcagtacaacttttttcttcgagtgcaccggcagggtcaacgagatctggatgctcttcgacgcgttctattacgcctgtttgtgacgcccccccaagcgtgctctaggggcactgtcgcgtacaaggaaggacgcgcatgcacctgtacagtgcagatgtgct

SEQ ID NO: 636 - DNA, 184 bp, Zea mays
  Clone ID: LIB3179-028-P1-K6-G1
cccagcgtccgcccagcgtccgcccagcgtccggcgattcgctcgctcggacctagcttcccttccaggagcgcagcgcccatggccatgtccacgcaagcctccgccgccacgcgccacctgctggccgtcgcctgggcgccggcggtgcaaccgcggcagatgagctcgcagctcgagctgc

SEQ ID NO: 637 - DNA, 201 bp, Zea mays
  unsure (1)..(201): unsure at all n locations; Clone ID: LIB3179-028-P1-K6-G10
cggcttcaggtctgtgagtgctcctacgtcctttgtcacagnatgagnatatatacatctattccagacctactctgctagtagggtctatgtcaaatataggtcgctgcatatatcagaataagaacttttgtacaattacaaaaaaaaaataaaaaaaataaacaaaaaaaaaaaaaaaaaaaaaaaaaaaataaaaat

SEQ ID NO: 638 - DNA, 134 bp, Zea mays
  unsure (1)..(134): unsure at all n locations; Clone ID: LIB3179-028-P1-K6-G2
nnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggg

SEQ ID NO: 639 - DNA, 381 bp, Zea mays
  unsure (1)..(381): unsure at all n locations; Clone ID: LIB3179-028-P1-K6-G3
cggncgcgccgttcggcgggtacaagnagagcgggttcggcaagggcatgggcatggacgcgctcgncaagtacctgcagaccaataccgtggtcactccgctgtacaacactcctggctctgaccgaccgacctcatccctgtccgatgaacagttcaacatcacaaaacaagaagaaacatgtcttgtaagatactccaaaggatcggttgcctgcagtagctgtactcttacacctgcatggattgatgatgtcgtagtgcaatgtaacattcagaacaataaagacatgtttcggactgcattcagctagctagctgtgtgccgactgctggtgtctgatcggttgaagagcatgtttcagtattactgtttctttt

SEQ ID NO: 640 - DNA, 426 bp, Zea mays
  unsure (1)..(426): unsure at all n locations; Clone ID: LIB3179-028-P1-K6-G4
caccgccgctagaaaaaacgctcggcgattcccaggtcccgcgagaatatgccgaagcagatccatgagattaaggacttcctcctcaccgcgaggaggaaggatgcccgctcagtgcaanatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgacgaggtctgattggatacatggcaacgccgagttgaactacccaagcttctttatcagtagcagagcatgctactctatgtactttgggaacctaagctattagacctgtcagtgttggatgtctggatcttgcatttttggagaaataccatttaccttgttcaaggacgcaagta

SEQ ID NO: 641 - DNA, 198 bp, Zea mays
  unsure (1)..(198): unsure at all n locations; Clone ID: LIB3179-028-P1-K6-G5
ccagtgaatgatgntgnatgnatgctctcgtnaaacaaaaaaaaaaaaataaaaaaaaataaaaaaaaaaaaaaaaaaaaaaaaaaaaaaaaaaaaaaaaaaaaaaaaaattataaaaaaaaaaaaaaaaaaaaaaggtttgttcctttttagaggatccaattttacttactcttacttgccactttaaaatttttt

SEQ ID NO: 642 - DNA, 251 bp, Zea mays
  Clone ID: LIB3179-028-P1-K6-G6
ctgtaagcatgttaattccctcacagcttgtggatttatgctatctcaagtgagcaaatggttgtggcatgcccccaactgctcgcactaaatatagatataatgaggatgaattttgaatacttcaagaatgagatggagagggatttggaggagctggttgagtttcccgcattcttcacatatggcatcgagtcgactgtgaggccttagcatgagatggtgtcccggaaggtcctgacatgccccct

SEQ ID NO: 643 - DNA, 311 bp, Zea mays
  Clone ID: LIB3179-028-P1-K6-G7
gtaccggatcacccattcccgggcgctgccgtcgtcgtcgtcctcgtcagctggctccaggcactccaagtccgtctccgtgaatacgctcgccctgttcggcaaatccaaggtcaagaccgcgccggcgaagaagctgctgcgcccaagcccaagccgaaggttgaggatggtatcttcggcacgtccggcgggatcggtttcaccaatgagaacgagctgttcgttggccgcgttgccatgcttggctttgccgtattgctacttggagaggccattaccgccacgggcattcttgcgcagcttaacct

SEQ ID NO: 644 - DNA, 211 bp, Zea mays
  Clone ID: LIB3179-028-P1-K6-G8
cgatgcgaagtctgcagatatcaacgtgccacctgcaccagccaaccaaccagttggattgggggcaacattggagttgaagaagcagaaatcaaagcaaaagtcgtagaaaacccgtgcctggaatttcttttatgactgcagttttggactctagggtgatctgttttttttacatttatagaaattccacgttcacgtggttgatgag

SEQ ID NO: 645 - DNA, 379 bp, Zea mays
  Clone ID: LIB3179-028-P1-K6-H1
ctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgtaaataacgcggtcatgccgaataatggatgtgtgaattcgttac

SEQ ID NO: 646 - DNA, 330 bp, Zea mays
  unsure (1)..(330): unsure at all n locations; Clone ID: LIB3179-028-P1-K6-H10
gcggcgccatggcccagnggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaagatctcgcaggaggagtacctcaacgcgccaggcgagacctactccgttaccctcaccgtgccgggcacctacggcttctactgcgagccgcaccaaggagcacgaatggtcggcaagtatcacagttaactaaagctagctctccattccatgca

SEQ ID NO: 647 - DNA, 232 bp, Zea mays
  unsure (1)..(232): unsure at all n locations; Clone ID: LIB3179-028-P1-K6-H11
gncaggatgtgggcgagcgctgctgtcttcaaaaaccaacctgtttcctgagccagaaggacatcgacgcggccagagaagccgacaggtggacaaccgcacgaagagcagagtggatgcgacgaagcaatctacaccactgttggcaacaggcgagaaatagtgtgcttttgacaggtctttgttgtatgcagtacctattgcatgctgcctgttaccagtaggccaaaac

SEQ ID NO: 648 - DNA, 483 bp, Zea mays
  Clone ID: LIB3179-028-P1-K6-H2
cggcgaccatgtgcgaagcagcagaatcctatccccatcccgatgccgctgtcgctgtcgctgcccctcgtcctcgtcgcgctgctcctgccggccgcccgcggcgccgcggagacgccgcagtacacgacggtgcacgcggagtcggacttcgaggtgcggctgtacggcgacaccgtctggatgtccgcccccaccccggacatcccttccttccacgtcgccaccaagctcggcttccacagattattccagtacctgatgggcgcaaacctcaactcttcgaggatcaggatgaccacccctgtgctcacgagtgtggttccaggagcagggcctctgcgctcctcggcctactccgtccggctgtacctgccggctaagttccaggcttcccctccggttcctctcccagagctgaacctgcatctagatcggtggccaggccactgcgtcgcagcgaggagcttctcgggtcgtgca

SEQ ID NO: 649 - DNA, 91 bp, Zea mays
  Clone ID: LIB3179-028-P1-K6-H5
tccggtgagaaaaaaaaaaaaaaccccaaacaaacagaaaaacaaaaaaaaaaaaagaaaaaaaggaaaaaaaggaagaaaaggtcaaaaa

SEQ ID NO: 650 - DNA, 195 bp, Zea mays
  Clone ID: LIB3179-028-P1-K6-H6
gtcaccctcaccgtgccgggaacctacggcttctactgcgagccgcatcaaggagccggaatggtcggcaagatcaccgtcaactaattaagctagctatcgatcgatatccattcatgtattagctgcagcttactgctttgtactccgccgaactgaccatctctacatgttttcgagtaaacacatcaactc

SEQ ID NO: 651 - DNA, 188 bp, Zea mays
  Clone ID: LIB3179-028-P1-K6-H7
gcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagccttggcaacgtcagcaacggcggaaggatccggtgcatgcaggtgtg

SEQ ID NO: 652 - DNA, 242 bp, Zea mays
  Clone ID: LIB3179-028-P1-K6-H9
cgggatcttatccggccttgggggttcgttgcttggagttgacagggcagtgaaggagtgctccaggacatgacctccctaatggagtccaagctaggatggatggaattctgtccgaaagtttaggagacatgtcaggtacaaaaccagttattgttcgcttgtaaaagatatcatgaactattttgattaattctagcattcaggtccttatgttccaaacatttgtatttagagatgag

SEQ ID NO: 653 - DNA, 73 bp, Zea mays
  Clone ID: LIB3179-002-P2-K1-A5.F1
agatgaaaccgttctcaagaattttcaagacgaagtgaatacatcatacacaagagaggggtaaagttcagtt

SEQ ID NO: 654 - DNA, 74 bp, Zea mays
  Clone ID: LIB3179-002-P2-K1-A5.F2
agatgaaaccgttctcaagaattttcaagacgaaggtgaatacatcatacacaagagaggggtaaagttcagtt

SEQ ID NO: 655 - DNA, 74 bp, Zea mays
  Clone ID: LIB3179-002-P2-K1-A5.R1
aactgaactttacccctctcttgtgtatgatgtattcaccttcgtcttgaaaattcttgagaacggtttcatct

SEQ ID NO: 656 - DNA, 74 bp, Zea mays; identical to SEQ ID NO: 655
  Clone ID: LIB3179-002-P2-K1-A5.R2

SEQ ID NO: 657 - DNA, 74 bp, Zea mays; identical to SEQ ID NO: 654
  Clone ID: LIB3179-002-P2-K1-A5.F2B

SEQ ID NO: 658 - DNA, 566 bp, Zea mays
  unsure (1)..(566): unsure at all n locations; Clone ID: LIB3179-002-P2-K1-C10.F2B
gtcggcgacttgggccgcgtcagctcgatggccagcggcatcagcgtgcccaggtccgtcaggaagaagatggtgcgcgaggcgtanagcgtcgcgtcctgcagctcccgcaccttgtgcacgtagggcaggaacacgtcgtggtagtccaggatgaacagccgcttcgccgccagcgcctgctccacggtcagcgcgccgttcatctgcttctccaggatctccttggtgatggcggactccgctggcccgtacacctccgggtccagcttgctcttgatggggaactcagtcagcagctggatgcacagcgggttgagccccgcgatcgtctgcctcgcgaactcctcgtccttgaaccacgagaaccggtccctctctatcatctccggcacctcgaagcggaggacgtggtcggtggtgtcctccaccagcttgaccatgcgcgggacgacggtgcggatggcgtcnaacccggtctgcgccggcagcgggatgccgtcnctgaagaggtcgtcgatggcggggaagtgcgggaagcgcanatccttcttgttgatgagcag

SEQ ID NO: 659 - DNA, 340 bp, Zea mays
  Clone ID: LIB3179-002-P2-K1-C10.R2B
cccgggtgcgacccagcgtgcgcttcttcaccctcaagtgatacctgccgtgcgacacgcccaagggctgggggacctgagggaaaagagagctgcaggcgctgcgcggggacgggcacggggagcgcaaggggtgccagcgcgtctaccactacgacgtgtgaccaacgcacctgggcgacccggacaagaacccggcccaccagcggcccgtgctgggcggcaacaagcagtacccatacccgcgccggtgccgcaccggccgccccaggaccaagaaggaccccgagacggagatgcgcgagggccacaactacgtgccccgcgacgagcaggtctc

SEQ ID NO: 660 - DNA, 528 bp, Zea mays
  Clone ID: LIB3179-002-P2-K1-D5.F2B
gagatagaggaagtactgtgtaagatgtcagtctatgtctatctaaggggtccacacttaacatctccagttcacgggcagtttcaacacattcacatttccagctatatattaggggctaaattgcatggaaaccatgatgaacggcgcatccttctgttccaggatcgttacatttcaaacccacaaatagctccacgcgtttacccagatgtatcggcggcacaactcacaggccatagtcttcgccaaagtatttatcaaccaaaccattcgccatattcctcatcatctcgttctcatggaactggaacctctccatggcctcaatgccggcctctgtctccacgagctttgggccctggctgtcagggtatcctctcatcaccagttccaggaactgaagcccaagtctcgcactctctatatcggctgacctcaccaaatttataaatcctggaagggctccaccatctacgatggcaactaaatgctcaacgattatacttggggggggtaccactgcct

SEQ ID NO: 661 - DNA, 414 bp, Zea mays
  Clone ID: LIB3179-002-P2-K1-D5.R2B
gcggacagagaaaaaaaactgcagccgccgagctcagcctcagccgccgcgacggggacagagaaagaggggcgacgggagtgcctccgcctcaccgccttccgtttctccgcaccagtaccaccgcgacgccatcaagtcctatcagtggcgcgatacagctgctaataggaggagagaacatgctattgcaatagggaaggagagaagggaagccttgatgcgtgcaaagcgtgtatgccgagctcctctttctggcagtgatgaggctgcaacagaagagggggacatggttggtgatgaggagaaagcagatcttgagactagaacgactcaggctgttgaggagctgaaatctgctttgtcaagccagggaaaaggtgcacagaataggaagacagaagtgcttcgtgc

SEQ ID NO: 662 - DNA, 548 bp, Zea mays
  Clone ID: LIB3179-002-P2-K1-H1.F2B
ttccaacttaaatccttcagatagaactgttttggccccaatatacgcaaatatttgattcatccgtgagtcatcgtcacccaacacggattgatacacatccgttctcacttttcctacaaacgaatgctcacagcaagcaaaagtaaacgataagtgaaaaaacaagtgctacatgctatggcaaccatcccatgggagtccactagcccactactggtgggctgcttactcttcgttaccctcttcttccttggtaagcttgatcatgtcgtcaatcctcaggatagtaatggcagcctccgtggcaaactgaatgatctttactttgctcatcgatggctctatcacgccatactcaaggttgttgcgaatgatacccttagagaggtcaaggcccatacttgaataatgttgcttgtcggcctttgtttgagcagtatgatgatatgccctaagctttgctacaagctcagttgcatcttttgcagcattaacagatagtacctttggtatgattaacaaagactcagcaaattcagcaattg

SEQ ID NO: 663 - DNA, 343 bp, Zea mays
  unsure (1)..(343): unsure at all n locations; Clone ID: LIB3179-002-P2-K1-H1.R2B
gcgggaagctccttctcctcgaaccctctcgcgcgtgggttgctttcactctacaggggcccactcccacctcgccgccgcagccatggggatcacagcgccaactcccgacatcctcggcgagcgccagtccggccaggacgtgcncgcgaccgagaaacgtgatggcttgcggggcgggggccaacatcgtgaaatcctcgctcggccccgttggtctcaacaagatgctagtggacgatattggtgaggtcacaatcactaatgatggagcaaccatacttaagagtggggagggtgagcatccagccgccaaggttcttgtggaggtggctgagctcca

SEQ ID NO: 664 - DNA, 316 bp, Zea mays
  Clone ID: LIB3227-010-P1-K1-A1
caaatggtcatatcattaagaatgtcacaatttgatcaatgtgcatatctttttgaagaccatatatgctgcaaggtggatataatatttgaaagaatttgctccttgttttctttagagattacgtaaacgcaattgcttgctagaaggtaaatgaggctgaccgaagttgtgttacattgtttcatgccaaaaagcgcgatacgtaatacaaatgtattgttcattgatacgaacgctgcttatggttacagcttgcgtgttccaggaaatcacatctcttgatgttccaagtttaaaaaaacatatttaaaaa

SEQ ID NO: 665 - DNA, 382 bp, Zea mays
  Clone ID: LIB3227-010-P1-K1-A11
gatgaacatggcgggctcctgcgcctcctgctacgtgacgacggggtccttctcccggtcggcggtgaactacagcgcgggctgcaggacggcgctgtccaacgtcgtgatggcggcggcggtgctggtgacgctgctgttcctcatgccgctgttccactacaccccgaacgtgatcctggcggcgatcatcatcacggcggtggtggggctggtggacgtgcgcggcgccgccaggctgtggaaggtggacaagctggacttcctggcgtgcgtggcggcgttcctcggcgtgctgctggtgtccgtgcagacgggcctgggcgtcgccgtcggcatctcgctcttcaaggtcctgctgcaggtcacccgccccaacgtc

SEQ ID NO: 666 - DNA, 204 bp, Zea mays
  Clone ID: LIB3227-010-P1-K1-A12
tcggatgaacatggcgggctcctgctcctcctgctacatgacgacggggttcttctggcggtcggcggtgaactacatctcggtctgtaggacggcgctgaccaacgttgtgatggctggtggcggtgctgttgactctgttgtttcttatgccgctgttacactacaccctgaacgtgatttatggcggtgatcattatcatg

SEQ ID NO: 667 - DNA, 402 bp, Zea mays
  Clone ID: LIB3227-010-P1-K1-A2
acgcacaagcctaagagggctagcggggctatacttcgagttcatgaaccatgttggtgaggagtgaccagtgcctgcccatgattacaaattggtgtgccacacatgctatgtgctgggagcagatgatggataggtggtgttcaactgagtgggaccaggcgcacaacacttgccgggaatgacgtatgatgatgcaaggtcctttccaccaccaaggcagccggagtctgggccaatatgcagaatcggcgtcacatggtggacggccttgctccaccttctcggcctatgctatggcccataagggcaaggcgacgtccgatgtcacctacaacccggatgacggggccgaggcctacaccaaccccgccgtctacagccgccttcatgactacaccg

SEQ ID NO: 668 - DNA, 357 bp, Zea mays
  Clone ID: LIB3227-010-P1-K1-A3
ccagagactaagacacttacaattggtcagtttaagcttgggctgtgccatggtcatcaggttgttccatggggcgacctggactccctggcgatgctccagcggcagctggacgtggacatcctggtgaccgggcacagccatcagttcaaggcatataagcacgagggaggcgtggtgatcaaccctggctctgccacgggcgcctacagcagcatcacttacgacgtgaacccaagctttgtgctaggcttgcatcgtcgctgctttcttgaagtcgatcttgtccaccttcacctcgccgtcaatcagctcgtagacgtataccaccacacggagtccttcgatgtccatcag

SEQ ID NO: 669 - DNA, 100 bp, Zea mays
  Clone ID: LIB3227-010-P1-K1-A4
gctgaggctaagacacttacaacaggtcaggggcaggttggactgtgtcatggggatccagatgttgcatggagcgcagtggactccttggctatgctcc

SEQ ID NO: 670 - DNA, 406 bp, Zea mays
  Clone ID: LIB3227-010-P1-K1-A5
gcattctcgaattacgattcccaatccagcaaaccctaccagccttttgcaaactcagagagggacccgatggcacccaaggcggagaagaagccggcggcgaagaagcccgcagaggaggagcccgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgctacaaca

SEQ ID NO: 671 - DNA, 394 bp, Zea mays
  Clone ID: LIB3227-010-P1-K1-A6
gcgctttgcgcgattgctctccaacactttcacacaaaaataatggacgaccaggccattctaggcggtgggccgcctcttatcacgcaactggccgtccagtttagattgcagaagaagttcacgatcgttgacgtgatgcagaatatcagcaggagaatcaagatgttatcgccgcagaaatccactgggtagttctttaatctgtcgtcagacagtcagttaccattctgtactggctactgcagatagcacaaatcccagttgtgattctgtaccatgttcttgttatgatacttccagtgcctgtcattgaaaagttacatctgcgtcgaacagttaattacttccctgtactgattattgcgtataataataagtcccgattttgagt

SEQ ID NO: 672 - DNA, 409 bp, Zea mays
  Clone ID: LIB3227-010-P1-K1-A7
aacaagcctaagagggctcccggcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctcgagacaatggacggtgcttcatccaacaatggagc

SEQ ID NO: 673 - DNA, 410 bp, Zea mays
  Clone ID: LIB3227-010-P1-K1-A8
acgctcttgcgcagcaatttggatttgttcgcattggtgccatatacctactgtctggttttggtggcagcgtgttgtctgcactcttcctacggaacagctacatctccgttggtgcttctggagctctatttggcctgctgggatccatgctttctgaactactcatgaactggactatatactccaacaaggtagcagctataataacactgttgtttattattgcactcaatttggctattgggatactacctcacgttgacaactttgctcacattggtggattcgcgacgggtttcctcttgggttttgttctgttggcaaggcctcaatttagctggatggaaagtcatgagttgccacacactaaccaacctcccaagtacaaagcataccagtatattttg

SEQ ID NO: 674 - DNA, 406 bp, Zea mays
  Clone ID: LIB3227-010-P1-K1-A9
gtcactcagatcgatggctacaaaactgtattcaagccatacaatgagtggcgtattctggaggtgccaacaaaggatgacttgttgttttgtcaccggataccctctgttcaggttacaacagataaaggtggccagctgtgtggcttgtacgagctggatcctgctgctattactgattacttcctctctgcgggtacccacttacttgcgaaggctgaaatcgatcaccttcttcattgaactgttcatattgcatgctcttctggacgttagagtgtgtgatgggtcaactctggtttctgccaagccttgccaaacctacacactccactcggttggcctgagtgccttttgtactgaactgagcatacaaattgattgtaacgcttgatgcctatgaaac

SEQ ID NO: 675 - DNA, 178 bp, Zea mays
  Clone ID: LIB3227-010-P1-K1-B10
atttatagaaagcttgtaaccatacaattggtagtcattttaggtgctgttacttttggtgcctgctttacatcaccttttatttcatgaacttcttatgcttagttgctggctacacccaactgctgcaggtacagaaccgtgactagtgctaattatagaggcgcactgtgagctt

SEQ ID NO: 676 - DNA, 402 bp, Zea mays
  Clone ID: LIB3227-010-P1-K1-B11
atcaaaccctgttggtcaaatatgggaagctgaggcaacaatgtcagtcctctccatcttaggcacctgagctatttaatcgattaattggagctttatgagcttttgcagaattcatgaagaatttgaatgtccatatttcctaaatcatgaggtatcttgttacgtgccatctatctccagatgacatggttttatgccactacttacaatagtggcttgtgcctagtggtataatgctcatttgtgagtgagtccagatatcccgtggaacaagtgcacaaacatacggttatagagcctctacattatactgcaatgaaatgttgataccctccatgatagtaaaagttgcctttgtatttggaagcatccaacttaatactatttaatagtatccaa

SEQ ID NO: 677 - DNA, 405 bp, Zea mays
  Clone ID: LIB3227-010-P1-K1-B12
cgaggcaaaaatcttcgccaaagttcgaggatgggagacagagaatgtcgaggagattgctttgaagatctctcagcttcctttggcttcaggcaagcaaaagaggactgctgtgattactcaaggcgctgatccagtggttgttgctgaggatgggaaggtgaaaacgttccctgtgatcctattgcccaaggagaagcttgttgacaccaacggcgcaggtgacgctttcgtcggaggctttctctctcggctggtccagggcaagagcatcgaggactgcgtgacggctggttgctacgctgccaatgttatcatccagcgcccaggctgtacctaccccagagaagcctgacttcaactagtgcaatactcaggcaccgaggcacgttacgagcggttcgg

SEQ ID NO: 678 - DNA, 410 bp, Zea mays
  Clone ID: LIB3227-010-P1-K1-B2
gggcatcgcttcagaggttcacctctatgtgtttacagccaagccctatgcactcttaactaatcagtcacacggaaacattattgtacttggggactatgtatcctctgagcccgtggacccttttgaaataaaggaaagcaaccggcctaccaaaatgaagcttccacagttggaaccagatgagagaagcgtgacaaacataaaagaaagtgttcgggactttgttgtcggcagtggtgaatatgtgatcaaagattttaagttcactgttaaccaagcagtgcgaccagtggagaagcgcattgataaattgatgaaaaagaatgataagagtaagaaaagccaggacgacaactgggtgagtgcagcaacaccagagaggcctgttcgtgggattgatgaaccat

SEQ ID NO: 679 - DNA, 408 bp, Zea mays
  Clone ID: LIB3227-010-P1-K1-B3
attttatagaaagcttgtaaccatacaattggtagtcattttaggtgctgttacttttcgtgcctgctttccatcaccttttttttcatgaacttctcatgctgagttgctggctacacccaactgctgcaggtacagagccgtgactagtgcttattatagaggcgcactgggagctttgctggtctacgacatcaccagacggcagagcttcgatcacataccccgctggctagatgagctccgagcccatgctgacaagaacattgtgataatgctggttggcaacaagagcgatctcgaggagcagcgggccgtgagcactgaagacgccaaggagtttgccgagaaggagaacctcttcttcttggagacctctgcgctccaggcaacaaatgtggagagttc

SEQ ID NO: 680 - DNA, 135 bp, Zea mays
  Clone ID: LIB3227-010-P1-K1-B5
ctagctagcatacagacgaataatctcttcttcacctcactaacaccagctagcaactctttctctcctgcaataatggccgctcgctcctcctactcccagccgtagctggtcgcggcggcggcggtcctggca

SEQ ID NO: 681 - DNA, 398 bp, Zea mays
  Clone ID: LIB3227-010-P1-K1-B6
gtcccaagccttccacacacccgacgcccaagccgaccccaccgacgtacaccccttccccaaagcctccgacgcccaagccgaccccaccgacgtacaccccttccccaaagcctccgacacccaagccgaccccaccgacgtacactcccacaccgaagccgccggccaccaagccgcccacctacactccgacgccgccggtgtctcacacccccagcccgccgccaccatactactagaaagcgatgcctaccataccacactgctgtcagtctctggagcatttaggtggtctggatcaatggaagggttgtgtcctagccagccggcaaagatgagctgctgatggtaatgatgatgataagaggccactgctaccctactacgtaccctcc

SEQ ID NO: 682 - DNA, 404 bp, Zea mays
  Clone ID: LIB3227-010-P1-K1-B7
gtgagcaacgatcgctggcccaggctgtacccgaactatgcttctgaccgtcggcgtgacagcgctcctctcctccatggattcactggatttcaagtactggaataagagggcgcactacccggacaaggagaacgggatcgagatctaactgatgccgatcaaacgaggtgcgcctgtgagcttcagtattaacacatatgatggggagaccatatgcaatgggaaactagttatcgatcttgatgactgaataaaccatgtttacaaggaaacataaaacgcttgcacaaagacattttgcccgaatgcaacaggtgaatttgtgatatcccataagcagacactatcatccttcatcccacccggtttagacacgcttacaaagaatctcttgagatgaa

SEQ ID NO: 683 - DNA, 103 bp, Zea mays
  Clone ID: LIB3227-010-P1-K1-B8
ggaacaaactatgttggagttttatcaacaattttattctaaaaaaaagggttgggagtcgaatttatactgcagagtatcaaaattatactactgcctgtcc

SEQ ID NO: 684 - DNA, 404 bp, Zea mays
  Clone ID: LIB3227-010-P1-K1-B9
ctgactcaggtagatggctacaaaactgtattcaagccagacaatgagaggagtattctggaggtgccaacaaaggatgacttgctgttttctcaccggataccctctttccagctgacaacagagaagggtggcgagctctgtggcttctacgagctggatcctgctgctattcctgattccttcctctctgcgggtacccactgactcgcgaaggctgaattcgattacctccgtcattgaactggtgatattgcatgctcttctggacgttagtgtgtgtgtgggggcaactctggtttcggccaagccttgccaaacctacacactccactcggtaggcctcggtgccttttgtactgtactgagcatacaatttgattctaacgctgatgcctatgaaa

SEQ ID NO: 685 - DNA, 221 bp, Zea mays
  Clone ID: LIB3227-010-P1-K1-C1
ctttctacaaaaaaaaaaaaaaataaaaaaaaaaaacaaaactaaaataaaaaaaaaagcgatgagctaaaaaaataaacaaatactcaaaaacaagaattcaaaaccactaccatattatataaataacaaatggggggggcctttatgctctgtggcttttacaaacgcggtctctgctgctatttctgttttttttatctttgcctgaactcactatc

SEQ ID NO: 686 - DNA, 323 bp, Zea mays
  unsure (1)..(323): unsure at all n locations; Clone ID: LIB3227-010-P1-K1-C10
taaaaaaaaaaaaaaaaaaaaaaaaaaaaaaaaaaaaaaaaaaaaaaaaaaaataaaaaaaaaaaaaaaaaaaaaaaaaaaaaaatatttaaaaaataaataggtttaatatttgggggggtgtgttttagggtggttttttttttngngggttttgttggtttttttggtttttttttttgtattgtctatttttttttttgggtctgtctttttttagtggggcgtgtggtaaccctttttgtttggtctattttattttgtttgtgaatatatttttttttcttgctttttttatttgtttgggtggccttttttttttt

SEQ ID NO: 687 - DNA, 405 bp, Zea mays
  Clone ID: LIB3227-010-P1-K1-C11
gatgcaggctgctcagttccatctactgaagcaacagcaactgctcaagctacagagggagcggcagcatcttgccgctgccgcggcgtggagcgcgcgccagggcgcatgcgccaagcccgtcggctgcgtccgcggcgacgcgctgcttggtctgaacccggcggcgtgcctcccgcttcagaagccgcagcagcaccaccaccaccaccactcgccggcggctccggcctctggcatgcgtgccgtgttcctcaccccgtccggccccaagcgcgagcgtaacggcactggcgtgtttcttcccaggccggctggcgccccggcagagccgaagaaaaagacagggtgttcgacggttctggtccctgctcgcgtcgtccaggctctcaacctcgacgacct

SEQ ID NO: 688 - DNA, 407 bp, Zea mays
  Clone ID: LIB3227-010-P1-K1-C12
aataaaaaatgataaaaaaaaataataataaaaaaaaaaaaaaatagattaaaataaaaaagagaggggaaaaatatatagattgataaagaggagtggaagagctctcaaaggtatattctcggggcgcgcgttttgggggttcttgtttcttgctggttggtttgaaccggtttgctttttttttggtgtcaaaaaattagattttattgggacgttgttttttttgcttgtggtttgggaaattcgtgtgttttcctttttttatgggttggtagaacattccctttttcctagctggttttttatgttagttgccacgccggtttgctttttggtactgttgttgtttttgtttggtttttggtccggcctttggtttgcttctttatatcttgctctttttt

SEQ ID NO: 689 - DNA, 205 bp, Zea mays
  Clone ID: LIB3227-010-P1-K1-C2
caagagtgtggagaagaaggacccgaccggcgccaaggtgaccaaggcggctgccaagaagaaatgatgcgatcctgcgcctgctttagcaatacctagttttcatcatcacaagttttgtttgtgatcgttgctgttatcgtgtgaactgttgagatctgttagcatgtgcacttttatctatttatttggtaccatctaaaaa

SEQ ID NO: 690 - DNA, 238 bp, Zea mays
  Clone ID: LIB3227-010-P1-K1-C3
cccgagcgtgcggatgattgacctgaccggcgccattgtgaccgaggcggctgtctagatggaatgcttcgatcgctgagctgttttatcattacgtacccattatcatcaccaggtgcgtctgcgatcgctactgctctcttggaactgatagacacctgacctcacctctatctattttgtggaccatcgcgccaaaaagttgaatatggtctgtcctgagacaatcaagtttacc

SEQ ID NO: 691 - DNA, 359 bp, Zea mays
  Clone ID: LIB3227-010-P1-K1-C4
gtggatggtttatactagtcatcagcggagcttgttggtaggcacttgctggagtagttgcttcgaacttctttttttcgtgttagatgaggtaaaaaaacaattttgtgttattgactctgctgtgagcgagtgaaccttgcacattttcgttatctcaaatggatagatctgttctacgcttgttttgtgaattgtaatagctgttcgtttcggcaaaaaaaaaaaaaaaaaaaaaaaaaaaaaaaaaaaaaaaaaaaaaaaataataaaaaaaaaaaaaaaaaaaaaaataaaacatatatataaattaaattataatatattttttattaatatggggcggccctttttaaggat

SEQ ID NO: 692 - DNA, 300 bp, Zea mays
  Clone ID: LIB3227-010-P1-K1-C5
cgttactacgaggaaaccgttatgatactgaatctcatgccttatcgagcatcgtatcccatcttaaagttggtttattcggcagcagcaaatgctactcattatagggatttcgacaaaacgaatttattcatcactaaagccgaagtcagtaggagtactattatgaaaaaattcagacctcgagctcgaggacgtagttattctataaaaaaaacgatgtgtaatataacaattgtactaaatatagtaaagaaatcaaaataatctttagatcaatctaagatttcgattcccagt

SEQ ID NO: 693 - DNA, 340 bp, Zea mays
  Clone ID: LIB3227-010-P1-K1-C6
atcgccaatcaataaggactcgtggttgatgttctcggcatcggagttgcgtattgctgtaccgttgcttgcttactgtgcgttgtggctacttttgactgctatcgaataataataaattggtgtcatgaagtggaaaatgccatgcgatgatggctactttctgcagcagcgcctgttgttccatgggacgtgatctctttaaaaaaaaaaaaaaaaaaaaaaaaaaaaaaaaaaaaaaaaaaaataaaaaaaaaaaaaaaaaaaaaataaataacaatcaaaaatattaatattcttaataaaaaaaaaaaaaaaagggcgacacactctacggggg

SEQ ID NO: 694 - DNA, 403 bp, Zea mays
  Clone ID: LIB3227-010-P1-K1-C7
gtaccgcggcgacgtggtgcccaaggacgtgaacgccgcggtggccaccatcaagacgaagcgcaccatccagttcgtggactggtgcccgacggggttcaagtgcggcatcaactaccaggcgccaacagtggtgccgggtgccgacctcgccaaggtgcagcgtgccgtgtgcatgatctccaactccaccagcgtcgtcgaggtgttctcccgcatcaacagcaagttcgacctcatgtacgccaagcgcgcgttcgtgcactggtacgtcggcgagggcatggaggagggggagttctccgaggcacgcgaggacctggccgccctggagaaggactacgaggaggtcgccgcagagggcggcagtgatgacggcgacgaggaggaggaatactgatct

SEQ ID NO: 695 - DNA, 81 bp, Zea mays
  Clone ID: LIB3227-010-P1-K1-C8
gtgaaatattcagtgatcaacattgagactgttttttttgcaaagatgcggaatggtagaaaacccttcttttggtgtcac

SEQ ID NO: 696 - DNA, 352 bp, Zea mays
  Clone ID: LIB3227-010-P1-K1-C9
agctggcctgcgaatgaagccaccagtcatggctcaaagtcaaggacgatctgtctgtttcacgaagacggtggccccaaattttgctgggccaccattctgttgtatgttgttgatgccttcttaacttacctaggaagctgcgtttagacattttgcacctgatctacagctgctgctgtgtttctgtcctgatcgcattgttttccatagctttgctctgtggagcggcaacttgatctgccctgcccttaactagccggcaggtttattaatttggttttccatactatggttgtattaactgagaagagactccgacactttcgttgtgcctacctaagttctgtct

SEQ ID NO: 697 - DNA, 407 bp, Zea mays
  Clone ID: LIB3227-010-P1-K1-D1
gctgaatgtaccatagagaaggttcgggcaaagcatgacactaccaatacagcggtagctggctgtgtcactggaggagctttagctgtaaaaggtggccctaaagctacatgctttggatgtgtggggtttgctgcgttctcagtggcaattgaaaagttctttgatcggcatactcgaaatgggtgttgtgaatttgaacgctttttggccatgttcgtttgatcccaaaaccatagggattgaggtggatcggaagggattaaagaggattttgacttgtaggggatttgataccccttaatccctatggatcagcacaaaacgaacagggccttagctgagcatgagcagcgttggcagaagaacctgattgtttgcaacatccagtcatctacaactcatga

SEQ ID NO: 698 - DNA, 227 bp, Zea mays
  Clone ID: LIB3227-010-P1-K1-D10
cgctagcgccttcctagaaccttctcgtttctgtaagatagttctcgcctctgtaagataaactaatgcatgcgcaagctagaaatagtccgcttgatccgtcacgcggaattggttaaaaaaaaaaaaaaaaaaaaaaaaaaaaaaaaaaaaaaaaaaaaaaaaaataaaaataaaatataaatgggggcgctcgttctagaggatccaagcttcctacgcctgca

SEQ ID NO: 699 - DNA, 404 bp, Zea mays
  Clone ID: LIB3227-010-P1-K1-D11
cccaaggagcgtgccgacgtcgccgagcttcagagcgaggctagacctgcgcgtcgccgctgtctacaaggtgaagctcatcggccccgaagggcaggagagcgtgctcgacgtgccagaggacagctacatcctggacgcggccgaggaggccggtctcgacctgccctactcctgccgcgccggcgcgtgctccacgtgcgccggcaagctcctggagggctccgtcgaccaggcagaccagtcgttcctcgacgaggcgcaggtcggtgccgggtacgcgctcacctgcgtcgcgtacccgacgtacgactgcgtcatccagacgcacagggaggaagacttgtactagcccgggctggtccccgtgcatggatcaaccttgcacttacattcagattcga

SEQ ID NO: 700 - DNA, 400 bp, Zea mays
  Clone ID: LIB3227-010-P1-K1-D12
ggtatgtgcaaggaagaggaagacgtttgtcctcacggacgagggctcagttgttgcgtttggatggatgggttttgggagtctaggatttcttgaccgaggaacatcagacaaagtaatgaggccccgcgttcttgagagcctgcaggatcactacgtctcccaaataagcaccggactgtatcacactgtcgcagtgacaaataagggcattgtattcgggttcggggacaacgagcgagcacaacttgggcaggagtacattcgtgggtgcttaaaacctaccgagataatgttccaaaagagtatcgaagacataccaattgcggcgcctagtggttgacctcaaggccaagaggccaagaccaccattttggacactgttgcctgcatatatgtt

SEQ ID NO: 701 - DNA, 405 bp, Zea mays
  Clone ID: LIB3227-010-P1-K1-D2
cgaagagggtcttgaggacattcaagcacacgagattcctagttaggtgaaattcctttgtagggggatagtagctaggctctgacaagtagtgcttggtgcgtaatttctgcctttgctctttttccctttgtcagcgtcgaattttggtggtcggttgtaaagcttgtgttgagggggcttttgcggcttgatttttgtcctggattcgagttttgacaccggaggttgaagaagcggtaggatgatggtagtcctttagatcctgttgtaatgtatttaactgtgaggtgaggctggacacaataaattctgtaggcgtgtttagaggaagaagggggaagttgtgtgtgatggtttcttcagagaagattcctgctactgtgtacttcgaatctgtttttg

SEQ ID NO: 702 - DNA, 408 bp, Zea mays
  Clone ID: LIB3227-010-P1-K1-D3
ggctggacaactccaaggtcttatcttggttgtgctgcaaggtatacgacctaaaggaggtcttccccaagttgggtaaaaattatgccgcccaaacagaaaaagaaaaattgaaggaggctgtccaaatgatccgtgaatatctgaaggacgaaccatggttagcattactatgcaagaagctgcagctggatatcaatgcgatcactgttgatgcgaccaccaaaactgctgaagcttcggtttatgcggacagttgtccggcacctgccctcccctctgagagtaagactgcgaatggtggtgccaagtcaagcaaagggaggccagcgaagaaagcaaagacagaggtaggatccaagaacatcaaagatatgttccgaagggtcacgaggagtggatcaggat

SEQ ID NO: 703 - DNA, 68 bp, Zea mays
  Clone ID: LIB3227-010-P1-K1-D4
aaaaaaaaaaaaaaaaaaaaaaaaaaaaaaaaaaaaaaaaaaaaaaaaaaaaaaaaaaaaaaaaaaaa

SEQ ID NO: 704 - DNA, 405 bp, Zea mays
  Clone ID: LIB3227-010-P1-K1-D7
gttcgtcggtgcttaccagcagtagtgtagctgctcctgttttgatcggccgccatgatgtaaatgatcatcacccaactggaacccctgttatctcgttacatgcttaggcctctgatacgtctcgttcaaaaaaaaaaaaagacatagagaaagatctaaacaagaaatattaaaagacaaggctacgcatgataaaggtgcgccttctatattgtgctggactacgtgggcctggctttagaggttccaactcttataggctgaggtccataccggtaactttgttttacggctacctaatttcattaacgtgcgcgttattcacactcactggcttgaagaaaagcattatatcgcgattgtatctaagcagagagatatccttatttatacgtttgttta

SEQ ID NO: 705 - DNA, 400 bp, Zea mays
  Clone ID: LIB3227-010-P1-K1-D8
gggaaaggttatgagggtgtggtcactcgttggggtgtcacccggcttccccgcaagacccacaggggtctccgcaaagttgcttgtatcggtgcatggcatccggctagggtctcctatacggttgctcgtgctggtcagaatgggtaccaccaccgcactgagatgaacaagaaggtttacaagatcggcaaggctggacaagagacccacgatgcctccacagagtttgacaggactgagaaggacatcactcccatgggtggcttcccccattatggtatcgtgaagggtgactacctgatgatcaagggctgctgtgtgggtccaaagaagagggtggtgaccctccgccagtccctcctgaagcagacttcccggctggcgctggaggagatca

SEQ ID NO: 706 - DNA, 404 bp, Zea mays
  Clone ID: LIB3227-010-P1-K1-D9
attcagtttaacaagaacacatttggtcttgctgctggtgaagcacttcaggttactccactgcaaccaggccaatcaacaaggacacttttacaaatgaacacgttccagaatatcagccctggtgcaccaaactcgctattacaagttgctgtgaaaaataatcagcagccagtgtggtacttcaatgacaaaattccactgcatgttttctttggtgaagatggaaaaatggaacgagctagttttcttgaggcctggaaatctttacctgatgacaatgaatttacaaaagaattcccgggctctgtaatcagcagtatagatgctacagttgagcgccttgcagcatcaaatgtgttctttatagccaagcggaaaaatgcaaacatggatgttctgta

SEQ ID NO: 707 - DNA, 366 bp, Zea mays
  Clone ID: LIB3227-010-P1-K1-E1
cccacgcgtccggatggtactacggcttaaagaggcgcaagtgctgcaagagggcggtgaagagcagacccaacccgaggaactactaccggtgctcggcggtgggatgcggcacgaagaagctcattgtgaggaacagtgaatacctgtgctacgtcttaacaacctactacggtatgcacaagcacgccaagtcgtgcgactgctacctatgcccgcctcctgctgcgcgcagcgcagatcactactcgtctcctactgcagaacgacgttggtgagccactatttacgcttgactggcgcatatgctaccgtaagctgatgatgcagttgaatgaggactgtcgcgctcttgcaatatcatta

SEQ ID NO: 708 - DNA, 72 bp, Zea mays
  Clone ID: LIB3227-010-P1-K1-E11
gtctgcagtaatctagattgtggcaagtgacatattgctaataagtgacataaaaaaaaaaaagcacaaaaa

SEQ ID NO: 709 - DNA, 213 bp, Zea mays
  Clone ID: LIB3227-010-P1-K1-E12
ggcgtaaccagtgctttccctggaggaaaatgtttacttggcgaagctcgccgcgcaggcaaagaggttcgaggaaaagctcgagtttatggtgaatgctacgaaacctgtggactcgaaggacctcactgtgcaggaacgcaacctcttgtatgatgcatacacgaacgttattggggcccgccctgcctaatggcgcataatctcctccat

SEQ ID NO: 710 - DNA, 409 bp, Zea mays
  Clone ID: LIB3227-010-P1-K1-E2
gggagatagagagaggagagggagggtttcctcaaagagaacctgaacccaaacccaagcagagaacactagcgttccctcaccagggcgggcgtccatcccagcagccatggcgatggcgtacaagatggcgacggaggggatgaacgtgaaggaggagtgccagcgctggttcatggagatgaagtggaagaaggtgcaccgcttcgtggtgtacaagatcgacgagcggtcgcgcgccgtgctggtggacaaggtgggcggccccggggaagggtacaacgagctcgtggccgcgctgcccggcgacgactgccgctacgccgtcttcgacttcgacttcgtcactgttgacaactgccagaagagcaagatcttcttcatcgcctggtcaccggcggcgtcgagg

SEQ ID NO: 711 - DNA, 404 bp, Zea mays
  unsure (1)..(404): unsure at all n locations; Clone ID: LIB3227-010-P1-K1-E3
cccacgcgtncgacgattagatgacgagaggatgatgctatatttatcaagtccgcagcgccctgcctctcttgtgacggcccgcgacacaagtgtggtgattgacagtgacatcgctcactctaagttaggttttggttcttccctggcccccggaaatcatcacctggcgccgccacattcgaatggagatggatctgctggcatcatcttgcttcctcttttgtaaagcttttcctgctgagtttagtggtaccttagattgtcgtccatttctgccctgttctccgggcagctatttgtagtgtaaaaatatggtggcgtgctggatggtgttatttatgcgtgcgtggcctgtcatgacgaattccaccatgtttggggctatttgatggatgtttact

SEQ ID NO: 712 - DNA, 399 bp, Zea mays
  Clone ID: LIB3227-010-P1-K1-E4
ccataaattcagattgctggctccaaggcttatcagcaagggaagatctatggaattgatgccgcttctggagctgctatattagcacttgatgttcgaccaggaaatcatgttcttgacctctgtgctgccccaggtgcaaagctttgcatgctcgcagatacgcttggaaccactggttctctgactggtgttgatgttgcaaagcaccgccttgcggcctgtcgtacaatgttgcagaagtattctcttggtgaccgtactcggctctttgttgctgatggaactttgttttcccttttacctgtgaactccaggatgcaaagaatggaagggtcaattggcgttgaagaaaatggaagcatattcccagaatggacttcaaggagatcatggaag

SEQ ID NO: 713 - DNA, 314 bp, Zea mays
  Clone ID: LIB3227-010-P1-K1-E5
cctgatatggcgtaggtccctagtttacgaagtctgcattttcatgtgttcattaatatatctgctgattagctgttcgacctagcagtgtctaaaacgtgccgtgtgtcttttgtgctgagtgttgacatggggcctcctccctccagcctgtaaacgctgtcactgaaggtacctctcaactgaccatccttcattgttggtgtcgtgcagtgagtagtggccatactctttgttcccagttcctagcatttgaattgctcaaatgcgtaccttgctgagtaaggccgttggaaaatgactaaacaaaataa

SEQ ID NO: 714 - DNA, 401 bp, Zea mays
  Clone ID: LIB3227-010-P1-K1-E6
gcatcaccacgcatttgacgcggacgcgcgaggaagcaagcaccgccggagtcggagggaaaaagaaaaaagagcacggacgattcgcagctgcagcctgcacaggcggaggcgaggaggaagagagagcccccacgatcggctcgccgggacggccgacgggccgagggtgaggtatagtgcgggcgcgtggtcccgcgcgtggagtcgggatccgtattgctctctagcagtcggccggtggcggcgctcggcgtccggagggtgactgacagagagagaatcgtccatccatgggaggatccgggcgcagcgcgcattttttggacgcgtgcttcctctgccggaagccgctcgccggcaaccgcgacatcttcatgtacaggggcgacacggcgttc

SEQ ID NO: 715 - DNA, 403 bp, Zea mays
  Clone ID: LIB3227-010-P1-K1-E7
gcggcgtcgcccaaacccaaggccaaggccaaggccaagcctgtcgctcctgccgccgcgtcgcccaagccccgcgggcgccctcccaaggtcgccaagacctccgccaaggcctcccccgccaaggcagccaagaaggcggctgctcctgccaagaagggaaaggcagcggcggctcctaagaaggtggcaaccccgaagaaggctgctgctgctgccgccccggccaggaagggcgtggccaggaaggccaagaagtagtctgcctgccttgtcgctggcgagatccccccctcaattccgcctatagattcccctctttcatggattttgatccaatcgtaatattgtcagtagctctagattcgtcggtagctccagcatgagtgtcggtggtagttct

SEQ ID NO: 716 - DNA, 354 bp, Zea mays
  Clone ID: LIB3227-010-P1-K1-E8
agagctcgctcgagacaatggacggtgcttcatccaacaatggagcggctacacaaggccccgtggcgatcaaaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagctagcagaggcgcctgcttgtacctagattactgtttccattgtcgtcgtcatcggctaacattgtcataatgtcagtttgggtaatgttggatttaggtcaaaagagattaat

SEQ ID NO: 717 - DNA, 400 bp, Zea mays
  Clone ID: LIB3227-010-P1-K1-E9
gagcttggcccatacctgcagcactctgttaaatttcttttgagcatggtggtctttgaagcatgacaatggctgctcttaggtttgggattgccaccatcttctgggacaaagagggagtggaggttgattgatctgtcggcagtctgatggggatgaattatacgaggtcttcaacgctgacacaaagggttaatgaaacaaactcgaatccattgattataggcgctccgcacggaccatatgattcatctctcgttggacatgtagctacaagaatggtgtcagtgggcggttgctgccgcaactaaaagtccattcagtgtggatgtcagttgggctacgctatctaagaataaaaagtttgaggaacaacgagcatgttgccaagtagtttctc

SEQ ID NO: 718 - DNA, 401 bp, Zea mays
  Clone ID: LIB3227-010-P1-K1-F1
attattcttacactggctctttcgcctatacgcagatgtatagttagtgcattggatgtaaggccgactctaacaggttacccaaaatttacccataagcactgttttgcactgtagactgcactggtcgtagagtgaagattgaatatgggtatgggtaagccgttagagatagtctaaagtgcttgatttgattgttgaccgatttattgtctataaaatagctccttgaggtatggtgtgatttatgtgtttaattattaattcttcaaaccagagcactcaaatgcttttataatggtggttataattttattctgatttcttttaaacctggtatgtttacaaatttcaagaatttgtaaatgtgcagaggtctataattctgtttgatataactg

SEQ ID NO: 719 - DNA, 395 bp, Zea mays
  Clone ID: LIB3227-010-P1-K1-F10
atgatatagagcctgctaaatcagctgatgttcagatatctaataagtgggaggagtcaaaggtccactatccttcaagcactgatccagaggcggttgaactgacctactctgacatgaaatgtcttgaaccagaagaatatttaaaatcacctgttataaatttttaccttttataccacaagatggcaagatcactaaaggatatacacatgtttaacacctattattatagcaaactagaagaagcactattcatggcgggtcaccatgacttagaattcaccaagttaccgagatggtggataggtgtatatatttttaagaaagcggacataattttgccgattaacgaattgatgcactggatctttgatattgtttgcatgcctaca

SEQ ID NO: 720 - DNA, 178 bp, Zea mays
  Clone ID: LIB3227-010-P1-K1-F11
acgcgtacggagtctgctaaatcagctgatgttcagatatctaataagtggaaggagtcaaatgttcactatccttcaagcactgatccataagctgttgaacttacctaatcttacatgaaatgttttgaaccagataaatatttaaaaacacctgttaaaaaatttttcctttaat

SEQ ID NO: 721 - DNA, 402 bp, Zea mays
  Clone ID: LIB3227-010-P1-K1-F12
ctaattacagttgcaacgttcatgccttctacttcagtcttgtgcgacgtcagttcatgcttgtcatcaaatggaactcaaaccgtgattttctttgctggtttgtatctcactgctgttggatgtggaggagtaagatctgcattgcttccgtttggtgctaaccagttcaacaacgagaacagtctagacataaaaaagagaagaaatttcttcagcttgttctatatatgtgtcatctttggtgtgattacttctgggacaatcatagtttgggttcaggaaaatgttagctgggctattggatatggagtcgccactacatgcataggtcttgctttgataggatttctggtgggaacaccaatattccaagaagatgagccttgtggttctccagtg

SEQ ID NO: 722 - DNA, 400 bp, Zea mays
  Clone ID: LIB3227-010-P1-K1-F2
aagtacctcacctctccgagtttctcaactccctgtacaactgccagtataagtcgttcttcgttgcattttctggtctgacagagcaaatcaagttagaccgttatcttcagcctcatttccgctactacatgagggaagtgcgcaccgtggtatactcacagttcttagagtcatacaagagtgtgacaatggaagcaatggccactgcgttcggtgtaactgttgatttcattgaccaggaactgtcacggttcattgcagctgggaagctgcactgcaagattgataaggttgctggtgttctggagactaaccgacctgatgagaggaatgctttctaccaggcgaccatcaagcaaggggacttcttgctgaaccgcatccagaagctttcacg

SEQ ID NO: 723 - DNA, 401 bp, Zea mays
  Clone ID: LIB3227-010-P1-K1-F4
gcaatacctagcagaagccttccatcctcactcgctcgatggcccgcacgaagcagacggcgaggaagtccaccggcggcaaggcgccgaggaagcagttggcgactaaggcggcccgcaagtctgcccctgcgaccggcggagttaagaagccccaccgcttccgccccggtaccgtcgcgctccgggagatccgcaagtaccagaagagcacggagctgctgatccgcaagctgccgttccagcgcctggtgcgggagatcgcgcaggacttcaagaccgacctacgcttccagagctccgctgtctccgcgctgcaggaggcggctgaggcctaccttgtcggtctcttcgaggacaccaacctctgcgccatccacgccaagcgcgtcaccatcatg

SEQ ID NO: 724 - DNA, 91 bp, Zea mays
  unsure (1)..(91): unsure at all n locations; Clone ID: LIB3227-010-P1-K1-F5
gccgttcggaatttgggttcaaatgggggggtgtnaaacaaagaaaaaaagcaaaaaaattccgggaaaaaataaaacgatttttttaaaa

SEQ ID NO: 725 - DNA, 396 bp, Zea mays
  Clone ID: LIB3227-010-P1-K1-F7
cgttgcagcagctgatccgcgcccgcccggccgggagcgcaggcgaaggatggaacaatacgacgggctctttcctcccgcctacgtggactcctcctcatccctcctcctggtgcccaacgccaacggcactgcgcaggaggagagaccgagagcgcggcgcaggaggcgtcgagcagcgaggtgcggcggcggcggcggcgagctggacggaggaggggaccacaagaagcggcggctgaccgacgagcaggtagagatgctggagctgagcttccgggaggagcggaagctggagaccggccggaaggtgcacctggccgccgagctcgggctcgaccccaagcaggtcgccgtctgggttcagaaccgccgcgctcgccacaagagcaagct

SEQ ID NO: 726 - DNA, 386 bp, Zea mays
  Clone ID: LIB3227-010-P1-K1-F8
ggttcaagtcaccaaagcagattttatgtatctgaaacattggagtcaagccagagattctaaaacgtgttggagaaaccatgactactctgccaaaatttcaatcctcacagggctgtgaatttttttatcaaaggcgtcaaatgattgagactagagaaggcattgattggacagttggtgaaacacttgcttttgctactcttatcattgaagggaaccacgtcaggttaagtggttaggatgttgagaggggtacatttagccaccgtcattctgccatccatgaccaaactagagaatagtactacccactgtaccatcttgttatgaaccaagatgaggagatttttactatgagcaacatgtatgaacaatatggtaat

SEQ ID NO: 727 - DNA, 268 bp, Zea mays
  Clone ID: LIB3227-010-P1-K1-F9
ggttcaagtcaccaaagcagattttatgtatctgaaacattggagtcagggcggagattctaaaacgtgttggacaaaccattactactctgccaaaatttcaatcctcacagggcttgtaattattttatcagaggctttaaatgattgagactagtgaatgcattgattgtacacttggtgaaacacttgcttctgctactattatcattgaagggaaccacttaaggttaagttggtttggctgtttagaggggtacatctagca

SEQ ID NO: 728 - DNA, 292 bp, Zea mays
  Clone ID: LIB3227-010-P1-K1-G1
agcctgatgatgtcaaggcctgtcttctttgctatacaaatcattttctcataaaacatttttttttcaagaggtccttacagcatggtagttgatcaggtacagattttggatcgccatcacctatttggcaagtttgctagtgtggatggaggggtttctacgcgtactgaccagaacctagcattctttggcgggtacaacatggtgacaacacatatcgtgttacttcataagaatccttctgaggatatacatgccttggtcgaacaatactatgatcattttcatg

SEQ ID NO: 729 - DNA, 362 bp, Zea mays
  Clone ID: LIB3227-010-P1-K1-G10
ctcggccagcggaaggggagaggagggcgagatgacggtggagaaggtggacgcggggctttccgacttcgacgcccacttcgatcgcctcttcgcttccccggacgccgcctccgacggcaaggtgaagctgctgctcttcctggccgaccgcaagcctggctcctccctctcctggtgccccgactgcaacgtggcggagccggtgatctacgagcggctggaggcactggagggcaaggacgcggtgctcctgcgcgcctacgtcggggacaagcccacttggcgcgacccggcgcacccgtggagggtggaccccaagttcgggcttaagggcgtgccaacgcttatccgcttggagg

SEQ ID NO: 730 - DNA, 345 bp, Zea mays
  Clone ID: LIB3227-010-P1-K1-G11
ctcagtcagcggatggcgagaggaggtcctaatgacggccgagaaggtggacgcggggctttgcgacttcgacgctcacatagatcgcatatgctttatggcggacgccgaattcaagggcaaggtgaaactgatgaaatttctgtcgtatcgcaagcctgtctacttcctttcctggtgcaacaacttaaacgtggcggagacgatgatctactagacgttgaagtcacttgatggcaaggacggcggtgattactgctcgcttaatatagattacaagcttaatagatgggatccgtggcatctcgtgaagggttgtaccctattttttgcctttaatggcgt

SEQ ID NO: 731 - DNA, 408 bp, Zea mays
  Clone ID: LIB3227-010-P1-K1-G12
gggaaacagtccttatagccgcccacttaggctgccattgattggtggggactcggacagacttccttttattgggaatcatggttctgttgggcgccactttggaaatcaacgaaggaatatctcaccgaactgcattcttgatggtcaccgtcataacttcctttgaagccatgtcaatgagttttacttgtatgttaagagtgttttataaggacttcaatggtgcatatacggttagaccgccttgttcatatcgtcaagtcgcacacttatgcttgtgcacagcactcttatgatcttatcctaatatatccccttagtatcttagatcgtatctttactatctttttttggtaccaaatgtaatccagtgtcctagtaataaagtacccttgttctattctc

SEQ ID NO: 732 - DNA, 408 bp, Zea mays
  Clone ID: LIB3227-010-P1-K1-G2
agcaaccaccgcctacccgatctcgtcgagaggaagcccaatcccgaaaccgtcgccgtattccaatggcgcccaaggccgagaagaagcccgccgccaagaagcctgcggaggaggagccggcggcggagaaggccacggcggggaagaagcccaaggccgagaagcggctccccgcgggcaagtccgcaggcaaggagggtggcgagaagaaggggaagaagaaggcaaagaagtcggtggagacgtacaagatctacatctttaaggtgctgaagcaggtgcacccggacattggcatctcgtccaaggccatgtccatcatgaactccttcatcaacgacatcttcgagaagctggccgccggaggcggccaagctggcgcggtacaacaagaagcctaccatt

SEQ ID NO: 733 - DNA, 343 bp, Zea mays
  Clone ID: LIB3227-010-P1-K1-G3
agaggtttgacttcacaaaagggttgaatcaaaagttttctcttagccacagagaggctgtttcgaacccgtgacctggtgattcagtgagacagctctgaccactgcaccaggcctgtccactaagatcattacataacttatgctatattctcccgaatccaaagttaatgctcattgcaagggtgatgacagatggaaggcttaatgctcgcgtgaaatgtgatttgacagacaatctcacgctgaaagtaaatgcacagcttacccaagaggcacattactcacaaggaatgtttaactttgactacaaggtcgacgtttctgacaagtcagtcaattg

SEQ ID NO: 734 - DNA, 403 bp, Zea mays
  Clone ID: LIB3227-010-P1-K1-G5
cattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgc

SEQ ID NO: 735 - DNA, 97 bp, Zea mays
  Clone ID: LIB3227-010-P1-K1-G6
gcagaagtatgctatgctattcttctggggtctaggttatgcttcgtctgaatgactggatgtgatttttagtggttcggtcagatcaaaggaagtt

SEQ ID NO: 736 - DNA, 295 bp, Zea mays
  Clone ID: LIB3227-010-P1-K1-G7
gtcctacatcgcaagaagtgtgtctctcacaaccacgcttacgaacgcgggcatggggcttaataactcttacatagaattaccttgattcattgcactacccgacgccgtcttactcgataactcgaaactgcttgtctttacaaacgtcattaagcttggcacatatataacctgctgcagctactgtaactataaatagatccgtgatctatctgctcttgcaaaaaatgaaaaacatgtactccgtatttcatcccgcctataattgagcatttaatacattatttttaac

SEQ ID NO: 737 - DNA, 393 bp, Zea mays
  unsure (1)..(393): unsure at all n locations; Clone ID: LIB3227-010-P1-K1-G8
ggagcgggtgcgagggcaagaacttctacacccggagcgcgttcctgagcgccgtcaaggcgtacccaggcttcgcccatggcgggtcgcaggtgcagggcaagcgcgagatcgccgccttcttcgcgcacgccacgcacgagaccgggcatttctgctacatcagcgagatcaacaagagcaacgcctactgcgacccgaccaagaggcagtggccgtgcgccgcggggcagaagtactacgggcgcggcccgctgcagatctcgtggaactacaactacgggcccgcggngagggccatcggcttcgacgggctcggggaccccggcagggtggcgcgggacgccgtggtggcgttcaaggcggcgctctggttctggatgaacagcgtgc

SEQ ID NO: 738 - DNA, 237 bp, Zea mays
  Clone ID: LIB3227-010-P1-K1-G9
aaaaaaaaaaaaaaaaaaaaaaaaaaataaaaggcctgccgatctaaaaagatgccaagctaacaaacacaagcatatcaacaaaataattaatcatatagtattaccggcgctccattttcgtggttcttggtttacaccgccgtcgctgcccaaaactattttctttactaagcttaataaaattgaaaacctttccctttttcccaactagctgaattggtaaaatccctttta

SEQ ID NO: 739 - DNA, 384 bp, Zea mays
  Clone ID: LIB3227-010-P1-K1-H1
aaacaatctggtaaagaggggtcagagcaatctaaagatgcttcctatcttctagatgctcaaagtggaatgagtgtgtcccctagagttgctgcccaggatatgaaagaaagccaagaagttaaagaagctctgagagcgcagatggaagtgcaacgaaggctgcatgaacaagtggagcaggtccaaaagcgcgtgcagatcagaatggaagcacttgagaagtacatcgacagtatcctagagagcgcatgcaagatggttactgaacaatttgcttcgagtggcttcagtatcttcaaccctgatcttccggagatattccctggaggggtcatgtgtggcttcacggacacgttgggctcgtcggtgttgaaccagctt

SEQ ID NO: 740 - DNA, 377 bp, Zea mays
  Clone ID: LIB3227-010-P1-K1-H10
gtgaaacagtgtttggagccagccggtcaagctgacagtggatgagggggactcggagctagtcgactttaacgcgcactatgatcgtcgttgtccttcccctgacaacagaatccgacggaaaggtgaagctactgctctttctgtgggaccggtagtatgtctctttgatgtcatggtgacgcgactgacacgtgtgggagcagtggattatacgagactttagtggcacttatcggcatggacccggtgcttcttgtcgcctacgtgggcgacaaggccacttcgcacgaccctgctcacccttggaggatggatcccatgtttgtgctcaagggcgtgtctactcttattctttgggtaggatggggtctcca

SEQ ID NO: 741 - DNA, 402 bp, Zea mays
  Clone ID: LIB3227-010-P1-K1-H11
acggcctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatatacttttataatattaaaattggaccg

SEQ ID NO: 742 - DNA, 404 bp, Zea mays
  Clone ID: LIB3227-010-P1-K1-H2
caccagtgtgctcgtgcaccggagctccccagcagtgctaccggtggggtgcaggtgggtggcagtctgcatgctgcacgacttctatttcaacgtatccactgccaatgaacacaaagcgccggggcgcacgtattgctggaaggaagatgagccaaggtgcattcaaaaaggtgcttgagaagcttgctggtgaagggtacaatcttgttaatccaattgacttgaagacgttttgggctaagcatggtacaaataagtttgtaacgatcagataaagaagccgtgctatgtttgtcgctttgtaggttgtagagctgcagttaggcctgatttattgtttgtatgcctatgtgccagtctgcagacatttgtagtagtagtttttagccatgtttagtttc

SEQ ID NO: 743 - DNA, 393 bp, Zea mays
  Clone ID: LIB3227-010-P1-K1-H3
caaactcctcgtttcagaggaactgcatccattgggtgagaagctgagggccaactatgaggaaacccagaagcttctacttcaggttgctgggcacagggatcttctggaaggtgacctctacctgaagcagcggctccgcctgcgtgatgcgtacatcaccaccctgaacgtctgccaggcctacaccctgaagcggatccgtgacccggactaccatgtcgcgctgcgcccccacctttgcaaggagatcatggactcgaccaaggctgttgcggacctggtgaaactgaaccctggcagcgaatacgcaccgtggctggaggacaccctcatcctgaccatgaagggcatagcagccgctctgcacaacaccggttaaccatgaacagg

SEQ ID NO: 744 - DNA, 406 bp, Zea mays
  Clone ID: LIB3227-010-P1-K1-H4
ggaaaggaaaggacgaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggcaccaggcggcactaaattcacaagaaacccccctccacctcaagggatcgagatcatctacaattatggcaaggaggaccagtaaacaagagtcctgcaagcggggggcag

SEQ ID NO: 745 - DNA, 402 bp, Zea mays
  Clone ID: LIB3227-010-P1-K1-H7
aagcgatcagagcgaggcacggcgagggcgacgacagagccatgagttaccagaaggtcccggagtcctatccgccaccagggtactcgcagccgtacccaccgccccaggctccaccgtaggggccttactacccgccgccgcagcaaccaccttcggggtaccagggctactttaacgacggccagcaaccctacggctatccgccgtcgcagggtgggtattaccatcacggtcaccaccaccataacgaccatcatcaccatcatcatggtcaccaccaccaccaccacgaagatgatgactgctgccttggcttcttgaaaggatggctggccgctctttgctgctgctgcatgatggacgagtgctgctgctgctgcttctgacatacatgcacct

SEQ ID NO: 746 - DNA, 390 bp, Zea mays
  unsure (1)..(390): unsure at all n locations; Clone ID: LIB3227-010-P1-K1-H9
cccacgcgtccggaaaccctagcccgggaggctctcacctattattagaatccacctcgcaccccgcgagcggtgacttccctagggtttagtcgcgccgccgccgccgccgaaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggngcgctacttcaagaagcggttccgcaaggcgcagtgcgccatcgtcgagcgcctcaccaactcgctcatgatgcacgggcgcaacaacggcaagaaggtcat

SEQ ID NO: 747 - DNA, 343 bp, Zea mays
  Clone ID: LIB3227-011-P1-K1-A1
cccacgcgtccgggtggtttctcttgggcgagagctactgggtggcaatggcattttggttgattttcttgtcgccaaggcattttgtgacgtggaacccattttctcgtacgagggcacctatgacattaatagcctggtggctggcagagagatcaccgggatcgcgagcttcaagcctgctgtgtcagcaaaatcacgcctgtgaaagttgtttttttctttgttcccgaagacagtagaaatcaaccttgtacattcagatgattgggaataagaacggtaggaaagctgtaaaactcgacgtgcttcctcgtatgtactgttcttgttcaaattattc

SEQ ID NO: 748 - DNA, 407 bp, Zea mays
  Clone ID: LIB3227-011-P1-K1-A10
ccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagagaaaattaagctcaacaagcagctgccctacctcgttggcaacatcgttgagatcttggaaatgaaccctgaggatgaagctgaggaggatggtgctaacattgatttagactcacaaaggaaaggaaaatg

SEQ ID NO: 749 - DNA, 436 bp, Zea mays
  Clone ID: LIB3227-011-P1-K1-A11
ttgccggggacgcacaccacgcctgcgagaccttggaagaacttgtgatggactgcaaaaaacaggcttcacaaattgctagagctcgtgaccaagaggaggatgaagagaactataggcatcgagagtcgctgagagtgattagagaaaattacatggcgagagtgattaccttgaggaatgtgcatgcaaagaagtgggaagaatttcttgacacctttaaaagtcaacaacaagcacagccttcatacatacaaaccggatatctaggttttgagcagagaacggcacatatttcagctacacatcaaccaatggattcgaagagcacatatccgtatgcttctgatagctattcagccccaaaggctcatgcagcatatggtgagtttcaacatgagaggcatgatgatcttgggagggcctataggcgata

SEQ ID NO: 750 - DNA, 243 bp, Zea mays
  Clone ID: LIB3227-011-P1-K1-A12
ctgcttcacaagtcgcaaccctgcctgctgtacagtagtaaccatgcatgctgtagtctgccctatatgttgacgctgtcgttgtacctggcaacgtgtaattaactgccccggagacatctgtttttgccatctttaaaacgtatggatctcaataatatgacaagagttgcctgcttatgtgacattagcatccaaaagcaagtgtcatttaatgtaaaatcttggtctttgttggtcatc

SEQ ID NO: 751 - DNA, 411 bp, Zea mays
  Clone ID: LIB3227-011-P1-K1-A2
gtgcaaatgtcgttgtggatggcaccacggtgaatttgggcctgtgggataccgcagggcaggaagattacaaccgactgaggcctctaagctaccgtggtgcagatgttttcgtgcttgcattctcacttgtgagtcgagctagctatgagaatatcatgaagaagtggataccggagcttcagcattatgcacgtggggtgcctgatgtgttggtaggcacaaaatttgatctttgtgaagacaagcactacttgatggaccattctgggttggtgcctgttaccacagcacaagggtgggaacttttttgacaaattggtgctatgttttaaatctaatgcagttctaagacactgaataattgttaagattttatcgattcttccactaaggttgtttttcagcctt

SEQ ID NO: 752 - DNA, 417 bp, Zea mays
  Clone ID: LIB3227-011-P1-K1-A3
ctggtctcagtcttccgactggaatgccaacaaaggaagtggcgaaggaaatcaagctttctcgaaaagcaagcccagctgggacgcgcaaaacacctctggtggagatgaccaggcaggaaagaagagtgacacagacaactcctggagccagaaccgatcatctccatctatcctgggtcagccaagcggtgatgctaataacaagtctagcgcttgggacggcgctcccagcggaggagctggcaggggaggttcaggttcttggggaaagagcgacgaggatggctggaactcgtcgtcgggaggatcagccagagagaagccttcgtggggtggtggggcagaagctccttccaggaaggggggcgacggtgcatggtgcaaaggctgtaaggggagccggagcctattatg

SEQ ID NO: 753 - DNA, 192 bp, Zea mays
  Clone ID: LIB3227-011-P1-K1-A4
cgaccacgcgtccggtggtataaattttcggactttaatgccttcacatgacgagtctaaataaatcaaggggtcttgacaagcaagttcagctgctacgcgcaatatacctcttctggagaattccagacaggtatgaagtgtttctcatacatcttttggagccagatcctatcatctccatatattttg

SEQ ID NO: 754 - DNA, 412 bp, Zea mays
  Clone ID: LIB3227-011-P1-K1-A5
ggcagctgtaaatggtacatctgaactgatacatgctactggatctcatggctctggtgctattgctgagcgaatgccgctcattcaaattcttgtccctcatattatgggtctgaaagagcagctcaaagatccatctaaggatgaagaagatgtaaaagctattgctcgtttatatgcagacatgggtgaatcctatgttgacttgattgccacaggttcagatgattcaattcaaatagtgaacgcattgctagaagttacttcacttttggaatttgatatttcgtctatgacatttaatttctggcaccgtcttaagcgtaacctgatcaagagggactcttatgtatcatatggatcagaggtggcaatcgaagctgagaaaaacagaagattacaagtatttcgt

SEQ ID NO: 755 - DNA, 234 bp, Zea mays
  Clone ID: LIB3227-011-P1-K1-A6
taaagggatcaaagctaacgtccgcgggcaggcaacgtaaaagcttttttatggggcccccaaaatcaaatccacgggccggggtttaaaaacgtggggacgggaaaaacccgggggtaacccaactaaatggcctggaagaaaatccccctttcgccggggggggaaaaaccaaaaaggccccaaccaatcgcccttccaaacatttgccacacctgaagggcaaaggggccc

SEQ ID NO: 756 - DNA, 383 bp, Zea mays
  Clone ID: LIB3227-011-P1-K1-A7
caaagatcaagaacaatgcccagaaaactacctaactagggcttttgatcaattgatagtggttctgggaaggtttcaaactaagatcaagtctgaaacaagcaagaaaagttctgagattcttgcagctactagagagactatatgtcagcaccttgagggggttgaggcgcagatgcaggctgacgtggacaaattggtcaatgcaggcaggtctaaaaggaaacgcctagaatctacatttgaagatcaacaagaaaagttaagaattcttcatgagaagttcaaggaggaggtcaacaagcagcttctgaattgcaggagttctcttgagggttttgaatcctaccatgcagaacttaagggagtagcttgcaagcaaa

SEQ ID NO: 757 - DNA, 285 bp, Zea mays
  Clone ID: LIB3227-011-P1-K1-A8
taaaaaaaaaaaacaataaaaaaaaaaaaaaaataaaaaaaaaaaaaaaaaaaaggggtaaaaaataatgggatgtgtcaatgttttgggcgcttgcttgggcgggcgtttttttggttccaggtttcctttcgcttgtttgctttgtttttgtttttcttttgttgaatttttgtgcacttctttgtccccccttttacaccgctggccttgtggtaaccttgtttattcccctcttatttgcctttgcttttcataccccttttttctcttttcggttttttt

SEQ ID NO: 758 - DNA, 413 bp, Zea mays
  Clone ID: LIB3227-011-P1-K1-A9
ctcgactggccgttgtgtttcaccactactaggacacagctcttgtgtgtggacacttgctttcagctgtgaaggagcattgcttgcatcgggatcggctgactgtactgtaaagctctgggatgtcgcttctagcacaaaaaccctgaagacagaggataccaaaggcagctcagctaaccgactgagactgcttaaagctctccctacaaaatcaactcctgtttatagcctgcggttttctcggaggaaccttctatttgcctctggtgctctctcgctaagctcgtcgtaagctgtgttttttttgcagaaaactagaactggtcctgttttgacattgagtagtgaagctggcatttcagagactgcctattgtacagctaatattttcattagcaattccaacgaac

SEQ ID NO: 759 - DNA, 415 bp, Zea mays
  Clone ID: LIB3227-011-P1-K1-B1
gtgaaattgaatggaagattgttatttcaatgccttctgtgttgtcaacaggtggagagggtattatcccggccagatgtgtatgcaattgaaagggcaaaggaactgcttataggccaagagcagtcattgcttgatgcaattgccaaacttgatgaagcatctgaccatgaaagcggtaagttgccatggattgctagatttcatgaatgctctatttaaatgaatagttgttctctggacagtgtaaatagatatggtgaagtaccaaatctttattactgtcatttatttcccttcaacatagcgacatatttccatgcgataggaggttccatgtgatgtttcgtgtactgtagtagttgtctggtacgtagtccagcaacatattgttttgaatgcatgctgacagctt

SEQ ID NO: 760 - DNA, 406 bp, Zea mays
  Clone ID: LIB3227-011-P1-K1-B10
ctgactcaggtagatggctacaaaactgtattcaagccagacaatgagaggagtattctggaggtgccaacaaaggatgacttgctgttttctcaccggataccctctttccagctgacaacagagaagggtggcgagctctgtggcttctacgagctggatcctgctgctattcctgattccttcctctctgcgggtacccactgactcgcgaaggctgaattcgattacctccgtcattgaactggtgatattgcatgctcttctggacgttagtgtgtgtgtgggggcaactctggtttcggccaagccttgccaaacctacacactccactcggtaggcctcggtgccttttgtactgtactgagcatacaatttgattctaacgctgatgcctatgaaact

SEQ ID NO: 761 - DNA, 262 bp, Zea mays
  Clone ID: LIB3227-011-P1-K1-B11
ctgactcatgtagatggctacaaatttttattcaagccagacaatgagaggaggggtctgtaggtgccaacaaaggatgacttgctgtttactcaccggataccctcttttcagctgacaacagagaagggtggcgagctctgcggcttctactagctggatcctgctgctatttctgattcctttctctctgtgggtacccactgactcgtgaaggctgaattcgattacctccgtcattgaactggtgatattgcatgct

SEQ ID NO: 762 - DNA, 410 bp, Zea mays
  Clone ID: LIB3227-011-P1-K1-B12
accagccctccgagcgaggatggccggagaccgtcgaagccgacaacccgatgcagcagcagcatggcgggccgaccatcgggttcgcgcccggtaccggcttctccgggatccgcatccccaccaggatacagggcggcgaggagcacaacggcggcagcggcaatggcgacaagccgccgccgccgtctgtttcctcggcttctcgccagtgacagcagcagtggagcacagattactccatccaaccagcatgaccattgatcagtgcagcgtgtatcactaaaatctcacacgccagctcctcagcgtgcacccttgttgcgagagtctctctcgtgattcttcttcgttgtagcactgcattttcccacgacaggattgccgtttcttgtactactgagtttctg

SEQ ID NO: 763 - DNA, 420 bp, Zea mays
  Clone ID: LIB3227-011-P1-K1-B2
gggcattgtttcagatgttgacctgtatgtgttcccagccacgccctatgcactctgaactaatcaggcacacggtgaacatttctgtgcttggggactatgtattctttgcgcgcgtggacccttatgaaatataggaaagcaaccggcctaccaaaatgaagctttgacggctggaaccagatgagagaggcgtgacatacataaaagaaagtgttcgggactttgttgttggcagtggtgcatatgtgatcaaagattttaagttcactgttaaccaagcagtgcgaccagtggagaagcgcatcggtacattgatgaacaagaatgataagagtaagaaaagccaggacgacaactgagtgagtgcagcaacaccagagaggcctgttcgtgggatagatgatccattattaagcg

SEQ ID NO: 764 - DNA, 337 bp, Zea mays
  Clone ID: LIB3227-011-P1-K1-B3
gcaaattgtaccttgcatgtacttgtattctcaacgggcacaataaaagatagaaatggctcatgcatcactacttaacatttattaacttaaagactatatatatctttaaatctttggactccttttcatttctattaacgcttccgcctcttccaatatgatatcttactcagtttgtaccaattgatttaagcttgtcttacataataaatagttttcttgactttgttgttgtcattggtgcatatttaatcaattattttaagttcactgtttatcaatcattttgacttttgattaatctcattttataaatttgatgaatatcaatttt

SEQ ID NO: 765 - DNA, 195 bp, Zea mays
  Clone ID: LIB3227-011-P1-K1-B4
ctgtcgttgtacctggcaacgtgtaaatcaactttctccggtagacactctgtttttatgctcatcttttagaaatcgtgtgtgtattcttatattaattaattttccgagatgttttgccacccatattgtagacttatctccatcatacataaatactaccctattgtaaaatcttggtctttgttggtcatc

SEQ ID NO: 766 - DNA, 414 bp, Zea mays
  Clone ID: LIB3227-011-P1-K1-B5
cgcaaggcgaaggttgagttcgacgagcagccgccggataacttcgacccgaagaacccgtatgccgacccggtggcgatgctcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagaggtgatctgacccttccattgagttgaatgaagtagcctggaactgtggtagttcgtct

SEQ ID NO: 767 - DNA, 413 bp, Zea mays
  Clone ID: LIB3227-011-P1-K1-B6
cagtgaccttgttctggtccttagtgatggtaaaatcgcagagttcgacacgccccagaggcttttagaggacaagtcatctatgttcatacagctagtatcggaatactccactcggtcgagctgtatatagagaggctgcttaaaaccccgccccaaacctggcaacagaggctgggaggcaaatagcccgtatctgccagtgtacttgcttgcgccatagaggtccctgcgaacaccggagggcggcgtagaagacgaggtgtacatgagtgggaggaacactgggcgttccctgacctgaataccgtggaatcggcgagggagcgcggttggtattggtaggcaccaggggaggagttggtgacactagtacattacccgaagctgatgcttcagtatgtatgtataac

SEQ ID NO: 768 - DNA, 413 bp, Zea mays
  Clone ID: LIB3227-011-P1-K1-B7
gggaatatattctacaggccacgagaaaaacaagctcaagctgatcaaaagagggctaaattttttcagccagagggagaccaccttactctacttgctgtatatgaggcctggaaggctaagaacttttcagggccctggtgttttgagaactttgttcaatcaagatcattgaggagagcccaggatgtgaggaaacaacttctcactatcatggacagatacaaacttgatgttgtctccgctgggaaaaacttcacaaagataaggaaagctatcactgcaggcttctttttccacgccgccaggaaggatccccaggaaggatacaggaccttggtcgaaaaccagccagtgtacatccaccctagcagcgcattgttccagcgccagccagactgggtcatctatca

SEQ ID NO: 769 - DNA, 368 bp, Zea mays
  Clone ID: LIB3227-011-P1-K1-B8
gagaatatattctacaggccacgagaaaaacaagctcaagctgatcaaaagagggctaaattttttcagccagagggagaccaccttactctacttgctgtatatgaggcctggaaggctaagaacttttcagggccctggtgttttgagaactttgttcaatcaagatcattgaggagagcccaggatgtgaggaaacaacttcttactatcatggacagatacaaacttgatgttgtcttccgctgggaaaaacttcacaaagataaggaaagctatcactgcatgctttgttttttcacgccgccaggatagatccccaggaaggatacaggaccttggtcgaaaaccaaccagtgtacatttca

SEQ ID NO: 770 - DNA, 104 bp, Zea mays
  Clone ID: LIB3227-011-P1-K1-B9
tataatattgactacaggccacgtgaaatacatgctctagttgatcaaaagggggcgaaatattttcagtctgagggagtaccaccacattaaacttacttttt

SEQ ID NO: 771 - DNA, 217 bp, Zea mays
  Clone ID: LIB3227-011-P1-K1-C1
tgcatatatgcctgaatataaataaatatgaaacggcgatatggaatttagaaatgtcatcactcacattcactctagtgagcacaaaggttaattaatttccgtatcgccgtttcatatttatttatattcatgcatatatgcctggcaacaattcctgtaataacgtcgtactcgatcgttctagcactaataatatattatctattattgcaaa

SEQ ID NO: 772 - DNA, 295 bp, Zea mays
  Clone ID: LIB3227-011-P1-K1-C10
cccaaaccaacttattgataattaatactagaaagtagagagacatgaaagcataaaaaatacagggtccagaatgtaaccacagataatgataagtcaggtgggtacgacacccagaaaccctttgcacgctatagcaaaagccagctcaagccaggtgaatgtctcggtagcaatcctttggtgatacactttttttccgatttaagttgagatacaagaggggtccgtcttcaaagccaaggaagttacttggggccaacattctttaacgcgcaaatttgtttcttcccca

SEQ ID NO: 773 - DNA, 404 bp, Zea mays
  Clone ID: LIB3227-011-P1-K1-C11
gcagcactcatatccccatagtgctatcttgccacaagttacgttgcagtttgctaaccagctacccattcctcaagtacaattgtatcatcaaagccagcaggaatctgggcaaacactgaggcaagttggtgaacaatcacaacttcagaaccagggtatgcaagcagatagtttctctcaacagcagcaagactcagggatcaacttaaaccagttcttttcatctccagaagccattcagagtctacttagtgatcgtgagaagctctgccaacttttagagcagaatccaaaacttatgcaaatgctccaggatcgcattggccagttgtagtcgcactggaggtgctattgtgaaagtgaaatctgatgctggtcgatcgctaggttcctagagtatg

SEQ ID NO: 774 - DNA, 450 bp, Zea mays
  Clone ID: LIB3227-011-P1-K1-C12
gaccggaccggaattccattcccgacccaccccacccgtccgatttagatcattgtgtacaaatgacggaaaacatcgcgacgaggcatcagtcgaagcagttaggttgatcgcagatcatgtgaagctcaatgattgccaactccatcctgatagcattgaggtcttcctgtctttgagatttgatgaagatattggaaaagatgagattcaggaggaaaaggtgaaaccaaagaggaataaacgttggcaaaaaaatcaggaggttccgaagcaattgccagttaatgataagaagaaaaccatacaggaactgatctcaaaagctagaaaggaggttgatgcagaccttagagcagtttccttcactcttgacccgaaggagagaaaagggatacaaaaagaaacactttctgctctgtttgagacttacttccgcattctgaagca

SEQ ID NO: 775 - DNA, 414 bp, Zea mays
  Clone ID: LIB3227-011-P1-K1-C2
gaaacattctccaatatttcaccgaacgccgtgaatgctgtcacgtggggtgttttccctggcaaggagattatccagcctacggttgtggatcatgcaagttttatggtttggaaggacgaagcatttgaaatctggactcgggggtggggttgcatgttccctgagggtgattcatcgagggagctactagagaaggttcagaagacctactacctggtcagcctcgttgacaacgactacgtccagggggacctgtttgctgccttcaagatctgattatgctctcatggtctgtattgttgtatggttggacccaacaatattcttgcatccccgactacaggtctgatcgccatgaaagcttctgttcatttgagctcgggggagtccgctagtcttatttttcttgat

SEQ ID NO: 776 - DNA, 416 bp, Zea mays
  Clone ID: LIB3227-011-P1-K1-C3
ccctggcaacactggtctggatccgtcccagacctctttcttccaggtgcttaacatccccaccaagattaacaagggtaccgtggaaattatcacccctgtggagctgatcaagaagggtgaaaaggtgggctcgtccgagtctgccctgctcgccaagctgggtatccgccccttctcgtatggcctccaggtcaccagtgtctacgaggatgggtccgtgttcagccctgaggtgctcgacctttccgaggaggacctgattgagaagtttgccactggtgtctccatggttgcctccctgtcactggcgatctcatacccgacccttgctgctgtgccccacatgttcatcaatgggtacaagaatgtgcttgctgttgctgtcgagacagactactcatacccacatgctg

SEQ ID NO: 777 - DNA, 328 bp, Zea mays
  Clone ID: LIB3227-011-P1-K1-C4
taccagcccttcgagcgaggatggccggagaccgtttaagccggcaacccaatgcgggagcaaaatggaagaccgaccctcgggaaatatcacccaccgggtgcttgtcaatacgggtgaaaaggaggactagggcgagactgccctgatcgacaagctgagtataggtcgtttctcgaatggcctacacgttaccagtttttacaaagaccggttcaggcccagggaatgatgtgctcgaccttctcggggaggacccttttttcaagattaacgttggaatacagatgggtgccttcttcaaagtcaaggaagtatattggggcca

SEQ ID NO: 778 - DNA, 353 bp, Zea mays
  Clone ID: LIB3227-011-P1-K1-C5
gggaccatcaagagtttccctaaattgtcctataagttttaggcgcataaaaactcctatcaaaggccgtctttgcaaacactatcagtgttttgattatgataattacatggagatgaactcaagaaaaccaaactggcgctgtccatattgtaacacctcctcaagcttcactgacctacgtattgaccaaaagatgatgaagatactagaagagactggagatgatgtcactgatgtccttgtatttgctgatggatcttggaaagttgttccagctcaggatgaaaaatctgatagacatagaggtgacacaattcagcaggctgaagatgctgtgaatataatcgatt

SEQ ID NO: 779 - DNA, 341 bp, Zea mays
  Clone ID: LIB3227-011-P1-K1-C6
gctcttcatgccatgacgaccagtacgtgatcaccaacggcggacgggcggtcggccggcccggcatgcaggcgcgcgcgtgctcttcctttgtactgcaagacgacgatggatcgagaattcgagacgacggcgaccactctcgatggaagcttcaagtgccggtgccgtaagcgtgcgttaatttaattttgcgagacttaagggaaggacggattttggatggtactaagaaagaagctaggggattgcattggtgtgaggtgattaggcgtgcgtaagtggtggtgcgctgtgtctgtgatctgtgtatatatatgcaaatcagtagatcttatgtt

SEQ ID NO: 780 - DNA, 411 bp, Zea mays
  Clone ID: LIB3227-011-P1-K1-C8
ccgacgccttcagatgcaccaagatggggaagggcaagacgatcgtgctggggctggggagggacagcgacgaggtgtgcctgccgtcgctggagctgctgttcgggaggtgcgtcatggggtcgctcttcggcgggctgaagcccaagacccacatccccgtcctcgccaagaaatgcatggacaaggagctgcagctggacgcgctggtcacgcatgagcttggactgcaggacatcaacaaggccttcgacctgctcctgcaggggaaaagtctgcgctgcatcctctggatggacaaggacaagtaacggaaggagaggggcggccggaccaatccttcctgtctctgaataaatttgccctgttttttcagcgaggcgtcgctgaaagctggtgttagcggcgacc

SEQ ID NO: 781 - DNA, 80 bp, Zea mays
  Clone ID: LIB3227-011-P1-K1-C9
tcgacttcttaatatgcaccaagtattttaatgctgtgactatctctcttagggggggttgagacagtcgacgaggtgtt

SEQ ID NO: 782 - DNA, 377 bp, Zea mays
  Clone ID: LIB3227-011-P1-K1-D1
gaaggataagaaaatggaggaagatgataggtgttggtggtaatgactggaagcattatgttagaaggaaccctcatgtggttaaaaggcgaataaggaaaggaattcctgattgtctcagaggacttgtttggcagttgatttcaggcagtcgggacctcttactaatgaacccaggggtttacgagacactggtgatatatgagacatcggcctctgaattggaaattattcgtgacatatcacgcacatttccatctcatatattcttccaacaaaggcatggtccaggccaaagatcattgtataacattttgaaagcatattctgtctatgacagggatgttggatatgtgcagggaatgggatttttagct

SEQ ID NO: 783 - DNA, 413 bp, Zea mays
  Clone ID: LIB3227-011-P1-K1-D10
gtgtccgtgcatgtctagggtccaaacggatcgacgctgcgcggaccatgtgacagccccgcgctcatacgattcttctccagcaatgacgtgacggtatgcggcctgcggatcgagaacagcccgcagttccacctcaggttcgacgactgcgagcgcgtgcgcgtcgacggcctcttcgtcagctcgccggcgtccagccccaacacggacggcgtccacgtcgagaacaccaagtccgtccagatcctcaactctaggatctacaacggcgacgactgcgtctccatcggcgccggatgctccgatgtccacgtcgagaacataacatgcggccacggccatggaattagcatcggcagcctgggtgtccacaacacccacgcctgcgtgtccaacgtcacggtccggaa

SEQ ID NO: 784 - DNA, 112 bp, Zea mays
  Clone ID: LIB3227-011-P1-K1-D11
gcgagagcacttgtggaggtggcacactgcacaactgtcgcatgactgattggctgtaccgcccagaggatgtagttcttgcacagcttcgataacttcaaggctcacttgg

SEQ ID NO: 785 - DNA, 175 bp, Zea mays
  Clone ID: LIB3227-011-P1-K1-D2
tcgctatgtccgccccggtttgccactgggttattaagaacgtcattatggatggttgtctacactacattattgcttctcgatattggaaaactgttatgcgcctaaaaaaaaaaaaaataaaaaaaaaaaaaaaaaaaagaaaaaaaaacattaaaaaaatataaaagggggg

SEQ ID NO: 786 - DNA, 412 bp, Zea mays
  Clone ID: LIB3227-011-P1-K1-D3
tttgggccctcaagactcctgtatgcacggggacactgaagtgcggcctgaggtcgaggcacagcgaacgcgttggctgttcaatgttcatgtatacgactgtcgcttaatcttgcaaatcggcaaatgcattttgttgagttaaataaaaacgtgtagcggccgaatctttccatgtggccgctcctgatgccgacgtggtgtggtggcaaatggcatggcaggtacaaggactgttcctcggttcgcggcgtgggggtcactgacgcggccaccattgtgctgttttatacagggagtgtgtatcttaacaatttttttttaaattgctctcgattttacattatatggtattgggaatgccgtgttctaattataatgtttttttctttctttttataatttttttttt

SEQ ID NO: 787 - DNA, 412 bp, Zea mays
  Clone ID: LIB3227-011-P1-K1-D4
atcggctatttggatgggagtaccggagacctgaaagagtcccacctgcatgtccatacaagcctgcagctcagaagaacgatgagggtgcgagtgaatcaaaacccctggtcgaaccgcacggtgctggtgctggtgctgcggcggcagaagataagaaagtggaatgatgcagcaggcgcttaaaatggaggccacggctctgtgtggttagctaagaaacaataattgttgtggatggttatgtacttgggtgatgggttgaacttgttatgacactccggatccttaccagttgcattactaatcgctgctgctggtctggtctgtctgaatagaagggagttgaacttgcagtcgcaaatgtaatagcgagagtgaatcttgttgtccaactgttcaaggctttcgt

SEQ ID NO: 788 - DNA, 417 bp, Zea mays
  Clone ID: LIB3227-011-P1-K1-D6
caataatcccagggttgaacttgaatcccaccagaaacacggagcatccacagaatacacaccagccctagtctaatccaatcgacatcgacagagtaccagtagtctcataacagagagagagagagagagaaaaaaaaagaaaagagggcgataacgcaggacaaagctagaatagcacggcccagttccagctcttccgtaagctggttgcttcacttgcagccgtgttggacccggcacggatggttccgtcagaagcaggcgtccaggaggcagcagcagcagagggcagccaagcatccttccatgaaggaaggcccgctgctctgctgctgctgtggaggcggctgcgcgtactgcggcgggtagccctgctgtgggtaaccctgctgcgggtagccctgcggcgggtag

SEQ ID NO: 789 - DNA, 284 bp, Zea mays
  Clone ID: LIB3227-011-P1-K1-D7
gcgccacccgtcctctagataagaaaatggaggaagatgatatgtgcctgtggcactgaccggacacattatgctcacaagccctcttctaatcttaaaaggctaatcaggaaacggattcctgattgtctcgagagacatagatagtaaataaatctaaacagggcgatacctcttgacaaagctcgcataggctggcccagctccagctatttctaagccatgcgctttactagagaccgtttgacccgtctactggatgggtccgccagaagcagtgctat

SEQ ID NO: 790 - DNA, 381 bp, Zea mays
  Clone ID: LIB3227-011-P1-K1-D8
aaaagtcatcattgcctttctatgaggttgacactagaatatttcaaatcatcttcattggattctgatgattctcctggcaggttcagtagtccagaatacaggcacttcgttatactatcaaggaacgttcttgcggcttctgtagcaatcaactcaactgtgagcagttgtaaggagccaggctactttgcttttcatatcctaactgacgctcagaacttctatgccatgaaacactggtttgccaggaattcgtataaaaatgcagctatccgtgtcataaactacgaagcaattattttggagaaacttccaaagtatactatccggcagctgtttttgccagaggagttccgtgttctcattaggagcattaag

SEQ ID NO: 791 - DNA, 408 bp, Zea mays
  Clone ID: LIB3227-011-P1-K1-D9
gccccttgtggcctgaagactcgtccatttgactcaattctggctgaagtgcgcgcattcttcgatgtgcatgatcaagaaggaagtcacccaggaggcatccaccttgaaatgactgggcagaacgtgatcgagtgcattggtggatcacggactgtgaccttcgatgacctgagcgaccgctaccacacccactgtgacccaaggctgaacgcctcccagtccctggagctcgccttcatcattgcagagaggctcaggaagaggaggatgcggtcggggctcaacaacagcttgcctctgccaccactggctttctaagtagccgaagctgaacagagaaggtagagggatagttgcggcgactcgaaagattacgcatgtttatttgttgatgcttggtgtgga

SEQ ID NO: 792 - DNA, 411 bp, Zea mays
  Clone ID: LIB3227-011-P1-K1-E1
cgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacctcaacccgtccgggcgcttcgtcatcggcgggccccacggcgacgccggcctcaccggccgcaagatcatcatcgacacgtacggcggctggggagcccacggcggtggcgccttctccggcaaggaccccaccaaggtggaccgcagcggcgcctacgtggccaggcaggccgccaagagcatcgtggccagcggcctcgcccgccgctgcctcgtgcaggtgtcgtacgccatcggcgtgccggagcccctgtccgtgttcgtcgactcgtac

SEQ ID NO: 793 - DNA, 411 bp, Zea mays
  Clone ID: LIB3227-011-P1-K1-E10
ccgctgccgctttgacagggctcgcagcgccgagcgccgccatcagtgcaatccttgcgaagatcgactatgatgggcttgactactggatggtcatagcgtgcggggctctgatccccagctttggccgcgtcttcaggcgctcactgcggttggacgtgcggaagagcgtcgttggcctgctggtaggtgttgccttcgcctccgtgtgcttgatgtcgactagattcatctgtctgcacactccttactgtaactcggctccagaagccgtcacataactttgttgctgccccgtgctgttgtaaaacacatgtaatactagtgtaatggcgatacaaaaggaggatgtggaagggttacgttgcgtcgaagagatctcttacggcgatacaacaaagggaaatggat

SEQ ID NO: 794 - DNA, 248 bp, Zea mays
  Clone ID: LIB3227-011-P1-K1-E11
ggggccgccacacgtctgaaaaatcctcgccttaacaagggcagcggtgaagctattctgcgaccgcgagaagcgagtgagaccgggataacaaacgttaaaagataaaggctagaagcttcttagggcaatagacacacacgaatcccaatctacagtctggcacaaccgattgccgagggcaaacacaccaacgctcctggagaggggtctaccctgtgatcttttgtactgataaagggcccgtc

SEQ ID NO: 795 - DNA, 409 bp, Zea mays
  Clone ID: LIB3227-011-P1-K1-E12
gaaagctattaaggctgcttccgagggtccactcaagggtatcatgggttatgtggaagaggatctggtttctaccgacttccttggtgacagcaggtcgagcatcttcgacgccaaggccgggatcgctctgaacgaccacttcgtcaagctcgtctcgtggtacgacaacgagtggggctacagcaaccgcgtcgtcgacctgatccgccacatgttcaagacccagtaggggtttttcccccctgcttctcatggatggttgctgcttgtgtatgccgagaataaatgtggatggcgcgtgcctctgggtcgccaggttcatgctgagtctggacatgttttgcacttttgtttcccttcctgctaccatctgtgacagatccgctcgctaatatgggacctgaga

SEQ ID NO: 796 - DNA, 400 bp, Zea mays
  Clone ID: LIB3227-011-P1-K1-E2
cttgtctcataggctatcgcaccttaccgttcactatactccatgcatattgtcggtagttgctgactgcattttatgatgtttttattggttcatatatttgttctcatgtctttggatgttgatgtctggcacgagttccgttttgcagttgggttgtgatacggtttggttgtctaactataaagtcgtcaattatcgtatcttgtacccaaactgatggcttactttcctgagtaacgattaagacaactgaaacacgggctactactcgattaaaattctgataaatgttctgttctctgtagctgatggcagtcagatgttatgcggtattgtttgattgttccctatattgccaataaaaaggtttgcacattgacagttgaaatgaaacttc

SEQ ID NO: 797 - DNA, 416 bp, Zea mays
  Clone ID: LIB3227-011-P1-K1-E3
cctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctttatgtcattcctaatggaataggaaatgccgtgtttcttacgcctgcttttggttctgcattctactgaaaaagcgt

SEQ ID NO: 798 - DNA, 291 bp, Zea mays
  unsure (1)..(291): unsure at all n locations; Clone ID: LIB3227-011-P1-K1-E4
tccgacagatgcacgctttgacagcgctcgcggcagccgagcgacgcacgctgtagcaagcgagcaaagttatcgatcctgcgcctggtctactgtatggtcatagcatgcggggctgtgctgctggtnatgcctgctgttatcaggcactcagtggagatgtgcgtgcatgtgcacgtatatctacttattagatgccctctctggaatgccaactacacatatggcagctcgatttataggcgcgaagactacttactggtacatgcctccagatggcgctaccttact

SEQ ID NO: 799 - DNA, 407 bp, Zea mays
  Clone ID: LIB3227-011-P1-K1-E5
gtacgcgacgagcccgaggctgctggcggtggagctgctgaacgagccgctggcgcctggagcgaccctggacagcctcaccaggtactaccgcgacgggtacgccggcgtgcggaaacacgcgccggcggcctacgtggtcatgtccaaccgcctgtcgtcggggaactccacggagctactgtggttcgccggccgagggttcccgggcgccgccgccagcgtgcattactacaccgtgttcaacaggttgttcggtaacttcaccgcgcagcagaacatcgagcttaggcgggctaacttcttcggtgagcgtcggcgactcaccacccgagatggcccgctcaccttaatcggcgagtgggttgccgagcggaaggtgcccaacgcgaccaatgaggaatacc

SEQ ID NO: 800 - DNA, 417 bp, Zea mays
  unsure (1)..(417): unsure at all n locations; Clone ID: LIB3227-011-P1-K1-E6
gaaaatactgtgcatcagcaagtgattgataatgcaaatgttctggatggagaacagaatagagacagggataacaaaagttcagaagataagagctcagaggattctaaggtcaatgttaatgaggcagcaaagggtcaagcaggaacaagggataggaggaggcagcaaaaccaaggcaggtggagaggggttgaccctgtgatattttttaaagatgaagtgacagtcaaaagcattgtatctttctatggtatcacagattcatttccacttgaaggtcatctggtgactagaaaccctgatactagtcatgttaagagaatatactatgtgtcaaaatctgttcaagatgttttggagctcaacataaaaattggcgaaaggctaaagatcacctcactgngcctaaagatt

SEQ ID NO: 801 - DNA, 327 bp, Zea mays
  Clone ID: LIB3227-011-P1-K1-E7
cgaggacatcgacatgatctaagaaatctgttcctggttacggctacctgtattgttacgtgacgcgttcttctgcttctgcttgcggctacctttattgttacgtgacgtgtactggtatgttgtggtatggtttagcctgggttatcttgtaaaaggatctgaagtggttaaataatcgtgggtaatttcgtttttaatctggtacatgctgatacaaggtgttctgtactaagctattattgttctgaattgagttctcctgtcttgattgatttgccaattagacccagtttttattgagtctaaaaaagaaaaacaaaatgt

SEQ ID NO: 802 - DNA, 412 bp, Zea mays
  Clone ID: LIB3227-011-P1-K1-E8
cgacgcggtcgccatctccggcagcgaggtggaggaggggcatctgggcgtcgtccctggcgaagccgtcgccgtcaactttactctagagctgcaccatatccccgacgagaccgtgagcacggcgaaccacagggaccgggtactgaggctggtcaagggcctgtcgcccagggtgctcacgctggtggagcaggagtccaacaccaacacggcccccttcgcgcagcggttcgcggagacgctggactactacgcggccatcttcgagtccatcgacctggcgctgcccaggggcgacagggagcggatcaacatcgagcagcactgcctggctcgggagatcgtcaacctggtggcctgcgagggcgaggagcgggtggagcggcacgaggtgttcggcaagtggaag

SEQ ID NO: 803 - DNA, 361 bp, Zea mays
  Clone ID: LIB3227-011-P1-K1-E9
cgacgcggtcgccatctccggcagcgaggtggaggaggggcatctggtcgtgggggctggcgaagccgtctccgtcaactttactctagagctgcaccatatccccgacgagaccgtgagcactgcgaaccacatggaccgggtactgaggctggtcaagggcctgtcgcccagggtgctcacgctggtggagcaggagtccaacaccaacacggcccccttcgcgcagcggttcgcggatgacgctggactactactcggacattttcgagtatcatcacctgtcgctgcccaggggcgacagggagcgtgtcaacatctagcagcactgcctggcttgggagatcgtcaacactgttgg

SEQ ID NO: 804 - DNA, 425 bp, Zea mays
  Clone ID: LIB3227-011-P1-K1-F1
aggatacatgcgtacgacaagcctccccatgactgttactcaagagcagctgtaaaagctgtttgagcatgttggagaaatcacaaaagttgttattccacctgcaaaatctgggcatgaaaattggtacggttttgttcattttaaggaacggtccatggttatgaaggctctgaagaacactgagagatatgaacttgatggtcagctgctggattgttcacctgcgaaacctcctgctgataagaaggatgatactggatcatctcctactgcaaaaggacgttcattacccccaagttatgccccacttggatatggactagcgggagcttataatccacttggaaaaggactggcaggtgcttacaatccccctggaaatggactggcaggtgcttatggcgtgctttctgctcgtgccg

SEQ ID NO: 805 - DNA, 304 bp, Zea mays
  Clone ID: LIB3227-011-P1-K1-F12
ggagactgcatgtacatcacttgtagctattattgcagactggttccaagcaaatcagaatattatgcctatccagtcacagtttgacagccttatccgtgaaggatcactagagtggagaaacctttgtgagaacgagacatatagaaagcgttttcctgataagcactttgatcttgaaactgtccttcataccaaaattcacccgctgacagtttcccccagcaatcttttatttgatctgtcttattatgactatggatgagacttttgtgatataattgatgagactatggatttaaat

SEQ ID NO: 806 - DNA, 412 bp, Zea mays
  Clone ID: LIB3227-011-P1-K1-F2
aaaagtcatcattgcctttctatgaggttgacactagaatatttcaaatcatcttcattggattctgatgattctcctggcaggttcagtagtccagaatacaggcacttcgttatactatcaaggaacgttcttgcggcttctgtagcaatcaactcaactgtgagcagttgtaaggagccaggctactttgcttttcatatcctaactgacgctcagaacttctatgccatgaaacactggtttgccaggaattcgtataaaaatgcagctatccgtgtcataaactacgaagcaattattttggagaaacttccaaagtatactatccggcagctgtttttgccagaggagttccgtgttctcattaggagcattaagcggcctactgaaaacacaagaatgaaatacc

SEQ ID NO: 807 - DNA, 310 bp, Zea mays
  Clone ID: LIB3227-011-P1-K1-F3
gggttaaaagggggggaagccactatccatgcgagtggttactgcctaactttcgtggcccgggcacatgctgcatagccgagatgtactatacaggacatgcctggcatatgatcagactgtcatgtgcaggaaccgctcctgcatgaagtggagcgcactccgtcagcatggatgactgaccgttccgtcgtcacgcccaaaagctcaagtaggggtggcagattttataagtggcggtacaacgagcagtcttgagtcctgctgcactcacgcagacagactgtgaggagtggggaacgtagtgact

SEQ ID NO: 808 - DNA, 403 bp, Zea mays
  unsure (1)..(403): unsure at all n locations; Clone ID: LIB3227-011-P1-K1-F4
cttaagaacaggcagagtaagtcctgagagtgtggtttacagttttggcactgtcttgcttgatctcctgagtggaaagcacattccaccaagtcatgcactcgaccttataagagggaagaactttctagtgctgatggattcttgcttggaaggtcatgtatccagctccgatggaactgacttgatgcgattagcatcccgctgcttgcaatatgaagcacgtgaccggccaaatttgaaaacggtggtatccggtctcgaatgtctccagaaagatgtttctactccttcacacactttgctggggatccaacatgataataaaaactcagatcgaatntctttatccgctattgggaaagcttttgccagagcagacctgaatgaggtgcacgaaata

SEQ ID NO: 809 - DNA, 382 bp, Zea mays
  Clone ID: LIB3227-011-P1-K1-F5
aggccctcgtgctcatcacgctaggcggcaacgacttcgtgaacaactactacctggtgcccatgtccgtgcggtcgcgccagtacgcgctcccggactacgtccgcttcatcgtctccgagtacaggaagatcctctcgaggctgtatgagctgggcgcgcggcgcgtgatcgtgacggggacggggccgctggggtgcgtcccggccgagctggcgctgcacagccagaacggcgagtgcgcggcggagctgacgcgcgccgtgaacctcttcaacccgcagatggtggacatggtgcgcggcctcaaccgcgccatcggcgccgacgtcttcgtcaccgccaacacctaccgcatgaacttcgactacctcgcaaaccc

SEQ ID NO: 810 - DNA, 419 bp, Zea mays
  Clone ID: LIB3227-011-P1-K1-F6
acaaggttgttgttcagatagcactggatcttgccagaggattgaactatctacattcaagaaagatagtacatcgggatgtaaaaactgaaaatatgctgctcgatacacagcgaaaccttaagattgctgattttggtgttgctcgtgttgaggctcagaatccaaaggacatgacaggcgcgactgggacacttggctacatggccccagaggtgcttgaaggcaagccatacaacagaaagtgtgatgtctacagttttggcatatgcttatgggaaatatactgctgtgacatgccatatccagacctcagttttgcagacgtctcgtccgccgtcgttcaccagaacctgcggcctgacatccctcgctgctgcccaagcccaatggcgaacatcatgcggaagtgctgggac

SEQ ID NO: 811 - DNA, 405 bp, Zea mays
  Clone ID: LIB3227-011-P1-K1-F7
atttcctgctcacacaccttctattggataccatgaagaggacctctcatgaatcaaatttggaaggaagaattgtcaacgtgtcatcagaggggcacagacttgcatatcgggaaggaatccgttttgacaagatcaacgatgaatcagtgtatagtagcattggtgcatatgggcaatcaaagcttgcaaacatattgcatgctaatgaacttgccaggcgatttgaggaagataatgtcaacataactgcaaattctcttcatcctggttccattatcacgaaccttcttcgctaccacagtatcctagatgttctccatcggacgctgggtaaattggtgctgaaaaatgctgagcagggtgcggcaactacatgctatttggcactccacccgcatgtga

SEQ ID NO: 812 - DNA, 406 bp, Zea mays
  unsure (1)..(406): unsure at all n locations; Clone ID: LIB3227-011-P1-K1-F8
gcggcccgcaagtctgcccctgcgaccggcggagttaagaagccccaccgcttccgccccggtaccgtcgcgctccgggagatccgcaagtaccagaagagcacggagctgctgatccgcaagctgccgttccagcgcctggtgcgggagatcgcgcaggacttcaagaccgacctacgcttncagagctccgctgtctccgcgctgcaggaggcggctgaggcctaccttgtcggtctcttcgaggacaccaacctctgcgccatccacgccaagcgcgtcaccatcatgcccaaggacatccagcttgcccgccgcattcgtggggagaggggctaagcatcgtatattctgtcatcagtgcccgatcagaagatgtagagatgtgctgggttctgtagtttgg

SEQ ID NO: 813 - DNA, 405 bp, Zea mays
  unsure (1)..(405): unsure at all n locations; Clone ID: LIB3227-011-P1-K1-F9
cacataaaagctgctgtagatgctaggaaagagagtggctctgacattgttattgtagcaaggacagattctcgccaagctatttctcatgatgaagcattatggagggtgaaagcatttgctgatgctggagcagatgttctatttattgatgcccttgcttcagtagaagagatgaaagcattttgtgcggttgcaccagaagttccaaagatggcaaacatgttagaaggtggtggtaaaactcccatattgagccctgctgaacttgaggaaattggtttcaggcttgtagtatatcctttatccttagttggggtatcaatgcgtgcaatgcaggatgctctagttgcgataaaagacggcggtgtacctncacctagcgtgctgccatcttttcaggag

SEQ ID NO: 814 - DNA, 361 bp, Zea mays
  Clone ID: LIB3227-011-P1-K1-G1
gcttcggttatgagggctgcactggaatgctgccacaggggctggggaacctccgtggttgacggcgtcgccgcctctggccagtatatcgccacacgaccattccagctcgtgactgggcgtgtctggaagggaaccgctttcggtggcttcaagagccggacccaggtccaatggcttgttgacaagtgccgtaataacgaagaggcggtggacgagtacattacgcacaacatgaacctggctgacatcaacgacgccttccacctgctgcacgaaggtggctgtctgcgttgtgtgctgacactgcagatttgaaattcctaagctaagcaggttatcgctccggaactagaacttc

SEQ ID NO: 815 - DNA, 414 bp, Zea mays
  Clone ID: LIB3227-011-P1-K1-G12
tcgtatatagccccatactgaccgctcggtgttccacgagaccaacactcgcgtcattgtccttgctgagggtcgcctgatgaaccttggctgttctactggccatcctagcttactgatctgctggtcattcactaaccaggggatagcccaacttgaactcaagaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtc

SEQ ID NO: 816 - DNA, 414 bp, Zea mays
  Clone ID: LIB3227-011-P1-K1-G2
cggggcgacagcacccgccggcgggacctcatgttcagcgtcgtgaagccgtccgtgatccagctgcgggggcccaccaaggtcagcgtcttcctcgccagcaacgacgccgagcaggcctgcgacttcaggatcaccggcagctaccacgacggcgcctgcgctgtctccctcggcgactccgacaccgtcatcgccaagatcgaccggcggttcagcgtggtcagcgcgctgctggggaagaactcgtacagcgtcaccgtcaacccggggatcgactacgccttcgtcgtcgcgctcgtcgtcatcctcgacgagatgcattaccagcgatgacacgcacgcttcagttttggttccaagccgcgcgccttcccttctgctgttgcgtggaatcaacgctcgccccgttct

SEQ ID NO: 817 - DNA, 411 bp, Zea mays
  Clone ID: LIB3227-011-P1-K1-G3
attgagaactgtgtttgtttgcatgaggaggatcatgggatcctttggaaacatcaagactggagaactggtttagcagaagtaaggcggtcaaggaggctcactgtttcatttatctgtacagttgcaaactatgagtatggtttttactggcacttctatcaggatgggaaaatagaggcagaagtaaagcttactggaattctcagtttaggggccttgatgcctggggaatcgaggaaatatggcacaactattgcccctggtctgtatgcaccagttcatcagcatttctttgttgcccgtatggacatggctgttgattgcaaacctaatgaagctcataaccaggtggttgaggttaatgttaaagtggaaagtgcaggcacacataatgtgcataataatgct

SEQ ID NO: 818 - DNA, 239 bp, Zea mays
  Clone ID: LIB3227-011-P1-K1-G4
gaacttttggaactgtcaagagctgctgtcgagacttttgactaacatttgttctgtagatagggtaggtcaaggtctcatttgtaactatttatgtgatcattcgtacaatgatgatcagtgtaattcctgacagtcatttttttgttgtagtcgttattgaaatcttacaaaagtgtaggagataatttatcggaaaaaaaaaaaaaaaaaaaaaaaaaaaaaaaaaaaaaataaaa

SEQ ID NO: 819 - DNA, 406 bp, Zea mays
  Clone ID: LIB3227-011-P1-K1-G5
agaagcgccactccttcgtgcacaacgaaggtgttcgagtgggaccagacgctggaggaggtcaacatgtacatcgagctcccgaagggtgtgccaaccaagctatttcactgcagcatccaggctagccacgtcgaggtcggcatccgcggcaacccgccatacctcaaccatgacctgacacacccagtgaagactgactcgtcgttctggacaatagaagacggtgagatgcatataacactgcaaaaaagagagaaggggaaaacatggtcatctccaatacaagggcaagggattttggatccatatgctgcagatcaagagcaaaagcggcttatgctccaaaggtttcaggaagagaaccctgggttcgacttttcacaggctcagttcagtggaacct

SEQ ID NO: 820 - DNA, 406 bp, Zea mays
  Clone ID: LIB3227-011-P1-K1-G8
attgagaactgtgtttgtttgcatgaggaggatcatgggatcctttggaaacatcaagactggagaactggtttagcagaagtaaggcggtcaaggaggctcactgtttcatttatctgtacagttgcaaactatgagtatggtttttactggcacttctatcaggatgggaaaatagaggcagaagtaaagcttactggaattctcagtttaggggccttgatgcctggggaatcgaggaaatatggcacaactattgcccctggtctgtatgcaccagttcatcagcatttctttgttgcccgtatggacatggctgttgattgcaaacctaatgaagctcataaccaggtggttgaggttaatgttaaagtggaaagtgcgagcacacataatgtgcataata

SEQ ID NO: 821 - DNA, 409 bp, Zea mays
  Clone ID: LIB3227-011-P1-K1-G9
gaaggacgatgcggtggtgcagccgcagaccttcccgcccttcgaccgactcggcggcggcgcgtccccggcgtccggtggcctccccggcacctcgtcgggcggcagcagcattccagcgttcagcatgccgggcagcggcagcagcctccccggcgggtcgttcttgcccggcagcagcggcagcatcggcagcatgcccctcttcagcggcggctccccggccttcagcggcttcggcggcatgcccgggtcccccgccgccggctccgtctccgtcgtccccgtgcacggcagcaagccctgaaaatccgtccgtcgccggagcccggaagtctgtcgggccaacttgtgccctagtactcctttgcctgcattgtattggagagttggtatcgcgtttcgtttg

SEQ ID NO: 822 - DNA, 394 bp, Zea mays
  Clone ID: LIB3227-011-P1-K1-H1
gcctcctgcaccggccgctcaataactggggggaccaacccgtcctacggcgggcagcgccggcagcaaggagcccaagttccccaagaagggcgccaagtcccccaagaaggcttagaaagtagggacttcatttgcactgtgtgctgtagcatgctcgtgtctagatctgtggatgggatgtgtcctgctctagtttcgtccttgtgtcttattgtatgttcgtcttcatcgagaagatcttcagcaatcagagctcgttgtgtactaatgctccacatgttctgtttgtcggtctgattctgcaatccgccatattgttgaatttaatggctttgcggaatcactaaaaaaaaaaacaaacagggccggcgctctagaggatccaagctca

SEQ ID NO: 823 - DNA, 322 bp, Zea mays
  Clone ID: LIB3227-011-P1-K1-H10
ggaatcctcgcacccaagcgaccggaaaatcttaggctgatcagggtgatacagatgttgacaggctactaaacacacatgaggaatgccggtgctatgatgattgtgaaggcccgtatgatcaagtaggttggattgaactgacactgccgtcaaatagtcaagctgagatattgtcagagtggctctagtcgaaacatgttagatatgctgaccttacagaggcacttgaagcctggtgttatagatcgaaggttgctaaaagaaagctctctttcttgagcgacattggccaggtatcttgaatacctgaccaattaac

SEQ ID NO: 824 - DNA, 402 bp, Zea mays
  Clone ID: LIB3227-011-P1-K1-H11
caaaatctttggctgatcagggcgatcaggatggtgacggcgaagctgagacaccaaaggaaaacctggacaatgaggtctggcagggcctggagtctgcaattgtttcgattgtgctgacactgccgtcaaatagtcaagctgagattttgtcagagtggcttcagtcgaaacatgttagatatcctgaccttacagaggcacttgaagcctggtgttatagatcgaaggttgctaaaagaaggctctctttcttgagcgacattggccaggtatcttgattcctgaccaattaacaattaaccgaagcggacctgagatatctgaattgaacaagtttgcatgctttttgctggggaaaaatatcaagttctgtgatcaccaacataaattttggaattt

SEQ ID NO: 825 - DNA, 421 bp, Zea mays
  Clone ID: LIB3227-011-P1-K1-H12
gaaatggctacagacaacaagctccttggtgaatttgacctcgtgggcattccacctgccccaagaggcttgcctcagattgaggttacattcgacatcgatgccaatggaattgtgaccgtctcagccaaagataaggctaccgggaaggagcagaacatcaccatacgatcctcgggtgggctgtcagaggctgacatccagaagatggtgcaagaagctgagctgcatgcccagaaggaccaggagcggaaagccctcattgacatcaggaacaatgccgacaccactatctacagcatcgagaagagtcttggagagtacagggacaagatcccggcagaggttgcatctgagatcgaggcagccatcgctgacctccgccaggagatggcctcggatgacattgagaagatcaagg

SEQ ID NO: 826 - DNA, 412 bp, Zea mays
  Clone ID: LIB3227-011-P1-K1-H2
gcgtcctgtactgctacatgatttcagtgccagaccaaatactcagttcgatcacttgtatgcgcagataactgcataaggccgaactcatgcaaaatggtgctatgccagggcgtatctgttggaaatgctcagttgctagcttttcctggtagatcatcaagccttaagagcacccagtttcatgttaaaacgaatcattttcctgcaagagctctacgtgttggtactgattatattcatcatgccatgcctacatcatccccaagggaaaattctgtcaggggaatcccatcactatcaagacagcacaatcagcatccaaggtccgttagttgtcaggcatcctcactggcatctttcagctaccctgagctgacatccaaacccagatggtggtggagaactctag

SEQ ID NO: 827 - DNA, 411 bp, Zea mays
  Clone ID: LIB3227-011-P1-K1-H3
tctgccggtctctctcgccgttgtctcgctctccggcgactggtgggccgccgccgccgccgccccgccaggtgcggaggttttcgttggtccttcgccagcgacgagcacccaccaggcttgttgtatatgtgctgcaatggcgtctctggggcgaagagccgggagctacatctgctcggagctgtgtggcacaactctgaaccagagacgctactccacttcgagggtggattggaagcagctgcggccaatgatccttaagaggattaagaaccggacaaaggaatacccaatcaagagcatgatcccagtcgcggaggaggtggtcagggctagggagattgtcaatgagggcgtctccagactgctcaaggttgttcctgttcagtcatgcaagttttgtcatga

SEQ ID NO: 828 - DNA, 383 bp, Zea mays
  Clone ID: LIB3227-011-P1-K1-H4
ctcgtctataactaactatggctgagacagatattcacaagctcctaaactatgattttgtctgcgggtgctcttctgattttgtaggtccgtctgagcaggtaggttgtctgaacggtcctgagagcttatttgggtttgaagggaagtttctgtcatgtacaattagctgcccgcggtgatggtgggtagttgggtttagtacttgtggttgtgtggagttcgtcatcagatggtaggtttggtatgagctggcggaactgtttgtagagtactgcactaatttccttctggcttatttatgttagggaagcagctttagaagatcattgtgcgcttgtacagaggtcttaactgttaagctgctaagtgttatgcattct

SEQ ID NO: 829 - DNA, 420 bp, Zea mays
  Clone ID: LIB3227-011-P1-K1-H5
caaaatctttggctgatcagggcgatcaggatggtgacggcgaagctgagacaccaaaggaaaacctggacaatgaggtctggcagggcctggagtctgcaattgtttcgattgtgctgacactgccgtcaaatagtcaagctgagattttgtcagagtggcttcagtcgaaacatgttagatatcctgaccttacagaggcacttgaagcctggtgttatagatcgaaggttgctaaaagaaggctctctttcttgagcgacattggccaggtatcttgattcctgaccaattaacaattaaccgaagcggacctgagatatctgaattgaacaagtttgcatgctttctgctggggaaaatcatcaggttctgtgatcaccagcataaatttttgaatttggaggcagtgcagaaaag

SEQ ID NO: 830 - DNA, 331 bp, Zea mays
  Clone ID: LIB3227-011-P1-K1-H6
ggaagtcatcagttttacttgatgcgaagccatgggacgatgagactgacatggccaagcttgaggaagctgttaggagtgtccagatggaagggctgctatggggcgcatccaagcttgtcctactcggatatggtatcaagaagctgcaaatgatgatgaccatagacgacgatcttgtgtgtgccgacactctaattgaggactatgtgtgcgctgagccagttaacgagtacgtacagagctgcgacatcgtagccttcaacaagatctaagcgtgactttcgatcagtccttactcaggggtgctggcgatggtggatgctgataa

SEQ ID NO: 831 - DNA, 391 bp, Zea mays
  Clone ID: LIB3227-011-P1-K1-H7
ctcatctacaggctcgtccgcgactgcgaggccaccatggaggccgtgttcgaggccagcacaggccacgcccgctcgtcggcggggacggccccgtggcctcagccaggcagggcatcttccggaacaccgtggccgcgctggtgaccatgggcgagctccgcagcgggagttccacgtacggtcacttctcgctgcacaccgatggcctccgcggagtccgatcttctgcggcgcgtgtgcgtgcaggtcgacggtcaagtgtacatctgactatgcgagagattttacgctgtgctcttcgacggccagttactactcatgctagattgtcatactataagagacatgtatactttcgcttgctactacaaattcacctatttgtata

SEQ ID NO: 832 - DNA, 410 bp, Zea mays
  Clone ID: LIB3227-011-P1-K1-H8
gcataatcctgtgtggtttctatgacctgctttttgcaaataagggatactacatttttctcttccttcaaggcacggcgttccttgttgttggttttgggtatgtcggcacactacctccttgcactgcataagctgtcatggacaactgatattacctgctcaccagaaactgagcaagcaaagctcctctctcctgcacatatcaaactcttgaattcaatgatagttgagcaatgttcccccatcagtcttggcctgacatgatccaccgccgagaaggttgatcagatatcgccgtcgttctcctgtcagtgttggtcagatttgagccaaaccattctttattgtcagaaggccattcaaatagtgtcaccattgcacattttataataacggtgtttaccgaa

SEQ ID NO: 833 - DNA, 367 bp, Zea mays
  Clone ID: LIB3227-011-P1-K1-H9
gccacgcgtaccgaaacaatagcccgggaggctctgacctattatgagaatccacctcgcaccctgttagcggtgactttcctagagcttagtcgcgccgtcgccgaccacaaaacaacacatcgctctgtcgatctcagccatggcggacgtggagacgaccgatgactcgatgaagctctctatccgctgtaccttcaacgatgtgcatgtgaacgatatgtcgctgaacgactacctggctgtgactgcggggaagcacgcgacattcctgtctcactacgcggggcgctactccaagaagcggttacgcaaggcgcagtgcgccatcgacgagcgcctaaccaactatctcatgatgcacggt

SEQ ID NO: 834 - DNA, 418 bp, Zea mays
  Clone ID: LIB3227-012-P1-K1-A2
cggtctccctagagcttttcttgagcgcagccgcagccgctgcttttcgttcgtcttcatcctacgcgagggcgaaacccacaaaccctctccctcctgtactccggccgacacatccaggggcgatgacgctgggtagctccggcgccggatcgagcgtcgtcgttcctcgaaacttcaggctattagagagctcgagcgtggagagaagggcattggtgatgggacagcgagctatggaatggatgatgctgatgacatctacatgcggtcatggactggtaccatcattggccctcacaatactgtacatgagggtcgcatctaccagctgaagttggtttgtgacaaagactatccggagaagccaccatctggcagattccactcaaggatcaacaggacatgcgtttatcac

SEQ ID NO: 835 - DNA, 225 bp, Zea mays
  Clone ID: LIB3227-012-P1-K1-A5
cgtttccaattccagtatatctttctcttcttccaatcattggtggttgtgctctagctgctgtcacagagctgaactttaatatggttggatttatgggtgccatgatatccaaccttgcatttgatttccgcaacatcttctcgaagaggggcatgaaggggaaagtcgtcagtggcatgaattactagcttgcctgtcaattatagtcctggtcatactgac

SEQ ID NO: 836 - DNA, 310 bp, Zea mays
  Clone ID: LIB3227-012-P1-K1-A6
aagatgcaccacagtctgaggttgagaaggacaaggagggcgcggagaatgaagaagaaaaggaacctgaggataaggagatgactttggaggaatatgaaaaggtactggaggaaaaacgaaaagctttactctcccttaaggctgaggagagaaaagttgaaattgacaaggagctacaggccatgcaacactggcaattaaaaaggatggcgatgaaatgtttatcaagctgggctctgacaaggacttgaaaaaaaaagaaagtgctgaaaggaaaaaacggggcaagaagtccctgagcattaac

SEQ ID NO: 837 - DNA, 163 bp, Zea mays
  Clone ID: LIB3227-012-P1-K1-B1
catctcctgagcactttctcctcgtcccagacaagccaatcgaagccgagatacgaccatggactccaccggcaccggagcagggggtaaggggaagaagggtagcggtcgtcacaaggtcatttggtccaatgagtaattcgttgtttaggtccttgaaggc

SEQ ID NO: 838 - DNA, 167 bp, Zea mays
  Clone ID: LIB3227-012-P1-K1-B12
tcgcccacgcgtgcgcccacgcgttcgagatgatactgaatatcaagatgatacagggtgacctgaatatggtaagtcagaatgcagactactatatgcactggcgtttccagagaagcaagatcttttgatgcctgcatagactgacttccacaggctaactgatt

SEQ ID NO: 839 - DNA, 72 bp, Zea mays
  Clone ID: LIB3227-012-P1-K1-B2
gtttgaatggactaaaaaaaaaaaaaaaatatttatataaaaaaaaaaaaaaaaggatgagagataataaaa

SEQ ID NO: 840 - DNA, 414 bp, Zea mays
  Clone ID: LIB3227-012-P1-K1-B3
catgatagtttctctattacactctctgtttgatttcctggccttcaaaaatgatattcagttctggaacaagaacaagtccatggaaggtctatcggcaaaatctgtggttctgaattttgtgtgtcaactaattgttttcctgtaccttcttgacaatgacacttcatggatgatccttgctagctctgaattggtgtttgcattgagttttggaagatcggaaaggcgatgcatattgaagtcgatagaagtggaaaaattcccatgttgaggttccgagatcgtgaatcatatgcacagaataagaccaaagagtacgatgctattgcaatgaagtacctcacctatgtcctcttcctccttgagaacgggttctctatctattcacttaaagttgaaaagcacaagagc

SEQ ID NO: 841 - DNA, 270 bp, Zea mays
  unsure (1)..(270): unsure at all n locations; Clone ID: LIB3227-012-P1-K1-B4
ttcncgatntgctagctactgctcttgcccagcatgagcaaacggccgttgatgacaacgccggcggtcggagaagacggcgagccatccagcggcgctcgcggagccggtgcgccgccgccgtctcagccggtcggtaccggccgctacgcaagactgcagagcgccggcaccgggaccagtgcctgcgacggcgccgggccagacgtcttgtgacctatttggaaaggcgttttgaagcggcggaccatcccgcaaccgttgatcggt

SEQ ID NO: 842 - DNA, 308 bp, Zea mays
  Clone ID: LIB3227-012-P1-K1-B5
cccagggccacgatgacctcggcaagcgctgcgctaagtactacgaggccggtgcccgctttgccaagtggcgtgctgttctcaagattggccccaacgagccgtcacagcttgccattgacctgaatgctcagggtctggctcgctacgccatcatctgccaggagaacggtctggtgccaattgttgagctgagatccttagtgatggccctcatgacattgatcgctgcgcttacgtcactgagacagtccttgctggctgctacaaggctcttaacgagcaccatgtccttctgggaggtaccc

SEQ ID NO: 843 - DNA, 342 bp, Zea mays
  Clone ID: LIB3227-012-P1-K1-B6
gacgattttgtggctagtcatccagagctgtttgtgattgaaggagacttcattcaccttcgtgatggagcacagcagattatttctgccactacagctgctgcaaaaatagctgctgcgacagcatcttctgcctcttactcatccttactgccttctgttgccgttactcctgtggcacaaaatactcgcaaaagaggaggcccgcagttgattccagatcatcaaatgcaattccctctggaaacggcttcacagatcaatttaacatcattcaaggtgtcagcgacgtaacaatttcaggcaaagtaagaaatatccaagataatggcttcatagatg

SEQ ID NO: 844 - DNA, 307 bp, Zea mays
  Clone ID: LIB3227-012-P1-K1-B7
gaggatgcatctagttacataatgatacttgagatggttacacagggatctgcatatctttccagacaagcgtgtctgctccatattgctaggatcaatgggaaaaaataatctaagctcggcttgggaggatcaagggacgatgcttctatagtcgatgtcgtgatgacaccattaaaaacttattatcttttttatagctctcgatactgtaaaattagataggatttatatctagtctattggagatgctctaacttaggaatccttttgctttcatgcctccttcccatcccagccaaaatgt

SEQ ID NO: 845 - DNA, 383 bp, Zea mays
  Clone ID: LIB3227-012-P1-K1-B8
gtaaggtagtttgctctagttctgcaggaaatgctgtattttattggagtgacatgtctagatgtgcttccagtattgataatttgctgcctgatttcttgtaccctgtaagggtgcgatatttgtgcgaacatgctgctgaaagaactttgtttcttaatggtgattatgcatactgagagctgtaagcttactgctgaacgaactttggttctgaatggtgaatatgcatactgagagctaataatatcctgctctgctatcattgaacgttgcctatgctaggagcttgtcgaaagctagtagacccaacaagaaaaaggccagtattaccaacaaattgcctatggagtatggagactaccattctttcgacgctgggc

SEQ ID NO: 846 - DNA, 298 bp, Zea mays
  Clone ID: LIB3227-012-P1-K1-C1
tgctgacgtgcgtgatgagcatggaagagtgcacggaggcgctgactgaacacgcggacttcctaacagtgattacatccacagcataggaggagctatagaaggagaacaaggagttcttcaacaagttcaagccgtatatctcggacaacagaagcgggagcaccttctagctctagtagcacaggactgatcgagtctatctgctctgtcttaactcgctttaaattagcccgtgatgtgtattacgggtgcttagttatttcaggatgcatcatcactcactgtgtttgattag

SEQ ID NO: 847 - DNA, 126 bp, Zea mays
  Clone ID: LIB3227-012-P1-K1-C2
cgcgtccgaaaaaaaaaaaaaaaaaaaaaaaaataaaaaaaataaaagtctccgaatcgagggggggggggcaaatagtttgtaaactcaaatccgcgtgcttacctattttaaagctttcgaata

SEQ ID NO: 848 - DNA, 418 bp, Zea mays
  Clone ID: LIB3227-012-P1-K1-C3
agctagagcagaggtcttaaaagctggcaatggcaatggttacagcaactgtatgttagagggatttcaagggcaatacaaatatggcgacaattcatttgaagcatctgcttcaccttctggtgctagttattcaaaatgcaaggatgatgcagtgaaagctcttaaggttgatgaagcatgcacccacataagtgttcttttggtggcatttggaatggtggtggtggtgctggacagaataatctctttgtagcatcctttttcttcgatagggctgctgaggctggatttgtgaacgccaatgcacctgttgctaaggttaaaccctcagacttcagacaagctgctgagcgcgcttgctctttgagtgtgaagaacgccgaggctcccttttctggtgccaaaaggataacat

SEQ ID NO: 849 - DNA, 354 bp, Zea mays
  Clone ID: LIB3227-012-P1-K1-C4
gcgggaaggtcgaggcaaaatacacatcaagagccgctgaactgtacaggcagatgcttaccaaggaggtcgctaagagcgccacgaccgataatgccctgccatcctcacctgtcgcatctgaggcttccaagccgccatccgatgacttccctgaattcaaactcccagatgtgccagcaccaccggcaggaatctgaatgggaagcatgagcccaagtcccccagagctgctcctcattcaccaaaggccgctactcatcccacctttgccacttctgtgaagaagcccattggcgcaaagaaggttggaggcaagactggagggcttggtgttcgaaagcttactacaaa

SEQ ID NO: 850 - DNA, 265 bp, Zea mays
  Clone ID: LIB3227-012-P1-K1-C5
gtctagggcgtgcgctcgaagaggttcgctctcctggccgacgacctcacggtcaccgtggcaaacatcgaggaaggcgggcagttcacgatctctggcgctgaggagatcctgaaggcgctttagaagccgcagcaacgatcggtctagtttgaactcgcctttgaataacttgtcgttggacaaggtctattcggtgttgtgtatggaacggtcgtcactgagtcatgcacgatttggtatccgagtgtttatgttcgccggt

SEQ ID NO: 851 - DNA, 235 bp, Zea mays
  Clone ID: LIB3227-012-P1-K1-C6
acggcatcctgaacgtgtctgccgaggacaagacgacggggcagaagaacaagatcacaatcaccaacgacaagggccgtctgtccaaggaggagatcgagaagatggtgcaggacgcggagaagtacaagtcggaggacgaggagcacaagaagaaggtggagtccaagaactcgctggagaactacgcctcaacatgcgcaacacgatcaaggacgagaagatcgcgttcaag

SEQ ID NO: 852 - DNA, 312 bp, Zea mays
  Clone ID: LIB3227-012-P1-K1-C7
aagtgagctagctggctgggttggctcgcccgcctgcatggggcacaatcgcgtgcggtttcaatcccatccgccgacccgatctataatcaatcaaaccgccgccctccggcctggcggctgccgcagtctgactgcggtgtactgttagtctgctgctgatttgcggtgctatactgctggtacagtggcgtgtggattataggtgacacatctatgcgacatataactcagctcatgatggtgctcctgggtctgacatcattttcaccgatgatgttagcttgcaggggttccggaaacacctacaaa

SEQ ID NO: 853 - DNA, 267 bp, Zea mays
  Clone ID: LIB3227-012-P1-K1-C8
agctagagcagatgtcttaaaagctggccaaggcaatggttacagcaactgtaagtgagagggattttaaggacaatacaaatatggcgacaattcatctgaagcatctgcttcaccttctggggctagttattcaaaatgcaaggatgatacaccgaaagctcttaatggtgatgaagcatgctcccacataagtgttctttttgtggcatttgtaatggaggcattggttcttgacaaaataattcttttgtatcatcccttttt

SEQ ID NO: 854 - DNA, 322 bp, Zea mays
  Clone ID: LIB3227-012-P1-K1-D1
ctcagcccagatcagtcagcctcttttttttcttacaaatgctgtcaaagaaaaacgaaagaaatatcatattctttcgatcttttatagacagcatttgtaagataaaaaagaggctgccgttctgggctgatcgatcgcgttggtcagccatgatttactggaccgatacttactggcgtgcctgctttcttttataatgttgtatttcattcattatttgctaaatcccttgtttatttcttcctttaatttaattaatttattcgattatttgatttatttcattacttttgttaatttatttcatttcccttctatt

SEQ ID NO: 855 - DNA, 272 bp, Zea mays
  Clone ID: LIB3227-012-P1-K1-D12
gcatcagctcggtccaagagagatgtggacgccgcggaggaaacagcaagagcgagggacgactgttaggttgacaaccctcgtagcgcaggcaacaagaagctcacgccctgtggttaatttgtgaaacacgctgtgtatcgatactccacatgtaacatgatgctcatgtagacagtaggatgtttaatgtatcattgttgctgtgcttcttctgtaaagatgttgaatgtctcgaatcctgtttgatcaaagtgccatatgttcttccc

SEQ ID NO: 856 - DNA, 385 bp, Zea mays
  Clone ID: LIB3227-012-P1-K1-D2
gaataacagcggaaaactagacatcttattggctcaaggcaaggagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttcgaaggaagagttcagcttttggagattgcccaagtatccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtga

SEQ ID NO: 857 - DNA, 203 bp, Zea mays
  Clone ID: LIB3227-012-P1-K1-D3
ctcaactggacgaacgtgaaataaagagggagaggcgaaaacaatctaacagggagtctgcaaggagatctagattacgcaagcagcaagagtgcgaggagttagcccggaaggtagctgacctaacgaccgataacagcgctcttagagcagaactggacaacctcaagaaggcttgtcaagacatggtagggaaaattcac

SEQ ID NO: 858 - DNA, 339 bp, Zea mays
  Clone ID: LIB3227-012-P1-K1-D4
gcgccgccgccgccgccgccgtgacggaaggaagaggaggagcaaggagcacgacgcgatgggccactccaacgtgtggaactcgcaccctaagaactacggccctggctcccgcgtctgccgggtctgcgcgaaccctcacggtctgatcaggaagtacgggctcatgtgctgcaggcagtgcttccgcagaacgccaaggacattggtttcatcaagtaccggtgaagaggccactgtgctgctgtggagaacttcctacatcaaagaaatggggccttcattagaagggctaatttatgcgctttagctgtttgttcataacttgagactcatgtg

SEQ ID NO: 859 - DNA, 413 bp, Zea mays
  Clone ID: LIB3227-012-P1-K1-D5
gaagactactccctagactgtaatgttggcatagaggatccatctgcagctcacgatgtctcaatttgccgaaacagtaatgatgtgcatggaagcttggttgataacccattggctttagcaggtgacgatccatctttgcaaattttccttccaagtcaaccttctactgttccccttcaggaagaactggtgagcgcgctaatactccaaatggagtccaccctgatgattggaggatatctcttacgcttgcggctggtggagggggtaatgaagaacctacaagtgttgatggcctaaaatcacagccaaaagttccatcaaaagaggcaggagttagaacctttacttgatgctgcttctgctctcccaagcatgaacaatgacagatgtaatggatctaatctaaa

SEQ ID NO: 860 - DNA, 271 bp, Zea mays
  Clone ID: LIB3227-012-P1-K1-D6
gcaagaaggggaggaagaagaagagcaagtaggacaaggacccctccaagcccaagcagcccatgtcggcctacttcgtgtactcgcaggagaggcgtgccacgctggtcgcggagaagaagaatgtacctgagattggcaagatcaccgtggaagaatggaagaacatgacagaaggtcagagggctccctataagaggtcgcgaggaagcataaagaagagttccacaagcagatggaggtgttcatgcagaagaaggctgatgaagct

SEQ ID NO: 861 - DNA, 296 bp, Zea mays
  Clone ID: LIB3227-012-P1-K1-D8
ggaagtcatcagttttacttgatagtgaagccatgggacgatgagactgacatgggcaagcttgaagaagcagataggagtgtccagatggaagggctgttttggggcgcatccaagcttgtcccagtcggatatggtagcaagatgctgcaattcatgatgaccatattcgacgatcttgtctttggcgcactctcattgaggactatctgtgcgctgagccagtcaacgagttcgtccagagcttcgacatttttgccttcaccaagatctaggctggactttttatcaatcct

SEQ ID NO: 862 - DNA, 243 bp, Zea mays
  Clone ID: LIB3227-012-P1-K1-D9
acctatgcgtccgctcactttatataccactccctaggagagacccagcaacacacacagccgagctggaggggaggcaagatgatcaggaagccaggagactgggactgcaaggcgtgccagcacctcaacttcagccgccgagacatatgccagcgctgtagcgagccacgtggagttgctgatcgtggcagtggcggtttgctgataagaggaagaggcgactacgtcagcttcggtggc

SEQ ID NO: 863 - DNA, 327 bp, Zea mays
  Clone ID: LIB3227-012-P1-K1-E1
cgcttcgcgtcacattatatatccaattcctaaggaggaccaagcaccacacacagccgagctgggtttaggcaagatgaacaggaagccaggagactgggactgcagggcgtgccagcacctcaacttcagccgccgagacatatgccagcgctgtagcgagccacgtggagttgctgatcgtggcagtggcggcggcgaagaagaggaggaggcgactacgccagcttcggtggccgcggtggctcctccttcggcggcggctttggcgctgctggctctgacgtccgccctagtgactggtactgctcctgcggcgcgcacaac

SEQ ID NO: 864 - DNA, 287 bp, Zea mays
  Clone ID: LIB3227-012-P1-K1-E12
accgtatctacgccatatagaagaagccggacgatctcccagtgcagctgggaagggcagtcagacagtcccttttggcagcgatgcgacgtggatgtgtatattagtagacatcgatcacgacccttgagatgctagtgggggctggttgactttgtacattccaataagctgggtgtaaaaactgccattcccttgttcgcgaatcggcgggaggcgacggtgttgggctagttactgtttcagatagatttctcatcagattatatagtatggagtatatgatt

SEQ ID NO: 865 - DNA, 390 bp, Zea mays
  Clone ID: LIB3227-012-P1-K1-E2
gggaggaaggggggaccgactcagtccgcctgctgctcccagtaacgttgtgccagcatggtacacgcaaggtggaccggcgtggaagagaacgaggagcagctatggctacggagtggcgatgctccagcagggagatggcgcgcaggccatgccgggcggctttgaccctgagacgaactaccagtaccagctgttgccttacgtcgtcgagagcagccgtcagacggcgcgtcgacgcacgacatggactgccttcaaatgatgcgagctggtgatgttccacaagatggggcgagcaatggtggtggtggtggtggcggcagcgatatctggagcctagacgagctgctcatggccgttggcgcttactggaaaaagctatgtgca

SEQ ID NO: 866 - DNA, 153 bp, Zea mays
  Clone ID: LIB3227-012-P1-K1-E3
ccggaagaggtctagaaacattcaagcacactagattcctattaggaaaagaagaagtgagagatagttctagctctacaagcagactagggcgtaatactgcttagtcttttccctttgcagcgttaattttggagtcagtataaagcttga

SEQ ID NO: 867 - DNA, 378 bp, Zea mays
  unsure (1)..(378): unsure at all n locations; Clone ID: LIB3227-012-P1-K1-E4
gagaagagatggcggcgtcggacgttgagtaccgttgcttcgttggcggcctcgcctgggccaccgacgaccactccctcaacaacgccttcagcacctacagcgaggtcctcgagtcgaagatcatcctggatcgggagacgcagaggtcccgcggcttcggcttcgtcaccttctccacggaggacgcgatcgcagcgccatcgagggcatgaacggcaaggagctcgacggccgcaacatcaccgttaacgaggcccagtcccgcggcggccgtggaggcggcggtggcggatacagtggcgggcgccgtgatggaggcggctacngcggtggcggtggaggctacagcggtggtcgtggaggctacggcggcgg

SEQ ID NO: 868 - DNA, 329 bp, Zea mays
  unsure (1)..(329): unsure at all n locations; Clone ID: LIB3227-012-P1-K1-E5
caggctgctgccaacgcataaatcctctgaatagtagctgagttgagagttttttctagtggctctgcaaggatatagaacaatgttctaagactaccatgtttttaagtctgcctgatgcttataattcatgaacgatttttgcagctagctgtaatgtgactatttatcttatctgcttgttcaaccctgttgcgtgtgtagattctctgtttcatggtcttttcactcgacagaaacagttatttcttaagaacttcaccattatattcacagctgtgaactatgatattggaagtctttggtcatnaaaaaaaaaattatttaat

SEQ ID NO: 869 - DNA, 310 bp, Zea mays
  Clone ID: LIB3227-012-P1-K1-E7
cgataatcagatctgcacattctataacctagccttaggaagctgcagcaaaggagcaagtactgcaaagttccaagagaaaccttgatgaactaactgcattattaaaggctaatgtcgatgccataaataatttcaccagaaagatggatgatctgaaaagaaaaagggatgatctgaaggctcgtaagctattctagagcagactgtacaagatagtgccaaagacttagaacatctgatgaacagcacgaacacttatctagccaaacaagaagagtgcacgaagaacatccgagatttgggcttg

SEQ ID NO: 870 - DNA, 257 bp, Zea mays
  Clone ID: LIB3227-012-P1-K1-F1
aaaaacctccccaagactgttactcaagagcagctgaaaaagctgtttgagcatgtaggagaaatcacaaaagttgttattccacctgcaaaatctgggcatgaaaatcggtacggttttgttcattttaaggaacggtccatggttatgaaggctctgaagaacactgagagatatgaacttgatggtcactgctggattgttcacctgcgaaacctcctgctggtaagaaggatgattctggatcatcttctact

SEQ ID NO: 871 - DNA, 224 bp, Zea mays
  Clone ID: LIB3227-012-P1-K1-F12
cccaggtgctccagctagggaacaagccgtgaatttgaatgaaggactggtggcggataggactcgacgtcaagtgaagcccaaccatttattctgtgggccggactggatagaagtagccaggcccagtggcttgctcgaggtggtattttgtttgtggaatggttttgcggaagggtctgagcatttacttggtggtcgactgtattcggtctttcgtagag

SEQ ID NO: 872 - DNA, 380 bp, Zea mays
  Clone ID: LIB3227-012-P1-K1-F3
cggacgcgtgggcaggtctgagcgctcgtttgccatcggtgattgggtgtacatgaaactccagccctatgtgcagtcatctgtctcgctgcgagctcatcataagctgagttttaagtattttggcccatacaaagtcacagctcgggttggtaaggttgcatatcgtttggacctgcctgtctccagtagatccacccggtggtccacgtatcacaactgaaactggcagcaggttacaaaggccctgctccagcaactctgcctctggatttacctgaattcagtgttcctgttcaaatccttcagacgcgaggacttaccaaaggcaacccgtctcgtacagcaagggccttgagcagtgggtccggcttaccttt

SEQ ID NO: 873 - DNA, 419 bp, Zea mays
  Clone ID: LIB3227-012-P1-K1-F4
ctactccgtcgaggagacctacggtgaggatgaccatgccgacgacgacagggagaagaagaaacccactggcgtccagaagaaagtcaagggggaaaacaagcagcagcagaagaagcagggcaatgtggagatcgtcgagatcgaggacaacactgccggatgcgtcgccatcagaaaggcttttgaaatgaacactgcaagggcaagaggaaggaactttccccacaggatgccgcactgctcatccagatgaactacagggcgcacctggcccatcgctcccaggtgctccgttgccttcgcgacctcgccggcgccaaggccaagctcaaggagatcaggtcctttttttacaacatcacgttccgtcgccgcattggatatgacaatgaagagcttcaaaggtttgttgagaa

SEQ ID NO: 874 - DNA, 196 bp, Zea mays
  unsure (1)..(196): unsure at all n locations; Clone ID: LIB3227-012-P1-K1-F5
cacagcacncgcgcgcagccaancccacgcccgccggcccacacagcccagcgggggcgcgggcccccgcgcgccggcgaggcccgggggcggcagacaaccccgggggcggcccgcacccggcggaacggcagcgggcacgagaacggcggcgggcacgcagagggacagcccgggcgggcgcgagggggggccg

SEQ ID NO: 875 - DNA, 408 bp, Zea mays
  Clone ID: LIB3227-012-P1-K1-F6
acacgccaaaaaagtctccaagatcagcatcaaaattggcgtctactctacgcagcctctcattcaaaagaaaggatgagctcccagaagattgtgaacaacttcaacaacagcaaagtgcagatgatccacatcagacacttgagactgcatatgttgctcatgtttcattaagctgggaggctctgcattgcactatgtgcacctgagtcttattgttgcagcacaacctgataatcctacaacctacagctgtgctgctcaagcattccaacaattccaggtcctgttgcagagattcattgaaaatgagccatttgagcatggtacccgggttgagatatatgcacggtcttgcagcttgttgtcaaagttgcttcaagtccccacttttcaagtcacaagata

SEQ ID NO: 876 - DNA, 126 bp, Zea mays
  unsure (1)..(126): unsure at all n locations; Clone ID: LIB3227-012-P1-K1-F8
gcaacctggagctagcggaggtgagaaggagntnttgccgctgggaatctacatatttttttttgtcgatgcctttcttttaacagtggatataattaaatcatgttacctgtttcaaaataaaaa

SEQ ID NO: 877 - DNA, 240 bp, Zea mays
  Clone ID: LIB3227-012-P1-K1-G1
ctagatgctctgctactgaggaacccgccccatgcaggctctctgatagtattgggtatatttgtttcattgttaaattttgctacatgtgttacttttagagccctctgaacttcgttgtctgtaccatggagcaagtgacgcgtacgagtcgatgaaaatgatttgttagtagtgcattgctgtgtatctgtctggcacgattgatttagggcatggtttggtaacacttttttttaa

SEQ ID NO: 878 - DNA, 423 bp, Zea mays
  Clone ID: LIB3227-012-P1-K1-G4
ctggggctgataggctccagactggaatgaggggtgcctttggcaagcctcaaggcacctgtgctagggtggacattggtcaggtcctcctttctgttcgatgcaaggacaacaatgctgcacatgccagtgaagctctgcgtcgcgccaagttcaagttccctggccgccaaaagattattgagagcagaaagggggcttcaccaagttcagccgtgccgactacctgaagtacaagagtgagggtagaatagttcctgatggtgtcaacgcaaagctgctcgggaaccatggaagacttgagaagcgtgctcctgggaaggctttcctcgaggccgttgcttaagtccaatctacagttggaatgcgaatccagacgttttgggttagcctatcttattttgcttgggcaacatgaatttt

SEQ ID NO: 879 - DNA, 366 bp, Zea mays
  Clone ID: LIB3227-012-P1-K1-G5
agaaaagattgacaaagcaaaagctgaaaccattactgacgatgaactcaatgcactacaaagcaagatggaagaaaaactgcaggaagagaagcagcttcgccaagagttaagagtgttacatgatgagcttgatgacctagaaagccaaagactttctataaaagaaagaaaggatgctgtcaagaagaaaaagaagacacacagaaagcagaacgttcgcttttcatgtgtctgtcggttacaaatattatcccaaatttggaagaccaggataaggtttcaggatatattggtcgccagaacaaggaagaagatagagaagtttgaattcgagaacacgacgccaccagttgagatatgcga

SEQ ID NO: 880 - DNA, 147 bp, Zea mays
  Clone ID: LIB3227-012-P1-K1-G6
gttagccttaagactacgatttgcgttttctccatcttttagtttagtaaaatagtgtgtataatagattacaattcaataacaatagttaaaaaaaaaaaataaaaaaataaaaaaaatgataaattaaagaattatgttatatag

SEQ ID NO: 881 - DNA, 113 bp, Zea mays
  Clone ID: LIB3227-012-P1-K1-G7
cctgattcaagatcggtttcaggacccacaagtatagatacgagaccttactgctactaaaacacaatacctcaaatagacgggcttttcttcgcttgccatgggagcagcct

SEQ ID NO: 882 - DNA, 186 bp, Zea mays
  Clone ID: LIB3227-012-P1-K1-H1
caggacaaggagggcattcccccagaccagcagcggctcatctttgctggaaagcagctagaggacgggcgcacgctggccgactacaacatccagaaagagagcacccttcacttggtgctgcgcctcaagggaggcatgcaaatcttcgtgaagaccctgactggcaagactatcacccttggg

SEQ ID NO: 883 - DNA, 171 bp, Zea mays
  unsure (1)..(171): unsure at all n locations; Clone ID: LIB3227-012-P1-K1-H12
gggccggnacggaagggccgactcgacccacgcgtacggctataacgcgtgcatgcaggcgcgatctgcgggccggcgagcctggtgaacgcgaagatggacctgcaggagggggcgctgatgctgctgggccccacgatgaacgccaaggtggcgttcgagctgtcggag

SEQ ID NO: 884 - DNA, 254 bp, Zea mays
  Clone ID: LIB3227-012-P1-K1-H2
gaaagcaacaagctatctatcgaatcgttgcaattgaagttcgatctcgaagagaagagaagagatcttcgaaaagtaagtttttatgatccgataaagaatcaaacttgtttaaatgttccagctattctctatttccttgaaaagggccgacgagacgcaaaccctaaccgaggtcctgctccaaccccaccaaaccacctgtcgcctgctccttctggtgaaggggacgacgggatcactgcctccggtgc

SEQ ID NO: 885 - DNA, 408 bp, Zea mays
  Clone ID: LIB3227-012-P1-K1-H4
caaaatttataggattcaaataatcaaataaagtaaaggtaggcgggtaataaccttatttatgacaagtttcaaattggtaaagtatacccctaggataaagaagaagaaggggctgagaaaactcgcaagaaaagttccaaccgatcgtctacttaaattcgaacgggttttcaaagcacaaaaacgcatactatgtctgttttcaaagcacaaagagttctagatgagattcgctggcgttactacgaggaaaccggtatgatactgaatctcatgccttatcgagcatcggatcccatcttaaagttggtttattcggcagcagcaaatgctactcattatagggatttcgacaaaacgaaattattcatcactaaagccgaagtcagtaggagtactattatg

SEQ ID NO: 886 - DNA, 267 bp, Zea mays
  Clone ID: LIB3227-012-P1-K1-H6
atccgggagggtctatcgtgtagctctgagaattgacaccattatcagggacctgtaatagcaaagatagtttcttgtatatcgttgctaacctgactggatttattttcagggcactggtaatgcaaatttctacttctccactggtttggcttacacttgccttcagactgagttgctggtagagagtgtgagttcatgattaagcacgacagaaatgtaaagcttcttgttacaagctaatttgggtccttataatcagaatct

SEQ ID NO: 887 - DNA, 235 bp, Zea mays
  Clone ID: LIB3227-012-P1-K1-H7
catgccgctcagctctgcgtgcttgccgaggactgcgaccagcctgattatgtcaagctggtgaaggctctctgcgctgagcacaatgtccacctggttactgtgcctagcgccaaaactcttggagagtgggctgggctttgcaaggacgactctgagggcaaggcgaggaaggttgtaggctgctctgggttggtgtcaaggactactgcgaagaatctgaaggccctaacat

SEQ ID NO: 888 - DNA, 203 bp, Zea mays
  Clone ID: LIB3227-013-P1-K1-A1
ctttttgtcgcatatggggaggagctttagctttaagagattaactggcagcacctcgaacttctttgggtggttagcacggtttgagaccgtcaaatatttgtgtcgcatatcttgttgtccagaaattctttcaacttcagaacggagtaaataattctgtaatcaacaacagcactacagcaataggtagggtttatttc

SEQ ID NO: 889 - DNA, 415 bp, Zea mays
  Clone ID: LIB3227-013-P1-K1-A2
cgcctccccctcttctttcgccccctcctccatccatggtgcgaagaaagtgtaagcatccaagcactttgtcggaggagagggaaagagaggatcaatcaatcaattcgtcctaaatttaaccctcctaaaaaccacttatattactacttttatttatataaatccgtccccatcccaaccatccgccagcccacccgccccgcctgatccgtcccagcgattgctatgagtttaggtgattttaccacagatcttcctctttttttgagtatgtaaataaagtttgaggtccaggctcgtcatgtaaattcgggagcgagtgaaatcgggtacgtaggaattaggagcagagggacaagagggcctggctgcttggcaacagcaacaagaagaaaagggggaaaaaaagaga

SEQ ID NO: 890 - DNA, 374 bp, Zea mays
  Clone ID: LIB3227-013-P1-K1-A3
aaaaaaaaaaaaaaaaaaaaaaaaaaaaaaaaaaaaaaaaaaaaaaaaaaaaataaagggaaagaaaatatttttaatattaaaaaaaaaaaaaaaaaataataaaaaaaataaaaaatttaggggggccctttttaaagaatccaagttttttttcccgtgtttacaaatttatatttttttttttttgcccccaaaattaaatccccgtgccggctttttaaatagtgttgactggaaaaaccttggttttccccaatttaattgcttttacaaaattccctttttccaaattgatgtaatagcaaaagtgcctcatccatattcctttttaaaaaattgctcactctttattgtatatggaaccccccttt

SEQ ID NO: 891 - DNA, 72 bp, Zea mays
  Clone ID: LIB3227-013-P1-K1-A4
gaagctcctagcaagaccgagttctcaactgatgagatactgtctggttttgctggggtttgtggtgctttg

SEQ ID NO: 892 - DNA, 408 bp, Zea mays
  Clone ID: LIB3227-013-P1-K1-A6
atttactggatctaccgatactggaaaaattattctcgagttggctgcaaagagcaaccttaagacagtgacactggagttaggaggcaagtcccctttcatcataatggacgatgctgatgttgaccatgctgttgagcttgcgcactttgccctgttctttaaccagggacaatgctgctgcgctggatctcgcacgtttgtacatgagcgtgtttatgatgagtttgtggagaaggccaaggctcgtgcattgaagcgcgtcgttggtgatccgttcaagaaaggtgttgaacagggcccgcagattgacgacgagcaattcaacaagatcttgcgctacattaagtatggtgttgacggtggaactacccttgtgacgggtggtgataggttgggtgacaaggg

SEQ ID NO: 893 - DNA, 181 bp, Zea mays
  Clone ID: LIB3227-013-P1-K1-A7
gaggataacctagctagcacaataggtacgatataaggctcccagggcaccagagtcattccttttttggtagaccggaggaataacggatcaatcaatcaatcccgtctctaattaacccctccaaaaaccactcataagactaccgttaattatataaatacgatcccatactcaaaca

SEQ ID NO: 894 - DNA, 364 bp, Zea mays
  Clone ID: LIB3227-013-P1-K1-B1
ggcacccgtgttacagaaagataggcaatcaggccctgaggaagcaaggactagtggttggtcatcaatggatcggcgtcgtgccccactaccaattacaagtgtggggacattatctaagcagaaagcaccgatagggaatgatgctactgtttctagagatgctgtgatatctggaccaaattttatgggaaggtcaagtggatcttctaggaggcctgttgtttcgagtagccgtgatatggtggccactgacagttccgagccttcacgagcacgtgcaaccgacgcaagcccaggggcgttccgcagagcctcaagtcctcagagaagctcacctgtccattccgcagaacaaaagcgc

SEQ ID NO: 895 - DNA, 419 bp, Zea mays
  Clone ID: LIB3227-013-P1-K1-B10
accgccagcactcgcccaagccacgtgaatgtatcgtccctcaccctccgccacgtatacgagattgcaaagttgaagcaggctgaccccttctgcaagcacatctctcttgaggcgctgtgcaagtccatcattggcacagccaactctatgggtattgcgattgttaaggatctatgagcagcaatgccagccttttagtcatgaagaaatctgtgacattttgtatgttcctagtttgtagttggtgctggagaggatacaactcatctgtctcacagagcttcctgccactgccatgtcaagagtatgaaactctatgcaatttctgggagagccttcagcgcaacctttttctcttcctttgttcattttgtgacttaactgggactatgtgggtttacgttggggctttaaat

SEQ ID NO: 896 - DNA, 365 bp, Zea mays
  Clone ID: LIB3227-013-P1-K1-B11
ctccctcgagcccgagcaaacaagggtggacgcggagccggcggcggagcggagatggcggagaagaagcgaggcgccggcactcgcaaggatgaggtggtgacacgcgagtacaccatcaacctccacaaacgcctccacggatgcaccttcaagaagaaggcaccaaatgccatcaaggagatcaggaagttcgctcagaaggccatgggtactactgatgtccggattgacgtgaagctcaacaagcacatctggagcagtggtatccgcagtgtgccgaggcgtgtccgtgtcaaaattgcccgcaaccgggacgatgaggaaaacgcgaaagaggaactctactccctggtcacagttgc

SEQ ID NO: 897 - DNA, 419 bp, Zea mays
  Clone ID: LIB3227-013-P1-K1-B12
ctctatcgagccgagaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggaga

SEQ ID NO: 898 - DNA, 261 bp, Zea mays
  Clone ID: LIB3227-013-P1-K1-B2
gtcaagagcgtcgagcgtccgtcctacaatggctggctcggtggcggaacgcaaggagatcagggctctcctgctacaagacgaagagatccacaatgttcttgcttgggctcttctgaagtcgggctgctgctgcataaaacttcactaggcggggaccaacgcccatgccacacagcgccttccatatggcaacaacctctcgcagctacgacctcatgataaacgactggaaaatttcccgcattgaacggcaaaggg

SEQ ID NO: 899 - DNA, 206 bp, Zea mays
  Clone ID: LIB3227-013-P1-K1-B5
agagatccggattcaatttcaagagcatatatcaaaacattttgtaaaaattctagaaaactaaaggtttctagggatcggacttttgaggaggaaatttacctttccgtctgtctttgaaattaaaaggatttcaaccgatgaagactacagttacgcaacgaacttttttattttactacgtgccgttgatcgattggctgcca

SEQ ID NO: 900 - DNA, 85 bp, Zea mays
  Clone ID: LIB3227-013-P1-K1-B7
aaaaaaaaaaaaaaaaaaaaaaaaaaaaaaaaaaaaaaaaaaaaaaaaagagaaaaaaaaaaaaaaaaaaaaaaaaaaaaaaaaa

SEQ ID NO: 901 - DNA, 317 bp, Zea mays
  Clone ID: LIB3227-013-P1-K1-B9
cccacgcgtccgctcgtttttcatccgccttcgcctccaaccgcgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttca

SEQ ID NO: 902 - DNA, 410 bp, Zea mays
  Clone ID: LIB3227-013-P1-K1-C10
cccacgcgtccggccaagacggccgacaagcccggctacatcatccccgtcgagatcaccgtgtttgatgataagagctttaccttcgtcttgaagacccctccggcttcagtcctgctactcaaggctgcaggtgtcgaaaaaggttcaaaagagccacaacggcagaaggtgggaaaggtaacagtggatcaagtgcgtgcaatagctcaagagaagttgccggacttgaactgcaagagcatcgactctgctatgaggatcatcgctggcaccggcgctaacatgggcatcgatggtggatctccaatcccttttaaaaaaggaaaaggccctcttgtagtttgtttttgctggcaccaccaaggcccattttgaggttttttggggaagggcccaaatggtccaaa

SEQ ID NO: 903 - DNA, 414 bp, Zea mays
  Clone ID: LIB3227-013-P1-K1-C3
cccacgcgtccgcccacgcgtccgaggagttcttctccatcgccaaggccagcgagcggctcgtctgccacttctaccgcgacaactggccctgcaaggtcgtggacaagcacctgtcggctctggcaaaacagcacgtggagacacggttcgtgaaggtccacgccgagaaggcccccttcctgacagagaagctcaggatagtcgtcctcccgaccctcgccatagttaagaacgccaaggtcgaggactacgtggtcggcttcgacgagctcggcggcaaggacgacttcagcaccgaggacctggaagagcgcctggcgaggtcccaggtcgtcttcctggacggcgaagggtccgcgcaagcgtcgaaacaagctgccggcgccaccaaacggagcggtcggcagtcgg

SEQ ID NO: 904 - DNA, 193 bp, Zea mays
  unsure (1)..(193): unsure at all n locations; Clone ID: LIB3227-013-P1-K1-C4
agtccagtgcctcatagcagtaggttttagagatgattcaacagtaatatatctagtagacatcctgaagctgcaaanttttactagggaatatcagcgtttcatcttcactttcatgggccatagtcatctgatcatgtgctctcacatggctagagttttggaccgtagttgagatcaaagttcctcacac

SEQ ID NO: 905 - DNA, 216 bp, Zea mays
  Clone ID: LIB3227-013-P1-K1-C7
ggctcactgcctgatgcataaagctgaccttgcccttcataaagccacgagggccctcatgattgctgatgcaatcaaatcttccaacaagaacaagtctcgggattgccgtaagggatttgatgaatgaggaacgcgtgcttttttttgcctttatccgcgagcccctggccgatacacacaacttgaactcggtgctatcgctgatgatgggag

SEQ ID NO: 906 - DNA, 405 bp, Zea mays
  Clone ID: LIB3227-013-P1-K1-C8
gccagcccctcctgtgaagcacaacgcagtacctgttaccgcagtgacaccgagaaaatcatcatctgggtcaccatcatcctggtcacgtgttcagctaccaatcccattgaatcctctgccaataaagaaacatgagtgcaatcggttgcctatccacagttgctctgaagaagacttcttgaaagatgtcatgcagtttctacttcagaggggccacatccgacttgtacctcaaggaggactggcagaatttcctgacgcagtgttaaattcaaagcgtcttgatttatataacttatacaaagaggtggtataccgaggtggcttttatgtaggcaatggcataaattgggaaggtcaaatcttttcaaagatgcacaaccatacagttacaaacaaaat

SEQ ID NO: 907 - DNA, 295 bp, Zea mays
  Clone ID: LIB3227-013-P1-K1-D10
gggcacggacctgctccccgcgacggcgtcggcggcgaagctggaggtgtggctagaggtggagtcgcaccacttctacccgaacgcgtcgccgctggtgttccagctgctcgtgaggccgctcctgggcggcgcccccgacgcggcggtggtggacaagcacgcggagcagctcgccaaggtgctcgacgtgtacgaggcgcacctcgcccgcaacaaggtccttgccggggacgaagtcacgctcgccgacaccaaccacgcgttctacctggtttacctcaacaagaccccc

SEQ ID NO: 908 - DNA, 112 bp, Zea mays
  unsure (1)..(112): unsure at all n locations; Clone ID: LIB3227-013-P1-K1-D2
ntaatataaatattttttaattgaataaattttttttcataaaaaaagaagtttataaaaattaaaataaataattgaaaaatttttgttttttgatagttggttttttcaa

SEQ ID NO: 909 - DNA, 160 bp, Zea mays
  Clone ID: LIB3227-013-P1-K1-D4
cctagccgcaagagaggagcgttcgcctgtcctccccgccctccgtctcccgtcgtctcgccccccgcgcttcgtctgccgccccttttcggagaaatgtttgagcatctctttgaggacacctttcttcttcactaagactcgaccctgttggctatta

SEQ ID NO: 910 - DNA, 425 bp, Zea mays
  Clone ID: LIB3227-013-P1-K1-D5
gagagactccgagaatcagttgatatgcacgacaactttgaccaaataggtcttgcccagaagcttgagaagcatgaattgctggagatgaggaggattgctgcctacatttacaagaaggctggcaggtggaagcaatccattgctctatcaaagaaagataacatgtacaaggattgtatggagacatgctcacaatctggtgaccgtgaactgtcagaggacttgcttgtctatttcatcgagcagggtaagaaagaatgctttgcttcttgcctcttcatttgctacgacctgatccggccggatgttgctcttgagcttgcatggatgaacaacatggtggactttgccttcccgtacctgttgcagttcatccgtgaatacactagcaaggtggacgatttagtggaggacaaaatcga

SEQ ID NO: 911 - DNA, 287 bp, Zea mays
  Clone ID: LIB3227-013-P1-K1-D6
gagagactccgtgaatcagttgatatgcacgacaactttgaccaaataggtcttgcccagaagcttgagaagcatgaattgctggagatgaggaggattgctgcctacatttacaagaaggctggcaggtggaagcaatccattgctctatcaaagaaagataacatgttcattggattgtttggagacatgctctcaatctggtgaccgcgatctgtcagaagacttgcttgtctatttcatcgtgcaggggaagaaagaaagcttggctttttgaccctttcatt

SEQ ID NO: 912 - DNA, 386 bp, Zea mays
  Clone ID: LIB3227-013-P1-K1-D7
gaagagaagtcactgtcacttggtgagatcgatggcccgcgtcgccgccgtcctcgttgctctcctcgccctctttgccgtcgcggccacggcgcaggcccctgccgcgtcgcccaagcgcgccccagcccctgcgccacccaagatggcccctctcccgccgccgccgaccagggcccccatggcctccccgccctcgcctcccacgatgtcgccggcgtccgcctcctccgccgacgctccagccacgagccccgtcggtgcgggatttggcgacgcgatggccccggcgggagcctccgctcttactccggccgccgcgcccgtcacggagaagagcacagccgcatctgccttcgccatcagcttcttcgccatcgccggcg

SEQ ID NO: 913 - DNA, 252 bp, Zea mays
  Clone ID: LIB3227-013-P1-K1-D8
ggcatggcaaggtggtgaagtctttacgcacagagagaggggtttcaaacctaaagaggcaggttggagttatggcactcttgacgttggcttctgccaaatggatgtatctgtggcctggtcgcttctttcgtcgtacggtgaaaatgaagctttgtaagagtcggtgttagccgtggtcgttgcttcgattctctagcatgtaatgataagttcacattgggatatgcttgctgttttgctgtgatgata

SEQ ID NO: 914 - DNA, 417 bp, Zea mays
  Clone ID: LIB3227-013-P1-K1-D9
gaactgtccagaggaagaatagaattctgagttgcatgtggcccttttcctgagctctgtaaagaactacaacatcaacaagagctggcagaactaagatgactgttcccgtcgctccttcatttgtgtgtgctaaccgtgctgacaagaggaaggagttctacacaaaattagaggagaaacataaagctttggaagcagagaaggacgaggctgaggccaggaaaaaggaagagcaagacgttgctttaaaacaactaaggaagtcattggtgattagagcgaaacccatgccaagcttctatcaagaagggcccccaccaaaggctgaactgaagaaggtgcctcctacccgtgccaaatcgccaaagtttacaagctcaaggagaaagagctgcagtgatacaccattgacac

SEQ ID NO: 915 - DNA, 364 bp, Zea mays
  unsure (1)..(364): unsure at all n locations; Clone ID: LIB3227-013-P1-K1-E1
gtgatgcactcggctaccaaatttatagcgggacatagtgatcttatggctggaattcttgcagtgaagggtgagagtttggctaaagaggtagggtttctgcaaaatgctgaaaggtcgggtctggcnccttttgactgctggctttgcttgaggggaatcaaaaccatggctctgcgggtggagaaacaacaggctaatgcccagaagattgctgaattcctggcgtctcacccgagggtcaagcaagtaaactacgctgggcttcctgaccattctgggcgagctttacactattcccaggcaaagggagcgggctctgttctcagttttctcaccagctcactggccctctcaaagcacg

SEQ ID NO: 916 - DNA, 411 bp, Zea mays
  Clone ID: LIB3227-013-P1-K1-E10
gttcggagcgggcagcagcacacagccccatcccaatcctagtcgatcttcttcccctcctcaagccggttccttcgtccacacgaccgcgcgctcggaaaactccgcggagggcgaaggaagcgaaccaagggcgacgtatccgccgccggagaaggtagccctcgatccgccgtctcccacgattcgtttgtcttgcgacagctgggcgaccgtcgtcgccgccgcccttcttcaggtgcccaggtcttcgccggtccctttggcgccgacgagcaccaaccaggaagaaaagaagctgtaccatggggaagagaaaggcagctggtaagccaccttctaagaagcggatggacaagcttgacactggttttttctgcccattctgcaaccaccggagtagtggtgagt

SEQ ID NO: 917 - DNA, 283 bp, Zea mays
  Clone ID: LIB3227-013-P1-K1-E11
ctgacaatagcaatccagtttttttttttgaaattgcatcctctcctacctcttttttgcttttggtatgtaggatctatatctacttccgcgtgatattttggcaccggaggctctaaacgggtgcaaatttggtcggtgacaagtagcgaggagatagatgttgtgccgccagtttcttcttactttggcacagacccctcagcgggattttgttggacagagtgaccccccttcaccaggaaagatatccatatttgggggagtttccctattgctgttt

SEQ ID NO: 918 - DNA, 415 bp, Zea mays
  Clone ID: LIB3227-013-P1-K1-E2
caaaagttctatgccttgagaaaaccaaagactaatattcagattctacagcagagtgttaggggtaaatacaagtacacgataaatttccttaaggaacatgctaaggagatatatgcagaagttcgtacggcgtatattgacaccatgaataaggtgctaagtgcacatttccgggcttacatacaagcattggagaaactacagatggacatagcaacttccactgatttgcttggtgttgaaaccagaagcacaagcttcattttctccattggaaaagaacctctgaaaacccgtccttcagtgtttgctctgggtgaacgaataaacattttgaaagaaatcgaccagccagcattgataccttatatagctgaagcgaagtcacagaaatactcgtatgaagttcttt

SEQ ID NO: 919 - DNA, 172 bp, Zea mays
  Clone ID: LIB3227-013-P1-K1-E5
tgcctatgctagtgcctgccgtccaccatctccgaaacctcacaagaactgtcatgggtcttttaagtggatctgtacgggttcagaaaaactaccatcgccatggagtgggtggggaagcacgccctgatgatatacgtgctggtgggcgtgcaacatccttcccatgttc

SEQ ID NO: 920 - DNA, 381 bp, Zea mays
  Clone ID: LIB3227-013-P1-K1-E6
acctgccgagcgagaagagtcagaagcatggggcgctgtcatcgcagtccgagctcgatcaaaaggtctaaacgagacacacaaaggcatccgatgcttgttgagcaccggtcgacctggctttatttttagtacttatttttgagggatgagatgtttctataggattgtaggtggggccatagcagaaagagggtgcctgggtaaaatgcccatgagtttacttttgcagtgagtatgtcaatctaagctggcagatacttgatttagaatagtctttgtgtgtgtttcgctcttcatgtggcatgggcagcttgatctataggtgtatctttcactttcacactgaaattgaaaagttaagcgcaaattttcttgtat

SEQ ID NO: 921 - DNA, 376 bp, Zea mays
  Clone ID: LIB3227-013-P1-K1-E7
catttcgaaccggtggccatactggaacaggacagagggagcagaccacttctttgtcgtgccacatgacttcggcgcatgcttccactaccaggaagagaaggccatcgaacgaggcgtcctcccagtgcttcgccgtgctacactggtccagacttttgggcagaaggatcatgtctgcctgaaggaaggctccataaccatcccgccatatgctcctcctcagaagatgaaaacccacctcgttcccccagggacccctaggtcgatctttgagtatttccgcggtttattctacgacactgcaaatgatcccgagggaggttactatgcaaggggcacccccacgccactttgggagaactttaagaacaac

SEQ ID NO: 922 - DNA, 378 bp, Zea mays
  Clone ID: LIB3227-013-P1-K1-E9
ggctgacaacagtcatgtcctatttataactgtgatggaaggagacattaaagtttaagttgacctagttacaaattgaattaggcaacaagcttaaggtctgacaatgcctgaacaatattgatttttaggcgattatggaaaaatagtgtcttggaatactacctcatggacgagaaccggatcaaagaaaataactcgtgaggcaatttcagcttttgctgtgtcacccaacggtgctcttcttgcaattggaacaatagaaggaagcatcatcgtagttggctcaaaagacatgcggacacttgttacagttaaaaaggctcatcttggtattgttactacactgaccttctttcaggattcaagaacattgct

SEQ ID NO: 923 - DNA, 364 bp, Zea mays
  Clone ID: LIB3227-013-P1-K1-F1
cctagctctagtggtgctaggaattaaactagaacttaagtcaatcgtagcacattatagttcagacgacgcatcgctacacacacttgcaaaaaggtaaaaggcgtccacgaccacaaacacaagctgatctcagaacgggatgagtgagagcaagacgagtcactacttcttaggcgacttggcggcggccttcttgggggacttggggccagcggcagcggccttctcggctcttactctgttcttatcgacttctctgctctgttactgaagagttccgaatggctaactcagacagacagtgctggcaatgtgttcggggttcgaccgtaaacagaacaagatcagaaaaatagaagtt

SEQ ID NO: 924 - DNA, 283 bp, Zea mays
  Clone ID: LIB3227-013-P1-K1-F10
gtatatgatgtcgattgctccagaaaatgcgccctcgaaacctgagtatttggagattggtatcattgctggtgttcctgtttcaatcaatggccgagacctctcaccagcatccctcctcgcggagctcaatgaaatcggtggaaagcatgggattgggcgtatcgacatggtggaaaacaggctggtcggcatgaagtcacgtggggtctatgagacccccggtggcaccatcatggcagccgcggtacgcgagttggagtccctgaccctggacagggag

SEQ ID NO: 925 - DNA, 296 bp, Zea mays
  Clone ID: LIB3227-013-P1-K1-F11
caaggcgaagagtggtcacccaagagatgtttttgttgttatatccgagaaagaatgaggtttatcagatcacagttgacacaaaagcaagctcctgaccagtgaccacacctaatgaagaacaggcagctgcgccgcagcacacacacacacaccgaccagcgcagagagctatttgattcatatgcgcatttggctgattcagatgcgcatttggcagaaggcaatcgctgagcgcgaaggagttaaagcatgatcagatattcagatcttggatcatgctaaactgacacctt

SEQ ID NO: 926 - DNA, 298 bp, Zea mays
  Clone ID: LIB3227-013-P1-K1-F2
agcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaagtggaggagccagctgccccggcggagaccgagccagct

SEQ ID NO: 927 - DNA, 333 bp, Zea mays
  Clone ID: LIB3227-013-P1-K1-F3
ggctgaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaagggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactc

SEQ ID NO: 928 - DNA, 279 bp, Zea mays
  Clone ID: LIB3227-013-P1-K1-F4
agtagagagaaggaaaaatatccccaaaccctagcttccgatctcgatggcgaaccctcgcgtcttcttcgacatgaccgtcggcggcgccccggcgggccggatcgcgatggagctggacgccaacgaggtgcccaagaccgcggagaacttacgcgcgctgtgcacggtcgagaagggcgtgggcatgtccgggaagccgctccactacaagggcttcatctttcaccgcgtgatcctgcgattcatgtgccagggcggcgactttacccgttgtaa

SEQ ID NO: 929 - DNA, 309 bp, Zea mays
  Clone ID: LIB3227-013-P1-K1-F7
gctggatcgtgatgatgataagatcaccggggatgccgtagcaggcacactgggttatgtcgctccagaaaaacttatggaagcttatgcatcaatgatgtctgatgtgttctcttttggaatcatcatcattgagatcattaccggcaggagagcttcacctttcgttgatttaccggaatggggttcagttgatgagatgattacatcagcgaaagggttatttgatccggcgctagctgacgagtttcaggtgatggaaactaattggtgcaggagagaccggaccaaagtgcattgagcgggatc

SEQ ID NO: 930 - DNA, 267 bp, Zea mays
  Clone ID: LIB3227-013-P1-K1-F8
gatgaaagtgccatgaacgaaggcacacccccagccaaagcacagctgtcttgccccgagggtaaaagtatatcttccgtgaagtttgcgagcttgggaaaccccagtggaacctgtggatcataccaaatggggcgctgccaccacccgaactccttatctgttgttgagaagagcctgtctgaacaccaacagctgtacagtctccctgacagacgagagctttgggaaggatttatgccctggagtcaccaaaacactcgccat

SEQ ID NO: 931 - DNA, 417 bp, Zea mays
  Clone ID: LIB3227-013-P1-K1-F9
ggagagtctcgattctgccctcgaagcgcctccgcaacaaggtggctggcttcagtacccacctgatgcgccgcatccagcgcggcccagtccgcggcatctcgctcaagctgcaagaggaggagcgcgagcgccgcatggacttcgtgccggagaagtccgcgctcgaggtcgaagagatccgcgtcgacaaggagaccatggagatgctcgctgccctcggcatggccgacctgcccggcgttgagcgccaggctgaggtcttcaacacccccgcctacgggcgcccgcagtacggtggtccccgccgtgaccgcgtttagacttcgcggtggttgcctcttgatcgcactgctattcgtagttgttgtcctactatgctaaacttcttttagatttttgggtgcatctggggcg

SEQ ID NO: 932 - DNA, 281 bp, Zea mays
  Clone ID: LIB3227-013-P1-K1-G1
ctgtcctgctcgacaatgaggccatctatgacatctgccgccgctcccttgacattgagcgcccaacctacaccaacctcaacaggcttgtgtcccaagtcatctcatccctgactgcttccctgaggttcgatggtgctctgaacgttgatgtgaacgagttccagaccaacctggtgccctaccctaggatccacttcatgctttcgtcctacgctccagtcatttctgctgagaaggcctaccacgagcagctgtccgtggccgaaatcaccaacagc

SEQ ID NO: 933 - DNA, 191 bp, Zea mays
  Clone ID: LIB3227-013-P1-K1-G10
gcagaaacgagagggccggagcaggcgcagccccgacgatcccaccgacggtgggcctcatacttcctcgtaactgtcttcgtttttttatccaacaatctacatgagccgcgtggactgcgcggggggcgggacaagctctctaagttacctctttgagagcggtgagccccccaaaccagcaggggcac

SEQ ID NO: 934 - DNA, 306 bp, Zea mays
  Clone ID: LIB3227-013-P1-K1-G3
taaaaaaaaataaataaaaaaaaaaaaaaaaaaaaaaaaaaaaaaaaataaaaaaaaaaattaaaataaataaataattaaattaattacctaaatgaataaataatataattaaaaaataatttaggggggggcctttttaaagattcaaattttatttcccttttttttcaaggatattttttttttttggggtccctaaaattaaattattgggccgtttttttaaaacctttgcctgggaaatccccgtgttttcccaatttttattgttttgtaaaaatttcctttttttaaaattttttt

SEQ ID NO: 935 - DNA, 350 bp, Zea mays
  Clone ID: LIB3227-013-P1-K1-G4
aagaaacctgacacggctttgctcccatttcctacatacttcacgcgtgaaggtgagcctgaagacttggagcccctgattgctgatcttggtgatgttgacccattcatggcagccgattaagacaatgcacaaagttggttaattcctttttgtgttctaagcactccttgagctcgtccattccacgagattgtcaaactctcgatggatgtgagcaattcctgaatcacatgctatatccggttactggccagcctgatcaatgttgttccatgtacattacctggcaaagttaccagtgctataatggtctttatatgattagtttgattgaccgaatataacct

SEQ ID NO: 936 - DNA, 415 bp, Zea mays
  Clone ID: LIB3227-013-P1-K1-G5
ccctgactgaagctgaccaagcggacgcgggtatgcttccgggacgccttcttcaggctggccgagagttcgagtgccaagtgcggcgctgcgaacgggacgccgctttcctctgcaactgcaactgaacgggagacgaacgccatcgacaggacggtggcggacctcaccatgcgccccgctgtcctcgcgagccgctgccccgccgacggcgactcaagggcggaggcgcactccgcaaccaccgaccggcacgacgacggcgtagaaagggcaccgcgcgactgatccgtcttttttttgccggctactgctacgattcgttcggccatgttgggcgcagagagagagagagatgtacatatatatgatgaagagaaccggctgtcggttatgcatttctacggaacttcga

SEQ ID NO: 937 - DNA, 183 bp, Zea mays
  Clone ID: LIB3227-013-P1-K1-G7
ctctggtttctcatcgagaatagctctttctctttcgtcaagggtttcaccaatggcttgtaacaactggatgtaaaacattttttagttttttaatcgatgtagtgtgtttttgcattacagtccattgtggctatggcggctgctcatgtcgggtgtagtccatccgggtgtaatagtctc

SEQ ID NO: 938 - DNA, 331 bp, Zea mays
  Clone ID: LIB3227-013-P1-K1-G9
gcggcagcggcggcggcggcattgccgagatttccgtgattcttgcgcttgttagttgtgctgtgtatagttgggccggccgggggtggttccgttcagttccttatctgttggagtagtcgtcggcggcgatgggtatcctcgcgctcatcaccggcaaggcgggcgccagcgggttcgggtcggcgtccacggcggagcaggtcaccgacggcgctgacgccagccgcctcaccgtcgctatcacaggaggagctagtggcattggtctggagacatcaagagtcttcgccctgagaggagcccatgtggtcatcgctgctagaaacac

SEQ ID NO: 939 - DNA, 81 bp, Zea mays
  Clone ID: LIB3227-013-P1-K1-H1
aaaaaaaaaaaaaaaaaaaaaaaaaaaaaaaaaaaaaaaaaaaaaaaaaaaaaaaaaaaaaagaaaaaaaaaaaaaaaaaa

SEQ ID NO: 940 - DNA, 376 bp, Zea mays
  Clone ID: LIB3227-013-P1-K1-H10
ggctgtaccaacctcatgaagagcaatgaagaccaaagagtagagcagaaaggggtgtctcttagatgtgtcatcatgtaatctatgtgcgttgcaatgtacagcattattgaattgagcagcgagatgccgaggtgagagaccctctcaagaaatcatgtggttcgccttaatgttaatggtgccaccatcgcaataaaagcgtcgatgattgttaaaaaaaaaaaaataatataacaaaaaattaaaaatttatgattctgaaataagcaaattctttattagtcattatgttattgagaaattaataaatgggggggccgctctaaagaatccaagcttacttacccttgcttgcaacttaataacttttttt

SEQ ID NO: 941 - DNA, 377 bp, Zea mays
  Clone ID: LIB3227-014-P1-K1-A11
gtagattcaaggacagtcatggctattctggggccagctgatatggttgatgatgttactggcggtctgaagcttttgtagaaaaccaccttgtcagcattttcaacttgggtcttcatagagcagtgctgggactttgcaggccacagtggtctctgcacttgtactgatgtgcggcagaagaatgaaccttggccccgttggttgacctgagtttcttgtccatgaatttatttggaaggagagcttgcattcttttttcacttgtaccgaccgttatctttggagttgtgatgttagcagtttcgaattctggtgttgacaacttatagaccatcattttttctgtaacatagataagaaaatactatttgact

SEQ ID NO: 942 - DNA, 415 bp, Zea mays
  Clone ID: LIB3227-014-P1-K1-A12
cccttcactcttaaaaagctgtaggttagctagatatcgtggtgaacttcgggctacatcttcaaaggctgctactgatgaagtgatgcttgcaaaaacaactcaacaaactgcagaccaagaagtgggtgctacaatttcagcaacccgtataacaacacaatatcagcaggaacagctgactgtcagccatgaaacgctgactacactttcagcaggaactccaccacgcatgaaaggatggctagttaaaaaatcacccccaagaagaagaaagtgtgaagtatttgtgttatgtgtgtgaactgaaatctgggaactatgtatctgtggtttgtgtctgtgtactgaaatctgggaactgaaactatgtatgtgtggtttctgtgtgtgaactggaactgagtcacagaac

SEQ ID NO: 943 - DNA, 347 bp, Zea mays
  Clone ID: LIB3227-014-P1-K1-A2
gcctccgatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccaggacacccaaggtcttatttt

SEQ ID NO: 944 - DNA, 294 bp, Zea mays
  Clone ID: LIB3227-014-P1-K1-A4
gctgattacaacaaaataagcatgtcttacgaaactcaaagtgttgccgagggtatacctgtttcccgtagccatctcccccttgaaaaactttaggagatggtaataatttgtcagcatgattgaccatggctacttacgcagagaattgacaccactcaacaaatttagttaccgaactctcgatcctgtgttacagcaaatcctatggttatgtggaactctggtgctgtaattctcttgtatgctacccagtatgccgcaggaaatcataattcggtgttccattgcagc

SEQ ID NO: 945 - DNA, 421 bp, Zea mays
  Clone ID: LIB3227-014-P1-K1-A5
ccagaactcttccagttctattgatcctcttattcaggcgaacactggatccaatgctagttcatcactgtcttttatgagagggatcctgccgaagtatttcagttcagagtggtcatttgctcagttccatttaccagaagtcactcgttacatagtagcctttggtgcccagaatactgtgatgatggttggcctggatggcagcttctacaggtgcagctttgaccaagcgaatggagggcagatgttgcagagggaacatttccggtttctcaagtccgacagcccacctttcaggactgcagccgcttgacctgcagcacaaggatcatccatcccaccatgtaaatgtcgaaggtccactgtacatatcgccttcttcgcggcgaagttataggcagccggaataaggagagct

SEQ ID NO: 946 - DNA, 207 bp, Zea mays
  Clone ID: LIB3227-014-P1-K1-A7
ccggaacggcatggccggcccgccccacccgtctccgatccccaattactacttcggatcttgcattcagcgcagcgcaagtgtgagagggaggggtacacggtggaagatagagctcgcgttcggtaagctcttcatacggttcttttccaaaaaggagatgcggatccttatggtcggcctctacaccttctgttaaactcacct

SEQ ID NO: 947 - DNA, 146 bp, Zea mays
  Clone ID: LIB3227-014-P1-K1-A8
cgcgcgtaaccaaccagaaactttaggatgattacatacagatcctgacggaggggtatatatactgtttgatccgtggagctgtgctgatcacttgcttacttagccagtatttctttcattcaaggctttacaaagaactatgg

SEQ ID NO: 948 - DNA, 109 bp, Zea mays
  Clone ID: LIB3227-014-P1-K1-B1
aattaaataaaatttattataaaatttaaaaaataaaaaaaaaaaaaaaaaaaaaataaaaaaaaataaataaaattataagtaaaaaaataaagtttataaaaattaa

SEQ ID NO: 949 - DNA, 400 bp, Zea mays
  Clone ID: LIB3227-014-P1-K1-B10
tactgaactggtttataatgtgacgtcaatttactaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcgccctttttaaagaatcaaagtttacttacccgtgcatgcaaagttataattttttttttgtgcaacctaaattaaattaactgcccgccttttaaaaactttttaattggaaaaaccatggcgttaccaaatttaattgcttttaaaaaaaacccctttttgcaagcttgtttaaaaacaaaaaggccccaactattcgctttttcaaaaattttgtaacctttattggcaattggaacccc

SEQ ID NO: 950 - DNA, 377 bp, Zea mays
  Clone ID: LIB3227-014-P1-K1-B11
gtgcagagaggaaggatgctgtggagagcaccatgaatgcctacaaagctgctgaggatattgctcttgctgatctgtctccaacccaccccatcaggctcgggcttgctctcaacttctcagtgttctactacgagatcctcaactcccctgaccgtgcttgcaaccttgcaaagcaggcctctgatgaggcaatctccgagctagacagcctgggagaggagtcctacaaggacagcactctgatcatgcagctcctgcgtgacaacttgaccttatggactttcgacaccaacgaggacggcgtggatgagatcaaggaagcagctgttgcccctaaagaatcctcccccgagggccagtaagacggttcctat

SEQ ID NO: 951 - DNA, 83 bp, Zea mays
  Clone ID: LIB3227-014-P1-K1-B12
gctagcaaaatatacaatatctctaagcttacaaaccaaattatcacggggggggggtatcttaaagaaacaactactatcaa

SEQ ID NO: 952 - DNA, 243 bp, Zea mays
  Clone ID: LIB3227-014-P1-K1-B3
aacgggacaggcctttgaagactgtgatatgtgaatgaattcttgtacagagtgggggagttaaattcagtgttaatgatgattgaataactgaacaaaactggtatcctggtattgttaggattctttttgattaattttatagtgaggagacttgcacagtctttttaatgggtgagagaccaaataccataagtttaattgacagacgcttattaaattgagcttatgttgtatgagttg

SEQ ID NO: 953 - DNA, 338 bp, Zea mays
  Clone ID: LIB3227-014-P1-K1-B4
gttggcttctcctccccctccggttcgggttcgggttcgtgaggttctccggggggcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatctagggcatgaacggcaaggagctggacggacgtaacatcaccgtcaacgaggcccagtc

SEQ ID NO: 954 - DNA, 421 bp, Zea mays
  Clone ID: LIB3227-014-P1-K1-B6
gaagaaagcaaaaccgtatagttcgtgcattcatttagtgtggaattggtgctatgaattttggggaaggaattccgagaaattagtggacggtgatgatgatgttcgtgcgatactcgtcagacgctcgaccaaaaagcctaattcgggagtggctactccgtctttttcgtcatgtgggaatcgtcgtgctgacacgtcaataccgtcgatcgtcatcccctgttcgatctcgtcgtcaagcttcgcctcagccctagtcgtcgtctttcacccagcagctcgtcatgagacctcacccagcagctcgtcatgagacctggtgtcgagctcctttcctaacaaatgccgaacctatccctgctcctgcgttcgccaacagtcttaactcgtcaatcacgctcgccagatgttcaattga

SEQ ID NO: 955 - DNA, 430 bp, Zea mays
  Clone ID: LIB3227-014-P1-K1-B7
ctgacgagcgtgcttcattgtatgatgctgccaatacatggatcgacgcactgaacggaagagatttcctgggtggctccaagcctaacttggcagatcttgccgtcttcggtgttctgagacctatccggtacttgagagcaggaaaagatatggttgagaacactgaaatcggcgattggtaccgacgcatggaagacgcagttggagaaccatcaagaatacaggatgcagaagcaaactagaattttgacaacattcttttaaatactttagcggtatccgtgcctatgcatggaggctattcaattttttttgccagaatcaagtgtatgcaataatgctctgccagattattaagcataatagccccttggaacagtgtttttttttgtcttgggaacttggttgtgttgctgtgtaaggtttg

SEQ ID NO: 956 - DNA, 234 bp, Zea mays
  Clone ID: LIB3227-014-P1-K1-B8
gttacgctatgtttgaagtggctcaactctggattagctaacatgtctaggcagggagttaatataggaacaagattatcatagtgaactaccatcaaatcatctttgtggcgtaataaacggctcttacattattagaaacatatctggcaatgtttcaatgtttatttttattacggtgaaaacctcttgcatgctatggatgaggggttttcttgtaagtctctcatgagc

SEQ ID NO: 957 - DNA, 357 bp, Zea mays
  Clone ID: LIB3227-014-P1-K1-B9
acatcttcaaggtgctcaagcaggtgcacccggtcattggcatctcgtccaaggggatgttcatcatgaactccttcatcaacgacatctacgataagctcgccgtctaggccgccaagctcgcccgctacaacatgaagcccaccatcacctcccggtagattccagacctcggtgcgcctcgtcctccccggtgagctcgccaagcacgccgtatcctaagggaccaaggcggttaccaagattacatcctcttagggtgccgtctcacgttgttactttcctgtctaattcttatatataggctcttacttgggtgtcttcttcaactaatgtataaatttgattataattgct

SEQ ID NO: 958 - DNA, 304 bp, Zea mays
  Clone ID: LIB3227-014-P1-K1-C1
gggacgacgacgtggtattcaagaatcaagcacgaggagagaccaagacaccggaacggttcatcaacgacaccatcaggagtgatttccaccgtaaatttcttcagaggtacatgaagtgacgcttccgtcgttcacaattcagcctggagcccctcatcgttatcatgtttgtgtatgagcgaaagatcattattgtgttgttgtatgaaacaagagtgtaaacatatgtctactacttaacaaagttatgctgagcaatgcatatcctagttgaatgtgacaatgctatgttgtctatatt

SEQ ID NO: 959 - DNA, 405 bp, Zea mays
  Clone ID: LIB3227-014-P1-K1-C10
acatcttcaaggtgctcaagcaggtgcacccggacattggcatctcgtccaagggcatgtccatcatgaactccttcatcaacgacatcttcgagaagctcgccgccgaggccgccaagctcgcccgctacaacaagaagcccaccatcacctcccgggagatccagacctcggtgcgcctcgtcctccccggcgagctcgccaagcacgccgtatccgaagggaccaaggcggttaccaagtttacatcctcttagggtgccgccgcacgttgctacgatcctgtttaattctcatatttaggcctgtgctaggttgcttctgcaacaatgtagaatttgttataattgctgaatgaatcagttacccctgttgaagtttctaatatattgtaatcttgctagt

SEQ ID NO: 960 - DNA, 71 bp, Zea mays
  unsure (1)..(71): unsure at all n locations; Clone ID: LIB3227-014-P1-K1-C11
naaaaaaaaaaaaaaaaaaaaaaaaaaaaaaaaaaaaaaaaaaaaaaaaaaaaaagggagaaaaaaaaaaa

SEQ ID NO: 961 - DNA, 409 bp, Zea mays
  Clone ID: LIB3227-014-P1-K1-C2
acgctgttgaatcgacaggtacagcagacaaatacagaaaagggctggcctggttaaaaaacggctcaggttagcaagcagcctggcctgcttcacgtttgagagaaggtggcttcgaacgagacctgatcgtttccttcgtcctggggcctgggcgacttgctcaatgggagttgacaggacagatcacggccagccagtcaggtcgctgtgacgagctgtacaagaggcgatgatgcggctcaggcagatttatatcggaggagatgaatcgcgttggctcttcactcggtcctgtttcttaactgatgtaaattttagcttgtttttaactagaggaacgatgtaagtttaaccagacgaataaaacaactgtgtatgctctgcttccaatccagttattagctgc

SEQ ID NO: 962 - DNA, 400 bp, Zea mays
  Clone ID: LIB3227-014-P1-K1-C3
actgtctgtgcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaggcttggacgtggacaacctttatgtttcacaca

SEQ ID NO: 963 - DNA, 424 bp, Zea mays
  Clone ID: LIB3227-014-P1-K1-C4
ggcgactcgcaggttgatttggaatcaaacaggggcgacgcaggtgttgacagcaacggcctgctcccaactaagcagagcagtggcaggacatcgccaactaaacagcaccagcagcataagaagaagctttctctgaagagattcggtggtctgctgaagaagaaaagcgaaaattagcataagaaccatctgatcatattctttgttctatcctttgtggcatatttctttggcgagccatctatttcccaagtcttcacatatgttatggaaagcaaatgatggatgcttcaaagaagaatacagaatgtcgagtgtatttacataattgcgtatgctgagttcgtgtcttacatttttgtatgcgagctcttgtaattgttcattctatgcttttgttaatgttattgtctgtgaagta

SEQ ID NO: 964 - DNA, 243 bp, Zea mays
  Clone ID: LIB3227-014-P1-K1-C5
gcgaagtttggtatagtaattatgaatagtttccataagggaggagatggtggggccttcttcatagccaacccacccaataggggggtgggtgggtggttcgcttgcgtcttcttccattctactagcttcataaaaggtggactgatggaagagcaaagttgtcaatctcagtaaaatcagtgtgcatatgtcgtggttccttttctgaccatatataatatatatatgtaatggtaataa

SEQ ID NO: 965 - DNA, 422 bp, Zea mays
  Clone ID: LIB3227-014-P1-K1-C6
gttgaacagaaggatgataatatgtctgacggactgatgggcagtgccatgtcccttggtgacatcatcaactcagaggattacactcgtgttgtctcccgtggccctaatcctaggactacccacttttttggagatcgtgtttttgagcttcaagctgagcagctgatgcctgttgagagtaaggtcgatcagagtacgtctcctgtggaagacggtctgatgagcttctgttatttttgcagtgagaagctcaaagaagccgaagacatctacatctatcagggtgacaaatccttttgcagcgtggagtgcagggaaaatttcatggtagattatgagatggaagaagcatatcatcctgcgtctcctaggagcccaccctctgacggtggtcggattttccaactgatacgttgagt

SEQ ID NO: 966 - DNA, 419 bp, Zea mays
  Clone ID: LIB3227-014-P1-K1-C7
agactatcaaatctcagggagggaaaatcctttttggaggatctgccattgaatcagaaggaaactttgtgcaaccgacaattgtggaaattacaccttctgcaccagttgtgaaagaagaactctttggtcctgtcctttatgttatgaaatttcagaccttgaaggaagcaattgaaatcaataactctgttcctcaaggattgagcagttctatatttacaaagaggccagatattatttttaagtggctcgggccccatggtagtgattgtggtatagtgaatgtgaacatacctactaatggtgctgaaattggtggagcatttggtggagaaaaagcaactggtggtggacgagaagcaaggagtgattcctggaagcaatacatgaggagggcgacttgtacaatcaactat

SEQ ID NO: 967 - DNA, 427 bp, Zea mays
  Clone ID: LIB3227-014-P1-K1-C8
gttcgcttacatctttctcaggtcttccctgaaagaactgtctctcaaatgcattaaataatcgctacacaattgctatgtttgtgtgctatgaagctctaaactacggaacagaatagatttgcagtttgctatcggtcagatattgcgctcttgtacaaccatcatggggaaaaaaaatttcccgactgacttcatacctacgcaggtggcctttcatatctgggttcaccttgacatgggtgcaaagcacgattttagtgggctgacccccgagaaatggctgcttggcgctgttggtgcggtgagggttgctgtgagaggcttgtcggcatcaggtagcctgttgagaccaccatcccaatatcagttttagtctcctcgccgtttcatgaccacggcgaccggccttccacgatgtacattg

SEQ ID NO: 968 - DNA, 421 bp, Zea mays
  Clone ID: LIB3227-014-P1-K1-C9
caatcctattggtgcaagagcacaaccatcctcacatactgctcctgcaaatcggtaatacattctgcaaacttcctggtggacggttgaagcctggagaaaatgaaattgagggtttgaaaagaaagttatgcagcaaacttgctgtgaactcgccttcctttccacctaactggcaggttggagagtgcgttgctgtgtggtggaggccgaactttgagactgtgatgtatccttactgtcctccacatatcactaagcccaaggagtgcaagaaacttttcattgttcacctatccgaaagagagtattttgctgttccaaggaatctgaaactgcttgctgttccactgtttgaactctacgacaatgttcagcggtacgggcctgtcatctctaccatcccgcagcagctttctag

SEQ ID NO: 969 - DNA, 69 bp, Zea mays
  Clone ID: LIB3227-014-P1-K1-D10
gctctctgctgcgtgcttttgtataaaagaagtggttcgatgtcgcacagaaagggaaaaaataaaaag

SEQ ID NO: 970 - DNA, 53 bp, Zea mays
  Clone ID: LIB3227-014-P1-K1-D11
aaaaaaaaaaaaaaaaaaaaaaaaaaaaaaaaaaaaaaaaaaaaaaaaaaaaa

SEQ ID NO: 971 - DNA, 194 bp, Zea mays
  Clone ID: LIB3227-014-P1-K1-D12
ctccagtgtattatcactcgcatgcatgtgatgtgagccactgcacgcgtgagtgtcacatgggtcgtcgtcctgtctcgtctcatgtgtttcaaactgtaggcagcagaggatcgagatgcgtgtctgctttgttcgtgttcactgctgtcagtctgtcaccgagttcaataatttagctttgtttcatcggg

SEQ ID NO: 972 - DNA, 352 bp, Zea mays
  Clone ID: LIB3227-014-P1-K1-D3
atctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcggtggcggtcgtgttgtgttcttggtctagttagtctgtgttgtctttatcggtgctgttttctgtggtggttgtactgcatcgttctagtttctagtccatgtgctgtaatatctcgctgctgtaatcaatggaatgtcctcgtttcaagcctc

SEQ ID NO: 973 - DNA, 358 bp, Zea mays
  Clone ID: LIB3227-014-P1-K1-D4
gcagaacttgcctcaaatgctgctgctggtgacaagcaagaacagccaaaggatgatgacgatctactacagcaggcacttgcaatgtcaatggagggtggcgcttcaggatctgcagctgtgactgactccgctatggcagaagctggtgcagttgaccctgacttagcgttggctcttcaaatgtctgtccaggatgcaaacatgtccagtgacactgatatgagtaaggtgtttgaagacagaacgtttgtgtcatctatccttaattcgcttcctggtgttgatcccaatgatccatctgttaaagatttgctggcatcattgcacagccagggagagcaagagaagaaggaag

SEQ ID NO: 974 - DNA, 403 bp, Zea mays
  Clone ID: LIB3227-014-P1-K1-D5
cgactctcacagacttgctcggcgaggaggcctcttcctccgtggtcgccaagctggccaacgacggctctggcattggagctgcgcttctcgcagcctcacactcccagtatcagtatggcgcgagtgactagtagtcctgaaacgggcgcggatcgagattttgagtgtagctctcattttccttttcttttttcccttttcaaaacatcttttttggggatttttttcggcttccttttgttggctattccgtggatgcacttacggctctgcattgggatgtagctagtatagagccaatgagtttggaggttatctaatggcacaaggcaggagcatggaaatggaagcagagcaatgacattcatgctctgcccattcttttttccccttgtatggt

SEQ ID NO: 975 - DNA, 408 bp, Zea mays
  Clone ID: LIB3227-014-P1-K1-D6
agcgagagtacaaccgcaaagttcgggaggtcgtggagcagagctggacggcggactgatgatgccctgtgttgcgtcgcgctgtgctgcgcagctgctcactgcgccccgcgtccgtccattccataccaaaaaaagaaaatggcaaagccgaactcagctgttgctgctttcgttgccctgtgtcaagacgactgcttctctatgaacattttaccttcctgtgctgtatctggaatacaaacttaattatctctagcactgtggcaacatcttatcttatatgaaatttcctccgggaaaacgagaatgatttgcttgggtgattatttcatgaccagccaggttgctgtactaaactatggtacttatttcagctaattttgaatttgaactgctctccgtctt

SEQ ID NO: 976 - DNA, 242 bp, Zea mays
  Clone ID: LIB3227-014-P1-K1-D7
gtagcccgtccctcctgatacctcccaacaaactcatccaatcccaaactgcggggagtttatactgtgtgatacgaagacctgaagtataaattaacttattgcctcaatcatacagagatccattactatacaaacaactgaacataactctcactcactctttattccttcagttgcccttacccaaaatgtctcctattacataatctaaactctttgtacaaggtctccattaatac

SEQ ID NO: 977 - DNA, 81 bp, Zea mays
  Clone ID: LIB3227-014-P1-K1-D8
gctacccatcctctctcaaacttcaaaccaaaataatctaatattaaatgggggggaatttatacttctccaccctataca

SEQ ID NO: 978 - DNA, 423 bp, Zea mays
  Clone ID: LIB3227-014-P1-K1-D9
gatctattcttcagctgcaacatatggaggagtagcccatgccccatcacagccggatccggttgatggaaactacatatccaacttggtcttgagtgtttttcatgacccatctgtcatggaccaggagcatggactgcacatcaaagatgtcatagatcgtctcaaactaccagatgatgtagtcagtgcggccatccaaggtcatgttgatgtgggcaacatttacaacacaattgatgacttccactacaaatctgtccggaatggatgaccacgttgcaagtccagcgttcaggctccgtgtaggtatggagccgtttcaaggaagaagaaatgtaaaccctcttcaggatcgcctatattttgcagataggcttcatggtcaacagcttagcatatcggtttaggtgtgtattgctc

SEQ ID NO: 979 - DNA, 430 bp, Zea mays
  Clone ID: LIB3227-014-P1-K1-E1
gagccaggggagagcgggcagagccaaaccagagacgcggcacgcgacgcgggaggaccagcagcggcggcgcggcgacatcgcgaggccagggcagaggcgaccgccgagagtccctgccaccatggacaccttcttcctatcgcacggctcgcccacgctctccatcgacgacagtatcccggcgcggcacttcttcaagtcatgggtgccggcgaaggtcgcgggcgaccagcccccgcgcgccatcctcgtcgtctcgggacactgggagacggccacgccggcggtcaacgtcatccgcggcagcaacgacaccatctacgacttctatggctttcccaagcccatgtaccagctcaagtaccccgctccgggcgctccggacttggccctgcggaccaaagatctcctggagcaagccgggttc

SEQ ID NO: 980 - DNA, 414 bp, Zea mays
  Clone ID: LIB3227-014-P1-K1-E10
ccggccagaaggcggcgcacctggcgctgaaggcactgggcaggcccaacgccggggacgggaccatcccagaggtgtcgccggcgctgcgcgaggagttcgtgattgcgtccaaggacgacgaggtcgtggacgcctgagcgagcatccacgcgccagcatgcaagcagcgtcttatctgggccggcgccatcacggggtttcttcttttaatctgggactttgttgctgttggacgaatgaattcccttcgatcggttagctttaatctgtctcgttagtgtgtcgtgttcgtgtagcaccatgccacacaccagccgtgtgctctgtcacgtgggggccactcgtggggtctcctgctgctgtcagaacgaataagagaagatggaattgtgatgaaacaataaaaatgca

SEQ ID NO: 981 - DNA, 64 bp, Zea mays
  Clone ID: LIB3227-014-P1-K1-E11
gtttgtaccgtattgtttatttataatatgatggatcgtatgttgatatatggggtcccacact

SEQ ID NO: 982 - DNA, 354 bp, Zea mays
  Clone ID: LIB3227-014-P1-K1-E12
accggtaacattgacctttgcttcgccaatgaggatgaagctagagaggttatagggggaggtctggaatcagatccagaggaggcgcttgcgttcttgggcaagtattgcaaatgggctgtggtcacacttgcttcaaagggatgcatggcaaagcatggcaaacaggtcgttcaagtgccggccatcgtggagagcaacgcggtggacacaactggagcgggcgacctgttcgcgagcgggttcctgtacgggctggtgaaggggttgccgctggaggagtgctgcatggttggggcgtgcagcggcgggtcggtgacgcggtcgctcggcggagaggtgtcgtcggagaac

SEQ ID NO: 983 - DNA, 360 bp, Zea mays
  Clone ID: LIB3227-014-P1-K1-E2
gaagattgcgtccaagctgccggccgatgacaagacgaagatcgcggacgccatgggcgcggacattagctgtctggacaccaaccagctcgccgaggcggacgagttcgaggacaagatgaacgagctggagagcctctgaaaccacatcatcgccaagatgtaccagggcgcgggtgaagacatgggcgactctggcagcatggacgaggacgcccacgttggcagcgaccaccctggccccaagatcgaggaggtggactaaccatgttgtagtcagtcttgagcgtgctgcagtagctggctggcccaatccctgacgtgagttatcgacggctgtcggagcggagtgtccgctta

SEQ ID NO: 984 - DNA, 293 bp, Zea mays
  Clone ID: LIB3227-014-P1-K1-E3
taaaaaaaaaaaaaaaaaaaaaaaaaaaaaaaaaaaaaaaaaaaaaaaaaaaaaaaagagaggaaataaatttattattattaaaataaaaaataaaatgtattttttattttgtttttaaatttattattttttttttttttttatttaattttttttttttatttctttttttttttatttttctttttctgtttttattattttttatctttaattatgctgtttttttatatatttttttatttttctgttttgtttttttttttttttatttcatacatttttttttt

SEQ ID NO: 985 - DNA, 339 bp, Zea mays
  Clone ID: LIB3227-014-P1-K1-E4
cggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctc

SEQ ID NO: 986 - DNA, 426 bp, Zea mays
  Clone ID: LIB3227-014-P1-K1-E6
gaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacatt

SEQ ID NO: 987 - DNA, 284 bp, Zea mays
  Clone ID: LIB3227-014-P1-K1-E7
ctgctggggcgctgctgttacctttcacgaaacgcagcgaagcacaggatgcggggatcgtcgtcgacctgatacccatacccttagcgctggttaagctcttgcctttagcttatggtgctctgttgttttgcattgtctgaacatcctctcacatcctgagtgtacgttcagtttgaggtttcctgtgttgtccgtctgaattccttcaaactttgcggttggaactggatgaagaataaaactccaacccgtcctggttcttttgtgggtctgtttggaat

SEQ ID NO: 988 - DNA, 422 bp, Zea mays
  Clone ID: LIB3227-014-P1-K1-E8
cgaggccatgatgaatgagctggcccaacaggctgctgatatccacttgcaaatgatgtagtcaaaaagcgagatgaagtgcacacgtggaagatgcaaatgccctcagcttcttcataccatacatgctgcagatgggactgccggagttccagtcgcacctttatgctggcatttgcccctacctgtttcgttttgattaacacattatgattgctgggtatcatgtagcgaatgtttaaagtgggtaccgtatgcaaatcatgtatgtactgtactagtttttacaccatctgaccaatcagcacccttgaggacagagactatttttaaatgtctttattgaactctgagcggcaatggcatcttcgccggtgtagatttgtagtaagattttacttatttgatccctttttgctttt

SEQ ID NO: 989 - DNA, 262 bp, Zea mays
  Clone ID: LIB3227-014-P1-K1-E9
aaaacccataaaacataaaaaacttccaacaaactaatctaaatcccctacgggatggtatatatattattcgagatgactaactcacttttaatatatcattgctcttatctttttcatacaatacattctgctctttttttttgacaatccaccttttccaccctttttctctcaatttaaacttttcttttattttccaccaaaataaaattctattcccctgtattaaaaaaccaattatttaaaaaacctctccttt

SEQ ID NO: 990 - DNA, 184 bp, Zea mays
  Clone ID: LIB3227-014-P1-K1-F1
gacacccatccatactctaacacccaatctatatactccactctcatcccaaggggacgttctattttttcttctaataaaaataaacctaaattaaattcataatcatcatagttctcaacccattaacacctttatcctacttaactgctcatttactcttttcatattcaactgtattcat

SEQ ID NO: 991 - DNA, 358 bp, Zea mays
  Clone ID: LIB3227-014-P1-K1-F10
cccacccgtccgtccacacgttctcccacacgttcgcccactcttacgggaaatgtggactttattttttctcatgatcatccgagctcctcatatctttctgtagggcaactgttcacaaaccaaagactatcatattctacagagatgcgcgtcagtgatggacaattctaccaagttctgttgaatgaacttgatgccaatacaaaggcctgtgccttattgcagactcactaccatttctacatttactttatatcgcttgtccacataacgtcatcacactctgctgtttgcttataatttaaatcatcatcgtgctgtcaataaaagctttaacatacttcctttcaccttt

SEQ ID NO: 992 - DNA, 351 bp, Zea mays
  Clone ID: LIB3227-014-P1-K1-F11
tttttatctgaagcacatacatttaggtttttcgataagaaaagcacaggcattagtttggcagtacctgtagcgccttaagcaaaggcaaggtgatacacgatttaactgtcaatcattttaaaacaaaaagatgtggattggtgatcttgacagaagcctggacttctcaagaaacaactgcaaaaatctgacgtgcccttggtgcggttgctttgtgtacaagaattttcccaagttccaagtgtaccttcttgacctcacacagtaccctaatttgatctggttctttcgatagcccaaacatcagattcaggtacacctcttgcataaaatggagttttcttccag

SEQ ID NO: 993 - DNA, 330 bp, Zea mays
  unsure (1)..(330): unsure at all n locations; Clone ID: LIB3227-014-P1-K1-F12
ctcgctgtcttaagtcggttcagtcatcagtgtgtctagtctagggaaaccccataaaaatggtgaaggtggaatcccatccatgtcataattaaggatgcactttttgtaagcaaatgtatgatgtacaatggccggcggcagtctaaatgttacaactagctttttggtgaattcaccgtcanaaaaaaaaaaaaaaaaaaaaaaaaaaaaaaaaaaaaaaaagggggcgctctgaggatccagcttacgtcgcgtgctgctaggatacatttataggcacccaaatcaattactgtccgcagttacaccgatgactggaaaaccctg

SEQ ID NO: 994 - DNA, 311 bp, Zea mays
  Clone ID: LIB3227-014-P1-K1-F2
cgatcttgtctctgtcgacactctcattgaggactatctgtgcgctgagccagttaacgagtacgtccagagctgcgacatcgttgccttcaacaagatctaggcgtgactttcgatcagtccttcccctggggtgctggcgatggtggtggctgggcaatgcaccagcctaatttttccatagctatatgtctgctttgtgtggccagtgatattgccgtgagtatttttggatcctattcgagtcgaatgtaccagtaccagagttaatttgctttaattcgaaacaccgttccggttggaattctgtt

SEQ ID NO: 995 - DNA, 425 bp, Zea mays
  Clone ID: LIB3227-014-P1-K1-F3
ctagaacctaagaacctgcacaggagatgaagaggagcttgggtaggagatggggggcgccgaaggcgagaggtggatggagctagcaacgaacttctcggaggggagccggacggagctacggtgggcggaggccaacctgctgcgagccgacgaccacctgctgctgctgcacgtcatcaaggagcccgactacgagcagagcgaggccatactctgggaatccaccggctccccgttgattcccctctcggaattctctgaccctatcattgcgaagaaatatggagcaaagtcggacatagaaaccttggacatcctgaacactacagctacccagaaggatatcgtggtggttgtgaaagtcctgtggtgtgatccgcgtgagaagctctgtcaagttatccatgataccccgctgagct

SEQ ID NO: 996 - DNA, 424 bp, Zea mays
  Clone ID: LIB3227-014-P1-K1-F4
cagatgagttcaagtcaatggacaataaggacatgcgccctgaagattacttgaacttggtttgtcttggaaaccgggaagaaccaccatctaatggcagcccagaatcagagaaatctacatataaaagtgcagagatagtctgtttttgcattttccttattcttaagggtatggcttagctcaacccttctgattacaccaaaactgaatatggttttggcgcacggaccttatgggaagctagagaagcatttgaagacgcagaaattactcatgttgacgatacagtagatcctgttagagacatggaaactattagtgaagagctcagactaaagttttcggtggattttgttgatttacaagatcagctgtacaacacttaaaccttttttcgacactattctgtgtctatattctg

SEQ ID NO: 997 - DNA, 280 bp, Zea mays
  Clone ID: LIB3227-014-P1-K1-F5
acaaactgtttgaattttgtagtgcctgttttttgttagcctccagcgaagacttgattccggcatattgcttgttcacgcaccgttaacaccgattaagattggcccagccgtgcaggaattgccgggtgtgttttcaccccctcgctaatcgatgtccagaatctgtgtgcccacgggtgttgtattgaccctagctttgtaaccatgcacatgatttcttttttaacgctgatggatggcacctggatctctgtccatggccatcgtaatcccaaaa

SEQ ID NO: 998 - DNA, 186 bp, Zea mays
  Clone ID: LIB3227-014-P1-K1-F6
ccaacccatccctactcaatctgccaatttacatgctccacaattacatacagtgccctttttaaagtttcaactaatatcactccacttaacctcattatacaaccctataatcttcacacccatttaattcaataacctcgttactcctaactaaatcctctttaaacctattctcttaataac

SEQ ID NO: 999 - DNA, 423 bp, Zea mays
  Clone ID: LIB3227-014-P1-K1-F7
gttgcatctgcctcaacaagcaatcctgcttcatatggttcggccaattcacagaaacagttgtctcttccagcaaaagctggacaaacttcctcagcgggtactatgaatgaagcagatggaactagaaatgcatacaacgcaaatggaaaccagtcagcaagatacgcagccaacactcagagcattcctgcaaacgtcggcatgcaatacgacgggagtgcagtgtcgcctgaaatccagtttagtggttcatcccttcagagtcagtcttcaagagggtccaacatgctagcattgggccctccgcagcaacatcaaagtttcgaattcccagcgctcggccagcccgttcagccaacaggcctgaaccctttcgaagagtggccgcagcagcaggagaaccgtggcggcggtgtcgac

SEQ ID NO: 1000 - DNA, 422 bp, Zea mays
  Clone ID: LIB3227-014-P1-K1-F8
ggagccgaacgagcaagcaagccaccaacgaaggttgctagggccggagtggatggggttcatgctgcgggtgaggctcgcctccttcttcgtcggcgcggctgccgccgccgcgggcgggggctacttcctctacaaggactacaagctcgccaacgactctctggccctcaaggtgaaatgtctccaagactcaactgacactcgctacgaagcccttgaaaagcgactcgctgctttggaaggtctgcaaagccctgaggctgcaccggatgtggatacgccatctgattagtctgttcgctacgagactttgatttacgtctgttttcgtttgccccagttgtcttctcctttgaaagcaagtacctgaccaacaacaaaataatctaggatgcttcttttgtactgcaaatgtctga

SEQ ID NO: 1001 - DNA, 416 bp, Zea mays
  Clone ID: LIB3227-014-P1-K1-F9
cccacgcgtccgcccacgcgtccgcccacgcgtccgcccacgcgtccgcgaaagggggactgtctctggtggcatgatcagggagcttctcatatctttctggagggcaactggacagaaaccaaagaggatcatattctacagggatggcgtcagtgagggacaattctaccaagttctgttgtatgaacttgatgccattagaaaggcctgtgcgtcattggagtctgactaccagcctccagttacttttgtcgtggtccagaagcgtcatcacaccaggttgtttgctaataatcacaatgataatcgtgctgtcgataaaagcgggaacatactgcctggcaccgtggtggactcgaagatctgccatccaactgagtttgatttctacctgtgcagccatgctggcattc

SEQ ID NO: 1002 - DNA, 408 bp, Zea mays
  Clone ID: LIB3227-014-P1-K1-G11
acgcacaaatcttgctgcaagcaacagcaatgtagacgcacaatggactgatccatgggcgggacattctgaccaggagagcctacacagccatgacaacaatgaattataactaaggcttctgacgatgctcgaatgttactggctagaggaggaagatgatgccatgccctctgtcaacaattcatagaatgactacaactaagagaaccagccctatgtgtgaacacatgtactaaccacggtccaaggaccaagacaacatatgccgcgcatattattggacaatggcctagtagctgtggctagtcacatacgagcgaagtgaagctacagctagcaaaacctaggctatgtcccattggtctgtggtcagaagcttgacatgtcatgaccatgaagtatgtg

SEQ ID NO: 1003 - DNA, 414 bp, Zea mays
  Clone ID: LIB3227-014-P1-K1-G12
ggtctctcggttgagacttctaggagacaatgtacattccacaaggatggctgttgttgagtttgttcatgctgagggtgccatcatggctattaattggagcgggattatttttggcaactctgcctggaaggcatgacctcctaccacccacctcttctattactgtctatttatgtatctagactgaaattttgaattttgggtcggagtctaggagagtatttgctaacactgatggcattgtgcattgttcagggtgagtccttctaagactcccgtgaagccacgtgtaaatcgaatgggatctaactgactctgcctaagctcaaccggaaggcatggtcataagctgaaggctttcgcggtcctgtgcatcatgatgcatttgcttacattcttacaaacactctg

SEQ ID NO: 1004 - DNA, 187 bp, Zea mays
  Clone ID: LIB3227-014-P1-K1-G2
gcaagagcaagaagatggagatgactattaaatacatagatccaacttacatgatcggcgctattccaagcaatgcatcagacaatgtctattgcaccctgctcgcacatagtgccattcatggtgcaatggcggaatacagcttaacagtcggaatgtttaatggcaggcatgcatatataccatt

SEQ ID NO: 1005 - DNA, 88 bp, Zea mays
  Clone ID: LIB3227-014-P1-K1-G3
cccacgcgtccgaggcgaggtgttctactaaaatgccaagctcctggttggcctatgggtggtttccaaggtttttaaacttgttttt

SEQ ID NO: 1006 - DNA, 157 bp, Zea mays
  Clone ID: LIB3227-014-P1-K1-G4
cacacacgtccatgctgttgctgccactgaacatgctcccctaccatatcacggggtcgggctgtagtggcatcttttaaaatcaaactattgctcgatgtctatcatgagattaaactaccaaaaaatcgtctcataccgcctgacccctcattca

SEQ ID NO: 1007 - DNA, 424 bp, Zea mays
  Clone ID: LIB3227-014-P1-K1-G5
gaaaaatcttggtgcaggcgatgtcaatgtttacgcacagatgattgatgatgctgagggcctggacaagattgagaacctacagagccatgacaacactgagatatatgagaaggctgtcaagatgctcgaatcttactggctagaggaggaagatgatgccatgccctctggcgacaatccccagaatggcttcaactttgggaaccagccctctgttccatcaggtggattcaacttcggctgaagatgcccatttggaatggcggctgtgccattgtgccttggcctagtggttggggctagtcagagttggggtagtggcgtcgtcctccaaaaccttggttcggtcccattggtctggtctcaggtgtttgtcatgtcagtcccagtcagcagggtcagtccttgtgctgcatcacca

SEQ ID NO: 1008 - DNA, 426 bp, Zea mays
  Clone ID: LIB3227-014-P1-K1-G6
aacaaaatgagctcgtagaatcagctgcagagatgctttatgggctgatccatgcacgatacattctgaccagtaaagggctggctgcaatgctggagaagtataggaactatgacttcgggcggtgcccgcgtgtttactgctgtggtcaaccatgcctgccggttggacaatcagatattcatcgatctagtaccgtgaaaatatactgccccaagtgtgaagacatctactacccacggtccaagtaccaaggcaacatcgacggcgcatattttgggacaacgttccctcacctgttcctgatgacatacgagcacctcaagctacagaagcccttgcagcgctatgttcctcgtgtctttggcttcaagctccataagccatgagcctcatgtatttggcttcaagctccataacccagag

SEQ ID NO: 1009 - DNA, 411 bp, Zea mays
  Clone ID: LIB3227-014-P1-K1-G7
taaaaaaaaaaaaaaaaaaaaaaaaaaataaaaataaaaaaaaaaaaaaaaaaaaagagaaaaaaaaaaaaatataattaaaaaaaaaaaaaataaaaataaaattaaaataaattataaattaatttatatattaataaattaaaattaaattttgttttttttttataatttataaattatattattttttcatttaaaatatttttttttttttgttgtaaaataaattttattatttggatttttttttaaatttattttttttaaaaaatttttttttttaaaaataaatatttttttttaaatataataatttttttttaatttttttttaaataaataaaaggtcctattattttttttttttttaataaatatattttatttttttttttttttaatttttta

SEQ ID NO: 1010 - DNA, 406 bp, Zea mays
  Clone ID: LIB3227-014-P1-K1-G8
gaagatgcaaaagctgcacagagcttgaatgggcagcttgatatcgctggcagaggtattaaggtttcagctgttaccgatcatgtgggaatgcaagctagtggagcaactactggagatttagatgacgatgaaggtggaggcttggcactaaatgcaagttccagagctgctctaatgctcaaattggacaggagtggtactgcgaccagcttaactggtggtattggtgctgctggtgtggctgtaccagctacttctgttattggggctccaggagctgcttttcttctaccaccaacagttgctgctgttggatcagttcctggggcacctgtgctttctgttaccactcagaatgtgaccatgtctacacctacagaaatctttgttgcttaaaaacatg

SEQ ID NO: 1011 - DNA, 229 bp, Zea mays
  Clone ID: LIB3227-014-P1-K1-G9
cacaatccaacatccacacacttctagtatacacaccccaatatcactggcggagctatttatattttttctcctaccatacatccactaaaccacactacacaacctactacatcacattcaaataacaaagaaaacctacgctactcactaattactactctcacagcttatctaattctcaaattttacattactaacacatagaccaccacaactcttcacattc

SEQ ID NO: 1012 - DNA, 117 bp, Zea mays
  Clone ID: LIB3227-014-P1-K1-H1
gagttcagtctcctgagaccaatgggttcaagtttcttggtccagtgcagatcgggtggggagctgcccacactgatcttgttgctggtgatgggtataggatgtgggcatggggca

SEQ ID NO: 1013 - DNA, 370 bp, Zea mays
  Clone ID: LIB3227-014-P1-K1-H10
caagaagaaaagggggaaaaaaagagagaaggccctcttgctccttttggccaaatgcttacgtacccgttcccacaactgccaccatacacaaccaggagggtgagactgtgtacctctatgttcccaggaagtgctcgtccacaaacaggatcatcactgccaaggaccatgcctctgtccagatcaacattggccactttgatgccaatggcctatatgattgtcacttaacaacatttgctctctctgggtttgtccgtgctcagggcgatacatacagcttcttggacagtctgtttcagtagaataagtgcttatattaatcagtacattatacatctaatttaccaagaattgcacacttcct

SEQ ID NO: 1014 - DNA, 404 bp, Zea mays
  unsure (1)..(404): unsure at all n locations; Clone ID: LIB3227-014-P1-K1-H11
cgacgactacctcgagtactcgagcaccctggccggcgacctgcaaaggattctctccaccatgcgcgagctcgatgacagggcacatggcattatgggtcagaccaaagaacagataaagtatattctgggagtatcatcccatgggtatgacaggtcaaacatggatgatgatgagtcggagaggatgaagaaggacattgaagctagtcaggacaatgctctgaatctttgcaccgagaaagtcttactggcacgccaagcttatgacctgatagagagccatataaaacgccttgatgaagacttgggccagtttgcagaagatttaaagcatgaagggaagatacctncagatgaacctacagtccttcctccagttccggtggttagcagggatgaga

SEQ ID NO: 1015 - DNA, 418 bp, Zea mays
  Clone ID: LIB3227-014-P1-K1-H12
attccggaagatgtctgatgaatttgagccagttgacatagaaggatcggcaaagcccgatgtttgggtgcatcgccctggcagttacgtcaccagtacatgggaacctcggaaaggccgtccccggtgccaggattccagaattcaccgggagaatgattcttgtagtgatagcccaaggtcatcagtgtcagaatctcatagaagtgactccagcactgaagaacccacgagcagtaaatcgcaccgccacctccaaaaggtgaagaagggtttgggcaagctagctggagcagtgctccaccggagcccaaagaaggagaatgatgacgaagcttcaccatgtgtaactcctcaccaaaacattcgaccggtcggggaaagcagggtttcagtaacatatgtggtcgatcaagat

SEQ ID NO: 1016 - DNA, 210 bp, Zea mays
  Clone ID: LIB3227-014-P1-K1-H2
gcaataggtagtcttcctgtggttcagatcttggtattgagttcaattggatcagtgctacgttggtgtctagatgctatagtattggtttcaggctttgtgtcatttagctggatgcatatgtgatgtgtaccagtacattgctctgaatgctaatggatgagcgaatctgtatgtggatttatcaatatcaggatatccctcattggc

SEQ ID NO: 1017 - DNA, 304 bp, Zea mays
  Clone ID: LIB3227-014-P1-K1-H3
gagatacttcgcaattgtaacaggctgatccaagcaggaggtgaatgtgagatgggtgggtatatagcattacttctagtctgatgcatgacggttcatggagaaggctggtggttgagatagctatcacacactcttttggttaataattagatactctttttgttgagcaatgtgaacctttaatggtgtttatgagtcttgaggagttgagatggggctattatgaagatgctatggcctgttttggatgattggacatgttatgggctctatatattaatctgctagctttggtttcctc

SEQ ID NO: 1018 - DNA, 354 bp, Zea mays
  Clone ID: LIB3227-014-P1-K1-H4
cgactcccagccgtcgtctgctgcggactccgcctccagtttggtctgtttcttgcaagttgctcttgcggtagttcccccaactgtcaccatgcagaacgaggagggtaagactggggacctctatgttcccagaaagtgctcggccacaaacagaatcataattgcaaggaccatgcctttgtccagatcaacattggccacttggatgcgaatggcctgtatgatggtcacttcacaacatttgctctctctgggtttggccgtgctcagggcgattcacacagattcttggacacgctgttgcaaaaaaaaaaagcttttttcaaacagtagattttacattctagttta

SEQ ID NO: 1019 - DNA, 389 bp, Zea mays
  Clone ID: LIB3227-014-P1-K1-H5
cagcgaggctgctgctgttatcgcgaaggccaaggaaggcccaaaccggtgcgcggcctgtaggaagcgtgttgggttgacggcttttaactgccgatgcgggaacacgtactgttcgatgcaccgctactccgacaaacacgactgccagttcgactatcgaactgcagctagggacgctatcgccaaggccaatccagtggtgaaggcggagaagcttgacaagatctgaggcgggggcattgggtaacgaaaaaaggttgcgatctgcaagaattcagcatgtctctttgctgctttatcattgaactttccattcttgtcttggtgtcacgtcccctggggttcaatactatgatgcgcacagcattcctgctgctgcaagaatt

SEQ ID NO: 1020 - DNA, 247 bp, Zea mays
  Clone ID: LIB3227-014-P1-K1-H6
acgccaggcgctctattaacattgagaggcccaactactgcaacctgaatcgcctggagtctggggagatctcatgtattactgctcacctgacattcgatggtgccccaaatgaggatgcaaacaaagtatcagaccgaacctgttaccttacccgtgtatccacttaatgctgtattactacgcaccggagaggtcttatacggacgtcttacataagcaggagactgttgtggatatcaccacc

SEQ ID NO: 1021 - DNA, 243 bp, Zea mays
  Clone ID: LIB3227-014-P1-K1-H7
tatacaaataaattaaaaaaaaaaaaaatctaaatattcaaaaaaaaaaaaaggggggatttatataaaaataaaaaaaaaataaaaacaaaaaaaataaaaaagggtcgcccttttttttacatcaaacatttcgtcccattccttccacatacttaattttttttttgtttccctaaatttaatttaactggccgtcgttttaaaaactttttcttggaaaaacctacagtttcccaaatt

SEQ ID NO: 1022 - DNA, 238 bp, Zea mays
  Clone ID: LIB3227-014-P1-K1-H8
cccacccaatcttccactaacttcccatttatataccccaaaaccacacgctggggcctttaaaattatacattcactccccatcattcaaacttccctatactactctttttttcacaacactatatactttctaaatcttcctctttccctactatactcctcatataacactattttctttttcaataactccatcttaataaatattatctcatcactctttctatcaattatc

SEQ ID NO: 1023 - DNA, 326 bp, Zea mays
  Clone ID: LIB3227-014-P1-K1-H9
caccagttcgccacccgcatgggcaacgtgttcaccattggcaagggcaacaagccgtgggtgagcctgcccaagggcaagggtatcaagctcagcatcatcgaggagcagaggaggcgcgactttgctgcccaggctgctgccaaggcataagttctctgaatgtgctgcttggagctttttgctatgtctagttttatttttatctgcaaggatatagagctaccttcccaagacgttttatcatcatgttttgttgcttttggttcttgaacagcgtttgcagctagctgtaatgctttaattcgactttctatatattgttg

SEQ ID NO: 1024 - DNA, 299 bp, Zea mays
  Clone ID: LIB3227-015-P1-K1-A10
agcaggctggtcctgagctagaggagagtcatccaagaggggggggtggtgttaaaaattgcgctattctgcaacaactagtcaccgttacattggcctatcatgagtgaagatatttaaatgcttattcgacgttagagagtactgattctaattattttattaatcagcttattatgcacctatagaatatgattgtaccctaaaaaattagtggcaagagtcggataagtattttagcagcttgcattaatgcatccaggtagcatccatttatcaacgtgtgatagttggtgaat

SEQ ID NO: 1025 - DNA, 391 bp, Zea mays
  Clone ID: LIB3227-015-P1-K1-A12
ctcccgaccgcaacgcccctcatctccctcgaccccgacatccccgacccggtggggcccaaggcggagtagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcgaggccgccaagctggcgcggtacaacaagaagcccaccatca

SEQ ID NO: 1026 - DNA, 419 bp, Zea mays
  Clone ID: LIB3227-015-P1-K1-A3
tcgcccgcaccaatctctgcgtctcttcgtcttcggctgcgcggcgggcggcagcagcggaggaggttgaggagatgctgtccggcgacatccccccgaaccagaccatctacctcaacaacctcaacgagaaggtcaagaaagaagaattgaagagatcgctttatgccttgtgctcacagtatggaaggatactggatgtggtggccctgaaaacacaaaaattgagagggcaagcatgggtggcgtttagcgaaattacagctgctaccaatgctttccgtggattgcaagatttcgatttctatggcaaaaaaatgcgagtacaatatgcaaaaacaaaatcagactgtattgcaaaagaagatggtacttatgcacctaatgagaaaaggaagaagcaagaggagaaagctgct

SEQ ID NO: 1027 - DNA, 387 bp, Zea mays
  Clone ID: LIB3227-015-P1-K1-A5
gcgcacagctttcggcttctttctctcatcggcacacccgagctcgcgccctccttgcacgtcgaggtccgagtcctgctttgatggcgaccgacgtgactgagactcccgcgccgttggtggatgcggccccagaggcgcccgccgacgccccggcggcgcctgctgccgacgcgaagccggccaaggccaagaagggcaccgcgccgaagaagcgcgccagcccgacccacccgccgtacgccgagatggtctcggaggcgatcacgtcgctcaaggagaggacggggtccagcagctacgcgattgccaagttcgtggaggacaagcacaaggccaagcttccgcccaactttcgcaagcttctgaacgttcagcttaagaagc

SEQ ID NO: 1028 - DNA, 381 bp, Zea mays
  Clone ID: LIB3227-015-P1-K1-A6
acagaaatagtataacttgatttttgcttcattccatgtgtggggacattaatcattggtcttttcattgggcagaagtgccacaggtatggcgtcatgcaccgggatcttaaaccagagaactttttatatgcaagcaaggacagttcccctctaaaagcaattgatttttggcatgtttgtgttcttcaggccgggtgagcgatttacggaaattgtaggcagtccatactacatggccccagaggttctaaagcgaaactatgtccctgaagttgatgtctggagtgttggagtgatactttacatacttctttgtggtgtaccaccattttgggcagaaaccgaacagggagtagcgcaggcaatcataccatctgt

SEQ ID NO: 1029 - DNA, 408 bp, Zea mays
  Clone ID: LIB3227-015-P1-K1-A7
ggagaagctacagacggaggtgaggacgacgatgcgctcgccggacggcaagaagctggacatgctagcggaggaggacctcggcagcatgccctacctcaaggcgaccatcaaggagacgctgcgcctgcacccgccggcgccgttcctcctcccgcactactccaccgccgactccgagatcgacggctacttcgtcccagccgggacgcgcgtcctcgtcaacgcctgggcgctcgggagggaccgcacgacgtgggagaagccggaggagttcatgccggagcggttcgtgcaggaaccgggcgccgtggacgtccacatgaagggcaaggacctcaggttcatcccgttcggctccggccggaggatctgccccgggatgaacttcggattcgcgaccatgga

SEQ ID NO: 1030 - DNA, 416 bp, Zea mays
  Clone ID: LIB3227-015-P1-K1-B1
cttcaatggtgtgttcctcaaagtcaacaaggcgactattaacatgctacgcagggttgagccatatgttgcatatgggtacccaaacttgaagagtgtcagggagttgatctacaagaggggctatggaaagctgaacaagcagaggatccctctgtccaacaaccaagtcatcgaggagggcttgggcaagcacaacatcatctgcattgaggatcttgttcacgagatcatgactgttggcccacacttcaaggaggccaacaacttcctctggccattcaagttgaaggcgccgctgggaggcctgaagaagaagaggaaccactatgtggagggcggcgatgccggtaaccgcgagaactacatcaatgagctcatcaaaaggatgaattaggttcacgatcaagctcatt

SEQ ID NO: 1031 - DNA, 394 bp, Zea mays
  unsure (1)..(394): unsure at all n locations; Clone ID: LIB3227-015-P1-K1-B10
aattaactagcttcttctagctctagctaggctcgtctgctgcaagaaggtggcggcgcatgcatggaggggaaggaggaggacntcctcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctctttctctacatcttcatcctcaccgtcatgggcgtcttcaagtccacctccaaatgcgccaccgtcggcatccagggcatcgcctggtccttcggcggcatgatcttcgccctcgtctactgcaccggcgggattt

SEQ ID NO: 1032 - DNA, 392 bp, Zea mays
  Clone ID: LIB3227-015-P1-K1-B11
cccacgcgtccggccattctttgttgtatgtttctcaagtatcatggcctggggggggcctgatttcattaacttcctgccaactttggtgtccgggatgtacgttagctggctttacctgagatacttccaaaggaacccactgactggacttaagggtgatcccagtgatgacttctcctttcccagtttattcccagctgccatgagaccagttacggaccctgtggccaacctgtttgataggctgttgtgtgcaaggtccaggcctttggaagtcgccctcccgatatcagattctaccaaggctttaagaataagggagcgtgccgagagggttcttgaggaaaggttggcggcctgacaatgcttgtgacacagaggcctcgcct

SEQ ID NO: 1033 - DNA, 415 bp, Zea mays
  Clone ID: LIB3227-015-P1-K1-B2
gataaaatagaagctgaaagcaaggatgctgatgcagaagataacaagaaaagaaatgcagaaggtggaaagcaaggtgcttctcttaagaaagccaaaaaggacaagcttgttggtgcgactggaaaaagcgtcagaactgaaacaagcatggtttctgtggcacctcgagtgaaaccggagctaactcttccagcaacgcctgttgaagttgaacaatcaattcttgaggacctacgaaaccgtgcacaactgaatagtgtggcattgccatctgttagcttctacacattccttaatacacataatggattaaactgttcctcaatatcacatgatggatcactggttgttggtgggttttctgattcgtcagtgaaggtctgggatatgtcaaagatgggccaaccagcaa

SEQ ID NO: 1034 - DNA, 405 bp, Zea mays
  Clone ID: LIB3227-015-P1-K1-B3
aagaaaagttagagaggtaccagatgtaccagatctacgcggtgctcggcatgtacgtgggaagaaactttttagagatgatgggcacaactctagtggtgaggaatctattggtgcatctgaccatcaggatcacggtgaagatgacgacagcaacggcgatgcagatcagcccttgatcaacacgatcaggtcttccgccgccaagctacggtccttgaagatctctcaacagggaccaagcagccaaaaaggggtccctggcccatccggaagcaatagctgagaggatgcatgcagtgcccctcatcgttggtgatgatttccagacattgactgaccgattcaagcagcacaaggggctggcactaacatcagtttgacgaggacaccattccacgcgga

SEQ ID NO: 1035 - DNA, 400 bp, Zea mays
  unsure (1)..(400): unsure at all n locations; Clone ID: LIB3227-015-P1-K1-B5
tcgcgcacgctagtgtcagtggcacgcaagcagccccgcgcaccgaggggagaccagaggtgggggcgaggccaaaggcaaaggcaagggcccggaccgcaattgccaaagcttgaagcggcggtccgttctttccggtccccggcgcggcgcttgtggtcgtgctgctaggcatcgtcgcgggcgcggcgagggcgcaactgcggctgaactactacggcagctcgtgccccagcgcggagtccacggtgcgctccgtcatctcgcagcgcctccagcagagcttcgccgtggggcccggcacgctccgcctcttcttncacgactgctttgtcaggggatgcgacgcgtcggtgatgctgatggcgccgaacggggacgacgagagccacagcggcgc

SEQ ID NO: 1036 - DNA, 389 bp, Zea mays
  Clone ID: LIB3227-015-P1-K1-B7
tcgccgcaccatcaccttcagcccagccgcggctaccacgtcgagctcggcgctcgcgagaaagcgcttttggaggaggatgttgctttgaagaggttcaaatcatacaagaacagtgtgaaacaggtctccaagattgggaatgttctcactttagctgttgtatttggttgtagctacgagcttggtttgttggcggcaagcataaagtgaaggaaaacacagccattattccgggaagtgatccatcagcgtagactgtcattctatcacctcgtgtttttagcctggctggctctctcttattttggcgtgcaccatgtataaaataaaactaaactaggttaacccttgtttgcgaataacgttttcttgttcttttaaataat

SEQ ID NO: 1037 - DNA, 405 bp, Zea mays
  Clone ID: LIB3227-015-P1-K1-B9
gctacgtcacggtcaggggcgacaaggccatgcagctgcttgagagcggcctcaaggtcaaggagtacgagctgctcatgaggaacttcagcgacaccggctgcttcgggttcggcatccaggagcacatcgaccttggtatcaagtatgatccatcaacaggcatctatgggatggacttctacgtcgtgctcgagcgtgctggctaccgcgtcgcgcgccgcaggaggtgcaagtcccgtgttgggattcagcatagggtgaccaaggaggactccatgaagtggttccaggtcaagtatgaaggtgtcatcctcaacaaggctcatgccagcacgatttaaacctcacctgtgggggcaaaacagctctcgcttcatctccatgtgaacgcaagatcacctt

SEQ ID NO: 1038 - DNA, 308 bp, Zea mays
  Clone ID: LIB3227-015-P1-K1-C10
gccccagcccccgcgccggccgttggcggtgccgcggggctgccttgcggcggagcgggggcgtgggccgtctccgctctaatctctctcgtcgccttcctcgtgatctgagggcgtggggatcgtgctgcgcatcgcgggagatggagggacgaatcctgccatctggatcgcagagagagaggagagggggatatttatgttcggtctggttgttctagggggcctctcttttgcctgtataagagaggatcatgattttttttatataaaaatacctggttatgtgtcattctgttttaataaaa

SEQ ID NO: 1039 - DNA, 407 bp, Zea mays
  Clone ID: LIB3227-015-P1-K1-C2
ctcaagaattgcttcgccctcctcctaaggtcccatccattgttattgttgatggccatgagtgtgaggaatatgaggagccacctatacttggaaggaagacttattttgtagcagataaatcaggtttgaaccatcaatgggtccagtgtgaagattgttccaaatggagaaaacttccaatagatgccctgttgccctccaaatggacctgctttgacaataaatgggattcagaaaggtcttcttgcgaacctgcacaggaaataagtttggaggagcttgcagaactcattcctattaaacctggaaaaaaacccagattgaagatagaatctgatgctattgatgcttcaaatgggctggacacgcttgcgaaccttgcaattctttgggaaggtgaagcg

SEQ ID NO: 1040 - DNA, 354 bp, Zea mays
  Clone ID: LIB3227-015-P1-K1-C5
gggcaacgactggcacccgaccaactacttcagggggggtaaggggcagtgcccccacccctacaactaccccaaggatgaccccaccagcacctttacctggcccgccggaaccaactacaaggtcgtcttctgcccgtgagggcggtgaactagcattagcgtgcgcgcgtcgaccaagaacaagaaataaaccaccgaggctgtgtatgttgccccgcgtgtgcttaacttgagcaaaaataaaaccaacaaaacaagcacgtgtgatctttatgtcaccaactttatcaacttaattaattgggcattatgaaagtgtttctttacatgctcgtactgaaatttggtttt

SEQ ID NO: 1041 - DNA, 350 bp, Zea mays
  Clone ID: LIB3227-015-P1-K1-C6
taaaaaaaaaaaaaaaataaaaaaaaaaaaaaaaaaaaaaaaaaaaaaaaaaaaaaaggaggaaaaaaaaatttatttaaaaataaaaaaaaaaaaaataaatcccacaaaaaaaaaaaaaaaggggcccccccttttaaaataccaaaattttctcccccctctttccaattaaaaattttttttaaggtgcccccaaattaaatctatctccccgctttttaaaaactttttccttgaaaaaccccttctttacccaaattaaataccttttaaacaaattcccttttttccaagtgagttaaaaaaaaaaaaatccccaaacaattctcttttcaaaaaatttccaa

SEQ ID NO: 1042 - DNA, 406 bp, Zea mays
  Clone ID: LIB3227-015-P1-K1-C7
caactttacggctgatgggttgcaaactctcaccaacaacttgtgttacacgtatgctaggtgcacacgctcagtatcgattgttcctcctgcatactatgctcacctggcagccttccgagctcggttctacatggagccagatacgagtgacagtggatctatggcaagccggggccctccaccaggggggcgcaacaccaaggctgccggtgttgggaatgttgctgtgaggccattacctgccctcaaggaaaacgtgaagcgggtcatgttctactgctaagactgatgctgttaaggcagagctaccttttattattacagtatatcgtgaagactagagtatttttttccacgtacttgatgatgctgagctaccttttattatgggcgacgatatatg

SEQ ID NO: 1043 - DNA, 368 bp, Zea mays
  unsure (1)..(368): unsure at all n locations; Clone ID: LIB3227-015-P1-K1-C8
ttccggggcgggccacgcctccccgaggagaaacccgcggcgaaaaaacccgccgaggaagagccccccgccggaaaggcgccccgccggaagaaacccaaagccgaaaaaccggtccccgctggcaagtccgctggcaaagaaagcggcgagggcaagaggggcaagaagaagggcaagaagagcgtggagacctacaagatctacatctttaaggtgctgaaacaagtgcacccggacattggcatcttctccaaggccatgtccatcatgaactccttcattaacgatatcttcgagaagctcgctgctgaggccgccaagctcgcgcgctataacaagaagcctaccatcacctnccgtgagat

SEQ ID NO: 1044 - DNA, 399 bp, Zea mays
  Clone ID: LIB3227-015-P1-K1-D1
tcgggccatggaaccacagtcaccatttgctcaccacaacctgttgatggattaccaaccgggtgcttccttatttctcttgactgtggattgttccacacaaccgtagtctcctctgatggagaggtgtggtgctggggaatggagagaggtcttggattgtgcccagatgctagcttttcgggagttgatgaaggggatgctttatatccaataagagttcagtctcctgagaccaatgggttcaagtttcttggtccagtgcagatcgcctgtggagctgcccacactgttcttgttgctggtgatgggtataggatgtgggcatggggcagaggccgcagtggtgtgcttgggagaggccagactgctgcagttacataccatgcgttgtgatgt

SEQ ID NO: 1045 - DNA, 400 bp, Zea mays
  Clone ID: LIB3227-015-P1-K1-D10
agctatgccacgaagtccaaccagacgcgggtcgtcaagacccctggtggcgggcgtggtgtaccagtacaccaagaagagagccagcgggcccaagtgtcccgtgaccgggaagaagatccagggcattccccatctgaggccagctgagtacaaaaggtccaggttgtctaggaaccgcagaactgtgaaccgtccctatgggggagtactatctggaactgcagttagagaaaggatcatccgtgctttcctggttgaagagcagaagattgtcaagaaggtgttgaaattacagaagaccaaagacaagacttcctcaaaaaagtaactctgaaacagaagtgagccactcttctgcagcaagggaagacattttttcgacagttattattaatgg

SEQ ID NO: 1046 - DNA, 401 bp, Zea mays
  unsure (1)..(401): unsure at all n locations; Clone ID: LIB3227-015-P1-K1-D2
gtcaccatgttcgacaaggtggccgccgacgtgaacaaggggcacattgacctcggcttggggcctgcagcccctgccgtccgtggcgctggcgaccagggacagaatggcgcgcagcagccccgggcggtgagcatgatgggcctcctggaagtggcgaaccggccccttgataactacatgaagcagaacggcctgacgagcctggcgggggagcaaggaggtggcagctccagcacgggcacggtcccgccggctccagtggagagtgaggaccggacgtccnatgagggccgtgtcgcgtcagcagagcgggaagcagacgccatgggcatcgacgaggccggcgagaaccagcaggacaagcctgccgactctgccggtgccgctgctacttgacg

SEQ ID NO: 1047 - DNA, 194 bp, Zea mays
  Clone ID: LIB3227-015-P1-K1-D3
gaaaaaaaaaaaaaaaaaaaaaaaaaaaataaaaaaaaaaaaaaaaaaaaaaaaaaggggaagggaaaaattattttttttaaaaaaaaaaaaaaataaaaaaaaaaaaaggggcgccccttttaaaggatccaagtttacttacccgtgcttgcaacgttatatcttttttttattgtcacctaaattaaatt

SEQ ID NO: 1048 - DNA, 154 bp, Zea mays
  unsure (1)..(154): unsure at all n locations; Clone ID: LIB3227-015-P1-K1-D4
gggcggtcaccgccggcgcccggaccaccctccttctgttcgccaccgtagtgggtgctagcgtgcacggggagcgcccccggggatgccatgtccncncacaaacaatcaccggcatccctttggggggcacaagggagcttcgcccgaggtt

SEQ ID NO: 1049 - DNA, 354 bp, Zea mays
  Clone ID: LIB3227-015-P1-K1-D5
ctaaaaaaaaaaaaaaaaaaaaaaaaaaaaaaaaaaaaaaaaaaaaaaaaaaaaaaagagggagaaaaaaatattttttaaaaaaaaaaaaaaccaccgcccccccattttaaataaatcctaacttacatcccccttcctcctaatacctccaactcttttaattccaactaaattaaaccaactccccctttttacaacacatattaaattaaaaaaccccttttttacaccaacttaactctttaaacaaaaaaccccctttcaaaaaattttaaataacaaaaatcacctaaccacaccctttactaaaaaaattccctccacataatcaccatttccttaccccctctt

SEQ ID NO: 1050 - DNA, 403 bp, Zea mays
  Clone ID: LIB3227-015-P1-K1-D6
cagcacttcagattatgacaaggaaaagctccaggaacggttggcaaagctctctggaggtgttgctgttctgaagattggaggagccagcgaagcagaagttggtgagaagaaggatagagtgacagatgcactgaatgctactaaagctgctgttgaagagggcattgtaccaggtggtggtgttgctcttctctatgcatcgaaggagctcgataagttgcagacagcaaattttgatcagaagattggtgtgcaaatcattcagaatgctttgaagacacctgtacacaccattgcctccaatgctggggtggagggagcagtaattgtgggcaagcttttggagcaaggaaatactgaccttggttatgatgctgctaaagacgaatacgttgacatg

SEQ ID NO: 1051 - DNA, 390 bp, Zea mays
  Clone ID: LIB3227-015-P1-K1-D7
gaacgtggtgtgccagtactacccgccgtgcccggagccgcaccgcaccgtgggggtcaagaggcacacggaccctggcttcttcaccatcctcctgcaggacggcatgggcggcctgcaggtgcgcctcggcaacaacgggcagagcggcggctgctgggtggacatcgctccccggcctggggcgctcatggtcaacatcggtgatcttctgcagctcgtgaccaatgaccggttcaggagcgtggagcaccgggtgccagccaacaagagcagcgacacggcgagggtctccgtggcgtccttcttcaacacggacgtgaggaggtccgagaggatgtacggccccattccagaccccaacaaggcccccctgtacaggagcgtcag

SEQ ID NO: 1052 - DNA, 396 bp, Zea mays
  Clone ID: LIB3227-015-P1-K1-E11
agttggctcactcttttctgtctgttgttcatagtatttgtcaaaagtgaggggggttgacccctggtgttttgctaaccaacttttagtgtctcaactgcgctgtgccatgtttgatacagtaccttgtacaaaaatgtcaccttggtggtgtggcatcctaaagttcatgcattcattctgccatccatgttttttgaatttctagtggtgtttcttgttgcagccttttggattttgaatttgctgcatactcaggtatggcgacatggcgttgagattttcagtgggcttttaaaagtgtgttgttgtagcttatgatcactggttaaggagctttttatatttggtgccttaaaataagcaaaagaagaaatgtatggcatgtaagccata

SEQ ID NO: 1053 - DNA, 355 bp, Zea mays
  Clone ID: LIB3227-015-P1-K1-E12
gcgaacctgggacacaagcctgttgaggtttttgtaggtcgggcgctcaatggcgagggatcatcggtttatttcttatattgcctcattgtccagcagtatagccacatcattttgctcgaggaggtagtgttttgacagtacacttttttatgtctcaactacctaattataaacttggtagtaagggtacacatttaacccaagcttggatttctttccgtagtcaacatacagtcgctctagtatgatggaaccaatgccatagccccttcctccaccaacagtgttgtagacgatgaatccttgtataccatttccattatctacctactttctgatgctatcaaatcac

SEQ ID NO: 1054 - DNA, 251 bp, Zea mays
  unsure (1)..(251): unsure at all n locations; Clone ID: LIB3227-015-P1-K1-E3
gtttgcttctcctccccctccggttcgggttcgggttcgtgagggtctcccaagtgtcagagtggttngtgagcggatcttaaatccncccttctcattttgagtaccggtgcttcgtcggcgggctctcctgggccacggacgaccacttccttcacaacgccttcatgacctacggggagggcctcgaggccaagatcatcctcgatcgggagacgcagaggggccgcggcttccgcttcgtcaccttt

SEQ ID NO: 1055 - DNA, 378 bp, Zea mays
  unsure (1)..(378): unsure at all n locations; Clone ID: LIB3227-015-P1-K1-E5
ccgagctctgcgacagcccccagttcttctctgccacgtcgtcgcggccctttaggggggggctntgcccggtcactcctactnccaatagcgagtgctcgcgcagcctcttcggcggctactccgactacccggactacatgggcaacacggagtcgttccgcgccaaggcgcgttcgcagagcgcccccaagcagaggccgcattacgagagggccagctccctacgcagggcgtttggaagcggcggctgctgccttctccctgcacgccaagttcaccaacaaggcgtacccgggctttggcaagctggatcggccttgcttgccggccaatgactgatactgagcctgcttaattcgcgtcaagatgatgtgc

SEQ ID NO: 1056 - DNA, 387 bp, Zea mays
  Clone ID: LIB3227-015-P1-K1-E7
caacattcggttcaattggcgggctcgtgtcaaaattgcagttggcattgcctggggacttgcatttctccatgaggaaatccgtcctcacattatccatagggacataaaggcaagcaacattcttcttgacaaggacctgaccccgaaaatttccgatttcgggttggcaaggctcctaccacccaacgcgacgcatgtgagcaccctagtagcaggcacattatgatacttggctcctgaatacgcaatccgtggtcaagtgacaaagaaatccgatatctatagttatggggttcttcttttagaaattggtagtgggagatgcaacaccaacacaagattacctagtggagatcaattcctccttgagaggacatgggcact

SEQ ID NO: 1057 - DNA, 309 bp, Zea mays
  Clone ID: LIB3227-015-P1-K1-E9
agctcccacacccttctgaggcatctgggaggaccttccaagaagccgaggcgaggaatggtggaatcatgagggtctcttgggactccggcaagctgttgcctgtagtgtagcaaggcagaaacttttcgtcaggttgctgtataccgctaggcacaaggtgagcagagggagcctttggtttaaggcgagagactggatcatgggattcttgggggcctaagtaacactgttaaaacctgtggttaactgtggtgtatccatcaactaattgtctcaagcaatgcaggtagagtagttactaatttt

SEQ ID NO: 1058 - DNA, 265 bp, Zea mays
  Clone ID: LIB3227-015-P1-K1-F1
tccgaaaaaaaaaaaaaaaaaaaacgatccataataatttttccaacaaacaatatcaataaaaggggggaaaataaaaaggggggcggggaaatcgggcttccattttaaaggatccaaatttacatactcgtggctgcgaagaccttggttttttattaatttcaccctaaatttaatcaacatttcccctttttttttaaaaacgtcttcatacttgaaaaaaacccctgggccctttccccaacattaaattatctttttt

SEQ ID NO: 1059 - DNA, 402 bp, Zea mays
  Clone ID: LIB3227-015-P1-K1-F2
gcagaagcgatgaaccagtcttggtccagaccagcagcagtaaggagcaatgcaggaaatgatcttgccaacgacctgaacccccgtgtacctgaccttgccgagaagctgtctcagttgtcaatgggccccaacagggtgtcgggtttgggttccgagaggtttgttagaacccatgagaacgctgccaagcgccccttgcccgtgggatccagggcgtggcatggtccagctgaccccttccggcgcccatacgagatgccaggtgatagaactctccttccaaggaatctcgttcgctgaggctgaagctcttcgcaagaaacatatccaacgctcgctctcttcggagctactcttccccggctatttacctcgcaacaataaataaacaaccaaact

SEQ ID NO: 1060 - DNA, 314 bp, Zea mays
  Clone ID: LIB3227-015-P1-K1-F3
aaactcccctggcgggtggctaatctcaggaatggcgatttttggtgcaattcaggcggggggacctgatatataggcaatatgcctctgaatatccttgtccatgggctgcttaattttgattggaggagaacccaccatacgtttagcattccctcacgctaggataatactttaccaacctcctaatgcttattattgggcaaggacaccagaatttttactagaagtggaagagttacacaaagttcatgaaatgagcacaagggtttatgcccttaaaacaggcaaagctttttgtgttgtattctaag

SEQ ID NO: 1061 - DNA, 351 bp, Zea mays
  Clone ID: LIB3227-015-P1-K1-F4
ccaccatcacctcccgcgagatccagacctcggtgcgcctcgtcctccccggcgggggggccaagcacgccgtgttcgagggcactaatgccggtacgaagttcacctcgtcttaggatccttgtaatggtcatgtgggcgtcggcggtaggcgtggctcagtttatgtgatactgctagcgatggatgatgatgatctgcgtgtaattgaattaaagaattgtgctgatctttctacaaataaaaagaataagagactttgtagttgttattagttattatctagtagtgggggtgtggggtaatttatagttattgtgtggggtttactttataaaggggggggccttt

SEQ ID NO: 1062 - DNA, 96 bp, Zea mays
  Clone ID: LIB3227-015-P1-K1-F6
atctcagttgctgcgctggctacccttccctgcgggggtattttacgggagggcgggccaaccagagccaaggaaaagcattgcttcttccaaact

SEQ ID NO: 1063 - DNA, 406 bp, Zea mays
  Clone ID: LIB3227-015-P1-K1-F7
cgcgtccgattcttaagaaggaagggcccaagtccctgttcaagggggctggtgctaacattgggtcgtgccattggtggtgctggtgtgctttctggctatgaccagctccagatcctcttcttcggaaagaaggacggctccggcggtgcttaaatggagaaatatgatgacgaacaagagcagtgtgtgttcccggtcctttccaatcaggatctggtgaaggttttgcctttcatatcgaagaaattaataattcatgtggagggaggattcttccaacaatttgttttggatggagacttatatctccaaacactcggaactatcctactaggtggggacatcggtccccaaaaacatttatgggcatagaggctggccttctgttggcagtcgggcaatt

SEQ ID NO: 1064 - DNA, 332 bp, Zea mays
  unsure (1)..(332): unsure at all n locations; Clone ID: LIB3227-015-P1-K1-F9
ctgttggataacactgccagaatagagggatggttagctcggtttcctatgtttggcgtgggttngtggtgggacttcaaaaatgtcagctgttggtttacttccagctgcattgcagggtattgatatcaaggaaatgctagttggtgcagctttaatggatgaggaaacccggaacactgtggttaaagcaaatccagcagcattgcttgcattatgttggtattgggcatcggaagggataggcaaaaaggatatgggtgtgcttccttataaggataggttggtacttttgaggagatatttgcaacaacttttcatggaatctcttt

SEQ ID NO: 1065 - DNA, 398 bp, Zea mays
  Clone ID: LIB3227-015-P1-K1-G12
aaaacaatgacggtcagattgattatagtgagtttgccgcgatgatgagaaagggcaatgctggcggagcaggacggcggaccatgaggaacagcttgcatgtgaatcttggcgagctcctgaagcccaccgagacctagttttttttaaccagaggatcctgcttcccagatgcgccccatctgaaacttaccgtgtgcctcatccgctttcacagatcgattagttgatctctagtagcagcgccaaaagcagtttaagattttctcagtggtactagtagtgaggggaaaatagcatcctgtggtgccagtgagagattttaggcgctgaagacgacgtgctatgctactccggagtcctgttgtcttcttcttcttcttgttgttggtgatttc

SEQ ID NO: 1066 - DNA, 315 bp, Zea mays
  Clone ID: LIB3227-015-P1-K1-G2
ggaagaggcattatccttggacccacactgctgtagcactttaacatacccatacagcctagaagacggttcaaggaagccacacggaaagttgaagctggagaaaataccaagaaaccaagtagagaaaaaaaaactttggtttctggaggcgtattatttctgaaacagaaaacttgatgtgagcgactgatcctgagccaatggaacagtatgaattatatgggttgaacatggtaggtgtaccaagttttgttcatcgcagagtatcccagatgtgatcgggttaaaaaaaaaaatggggtaattattaat

SEQ ID NO: 1067 - DNA, 390 bp, Zea mays
  Clone ID: LIB3227-015-P1-K1-G4
atttcttcttctacgtgcactcggagacccgcgacatctgcggagagacttcctgggcggcgaccggcgacttcgtgctgtcccaccagcagacgctgccaggcttcactccgccgggctcctacacgatctacatgaagattgtcggggacgacaacgaggagctgagctgcatctcgttcgggttcagcatcggcttcgtcgcgtgcagctgaacgcgtccgagcctgggcacgagaggcagccagcccatggatgtaaattacgtggagcacactctgtatcctatgactttcaagtatctaggggcatgtaagctttttgtgggtgtctgtggtcaactgagacggttttatccgggggtggacattacaataaagcaaaggcact

SEQ ID NO: 1068 - DNA, 284 bp, Zea mays
  Clone ID: LIB3227-015-P1-K1-G5
ctcaaaactgctggggtaagaagggaggggccttcaccggggaagtcaatgctggggggcgcgtcaaccggggggggccctgggtcattcttggacactctgaaaggagagctctgctgggagaaacaaaagaatctggtggagacaagggggcgtatgccctggctcagggactaaagggcattgcatggggtggggagacacatgagcaaagggaggccggggctaccatggagggaggtgccgcacaaacaaaagcaattgctgagaagatcaaggaccgg

SEQ ID NO: 1069 - DNA, 389 bp, Zea mays
  Clone ID: LIB3227-015-P1-K1-G6
cgcgcatgctgtattgtaatgctgtagattccgacttcgcaattgcaactgttgcgtgcgcttttggtcagggatgatgcctttcgctgcaacagttgaggctccagttcaatatttgaagataaatccggtcccttcttgctagggatgggcatgggtacctgatacccgttcggtaaaaaccgtattagagcacatgtgatcatttgttatacccctcgggtatggtagtcatgggtatgttctttcttgccatatatatgttctttcttgccatatatctgctactagatagaaaacctgctcacatgacacgtcttttatattaaatattaaatattggacaattagggtactacccttctgaaaaaaatcgcactattgtttag

SEQ ID NO: 1070 - DNA, 379 bp, Zea mays
  Clone ID: LIB3227-015-P1-K1-G7
tgaggatattgctgcggttgctcttgctcttaggttggatggcctgattatatcggacaccacagtttccagaccatcgcctgcagataaacatccattggctcaggaaactggtggattaagtgggaagcctttgttggacttatctactaacattctcagggacatgtatatgcttacacggggcaagattcccctcataggatgtggtggcgtgagcagcggtgaggatgcatacaagaagatccgttccggagctacacttgttcaactttatactgctcttgcatatggtggtccagctcttatacccagaataaaggctgagctagcaaaatgtttggaaagagacggtttaaatctgtccaagaagcggtcg

SEQ ID NO: 1071 - DNA, 227 bp, Zea mays
  Clone ID: LIB3227-015-P1-K1-G9
atagccccctaggttcttttcagaaaaaaatattatggaaaggtagcatactttttgtcctttggtgtcacccctctccattatgcctggtggatcatatccatttgaaaattctgaggatccaatgaactttccgtaaacaatcagcataattctttgcgttcaatacttcatcccggattatgtgagagtgtctttatactgcataccccttttttcttatatat

SEQ ID NO: 1072 - DNA, 406 bp, Zea mays
  Clone ID: LIB3227-015-P1-K1-H3
tacgagatcacgttcctcacccagctccccaaagacctcacgtgcagcggcggcaagtcgcgccatcgaggtggccaactatatccagaagacgctcagcggacagcttggcttcgagtgcacgtccatcacgcgcaaggagaagtacggcatgctcgctggcaccgacggccgtgtcccgtccaagaacaaggagaaggagaaggagaaggagaaggataagaactaacggccaacgtcgctctcttgctgctgcccagcagactgccgtttaattactgctcaaatttattccaatttattgttccttgtcgacaagttggccagtgtgatgtgggccgcgtactaatacaagcttgatgatgattagtatatctacaattcttccttttcggaagaagggcgg

SEQ ID NO: 1073 - DNA, 281 bp, Zea mays
  Clone ID: LIB3227-015-P1-K1-H5
tcgcacgccgaggtcgaggtcgaggtctcagcaaggaggatggaaacggagcaacaggggggggttgcgggggggaaggcgacccttgccaaagggacgccctcggcgtctttccggctccgcaacgggagcctaaacgcggtgcgcctccgccgcgtgttcgacctgttcgaccgcaacggggacggcgagatcactgtggacgagctggcgcaagcgctggacacgcttggccttgacgcggaccgcggggggctggccggcaccgttggcacctacgt

SEQ ID NO: 1074 - DNA, 397 bp, Zea mays
  Clone ID: LIB3227-015-P1-K1-H6
ctgcagagaagacaattgagctatcgtaaattcagactgcggtgtccaaactgcgggtaggttgtgtttcagggtgctttttaaagtgtgaatcacagttgagaggtgagactgactgaatatcagtggcagcatcaatggaagtcatggtatcagcagccgctgtgtagattacccaaaagtactggtacgtggtgactttttgtacagtgaattcttgaagaaaaaaaacggggttctagcatggcgacgtttgggcgctggacacaggattccaggaatagttcgagcctttcaggccaccgtttctgagcaagaagcgtttttggttctgcaatctgcatgttggaggcatcaaaccagcaaatggatcacaggggcacaaatcgggaacaac

SEQ ID NO: 1075 - DNA, 397 bp, Zea mays
  Clone ID: LIB3227-015-P1-K1-H8
caaactgttacaaatctgagcatctcaagagaccagagaactgggcactagttgggaaggcaaaatacatctacattgcttgatttttcctcacggtgtcacctgattctatccagttagttgctgagcatgctgcggcaaataacaaggtgttcctgatgaacctctctgctcccttcatctgtgagtttttctgtgatgcccaagagaaggtcctcccgtatgctgacttcatcttcggcaatgaaaccgaggcaaaaatctttcccaaagttcgaagatgggagacagagaatgtcgaggagattgctttgaaaatctctcagctttctttggcttcaggcaagcaaaaaaagactgctgtgattactcatggcgctgatccagtggttggtgg

SEQ ID NO: 1076 - DNA, 317 bp, Zea mays
  Clone ID: LIB3227-017-P1-K1-A11
ggtgagttgaagcttccaagccgttaccttgtttccccaccagagatagatagaacatctggggagtacttggtgaagaatggcatccgcacctttgcttgcagtgagacagttaaatttggccatgtcacatttttctggaacggtaaccgttcgggatactttgatgcaactaaagaggagtatgtagaagtaccctatggccagtggatttacattaaatgttgcacccaatttgaaggcccttgaaattgctgaaaaagccagggttcctttcctaagtggaaagttggaccaggtccttttaaacctgccaa

SEQ ID NO: 1077 - DNA, 397 bp, Zea mays
  Clone ID: LIB3227-017-P1-K1-A12
tccacctagtggaccaaaccttaaatttgacttgctaaaggaccttcgtgcattaacattaaagaaaggagttagcttggttctccatggagcatctggtctatctcatgagctcgtaaaggagtgcatagacttgggcgtgagaaaattcaatgtgaacactgaggttcggaacagctacctggcgtccctcagaaagccagaaaaggacttgattcaggtgatggcgtctgctaaagaggcaatgaaagctgttgtagcagagaagctgcgcctgtttggatcatgtgggaaagcctgagcgaagtacttgcgttgcgccggcaacatgcagtacaagaccgactgcatcatcgggttcgtgatgctgctgctactgtgcagttgcttacggata

SEQ ID NO: 1078 - DNA, 334 bp, Zea mays
  Clone ID: LIB3227-017-P1-K1-A3
gtcgcatctttacagcgtataatcgttttccattgctcctactcctatcatccagaaaatctgagcggtattgatggcgcccaaggcggataatatgccgtcggacttaaaggtgctgaaggaggagccctcggagaaggcggctccggcggagaaggcccccgcggggaagaagcccaaggcggagaagcggatacctgcggtcaagtccgacggcaaggagggcggcgacaagaagggtaggaagaatgcgaataaaagcgtggagacctacaagatctacatttttaagggtcctgaacaaggtgcaccccggacatcgggatttttcttc

SEQ ID NO: 1079 - DNA, 337 bp, Zea mays
  Clone ID: LIB3227-017-P1-K1-A5
ggctgcggtcttccactacggatcaataagcttgattgctgagccttgccggacagcacatctccgtgccatggagattgccaaagaggcaggtgcactgctctcttatgacccaaacctgagggaggcactatggccatcccgtgaggaggcccgcacccagatcttgagcatctgggaccaggcagacattgtcaaggtcagcgaagtcgagctcgagttcttgacaggcatcgactcggtggaggacgatgttgtcatgaagctgtggcggcctaccatgaagctgctcctagtgactcttggagatcaagggtgcaagtactatgccaggggg

SEQ ID NO: 1080 - DNA, 402 bp, Zea mays
  Clone ID: LIB3227-017-P1-K1-A6
ccgcacactcccaattcccctcgagcgccgcagcgagcccaagaagccgaccgccgagccccctctccagtccagtccgcggtctcggtttcttgcttgcccggcgcccaatcttcagagagagctccttctcgtcgtctgtctccatggccgcctcgaccaagaccgtcgccgtcctcctcgccgcggtgctcctcgcgctggtcgcgtccgcggcagccagcaggaagctggaggaggacgcacttctgggaagcctggccccagcccccgcgccggccgttggcggtgccgcggggctgcctggcggcaagccgggggcgtgggccgtcgccgctctggtctctctcgtcgccttcctcgtgatctgagggcgtggggatcgtgctgcgcatcgcggga

SEQ ID NO: 1081 - DNA, 344 bp, Zea mays
  unsure (1)..(344): unsure at all n locations; Clone ID: LIB3227-017-P1-K1-A8
cccacgcgtccgcgtgaccgttgaggagctgccggccaatgtcgccgaccttctctagatagtatggctgctaaggtttctggataaaggagtttgtttttgttaaaatacgccaacttttctctgctttggatgagtggtaaggtccggggtctgttcgtattgtggcgaaggatgggttttaagtttattttgtcgtatgcaacgtttcggaatttttgtagcgagtaggctacgcgccgctcctgggctagctgggtgctgagacactactgaagtatttccaccttagctggggggctaaaaaaaaaaaaannnanantaaaaaatataaaaaaaataaa

SEQ ID NO: 1082 - DNA, 395 bp, Zea mays
  Clone ID: LIB3227-017-P1-K1-A9
caatgatgctgtcaatgggtttccagatgatggttggtcactgatgagcagtgacggtgctgaggatgttactattgctatcaactcttctccaaacaaacttattggtcctcatgtcaactcctcccagctgtttactgcaattggaggaggtatcctgtgtgctaaggcatcaatgctgcttcagaatgtgccacctgccctactagtacggtttctgagggagcatcgctccgaatgggctgatcctggtgttgatgcttattccgctgctgctttgagggctagtccatatgcagttcctggtttgcgtgctagtgggtttacgggcagccaggttattctgccgcttgcacataccttagagcatgaggagttcttagaggttattaggc

SEQ ID NO: 1083 - DNA, 404 bp, Zea mays
  Clone ID: LIB3227-017-P1-K1-B1
ctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagct

SEQ ID NO: 1084 - DNA, 382 bp, Zea mays
  Clone ID: LIB3227-017-P1-K1-B11
ccggaggcgaaggctctcctggaagcggcactgatggacgccaatagggagagggaggagaagatcctcaagggcatcaccaagtatccgcaggcatcgcctacttcgccttgcgagcacgatgccattgacgaagcgtcctcggaggccagcgacgcggagctgtgctgcatctgcttcgagcaggcgtgcagcatcgaggtgcaggactgcgggcaccagatgtgcgcggcgtgcacgctggcgctgtgctgccacagcaagccgaacccggcgacgctgacgccgccgtcgccggcctgcccgttctgccgcggcagcatctcgaggctggtggtggcccgggcgagccccgacgccgatgacgacaaggccgccgccg

SEQ ID NO: 1085 - DNA, 404 bp, Zea mays
  Clone ID: LIB3227-017-P1-K1-B12
tctcactctccggcggcgggagcccgtggctccgcttcccgccttcccggctcttctccgcggaggccttcgtctcccattccgatgacgacgacgctgggggcgagggcggcggcgggggccggatcatcgaggcacggtccggggtgatgggccccacctcgcggcgcaccggcgtcatcggcgtcaagtgcgggatgtcggcgatgtgggacaagtggggcgccaaggtgcccatcaccgtcctctgggtcgacgacaacgttgttacccaggtcaagaccgccgagaaggagggtttcttcgccctacagcttggagcaggtcaaaagaaggaaaaacacctaacaaagcctgaagttggccactttagagcacagggagtgcctctgaaaagaaagcta

SEQ ID NO: 1086 - DNA, 399 bp, Zea mays
  Clone ID: LIB3227-017-P1-K1-B2
tgcttccattctgttcaagttagcgccgctaatccgctccctattcaccatccaatccaatcggcttcccccaggcacccatggcgacggcggtggaggttcccgtggaggcgccggtgaggacagtgaaggtcaccaatgtctctcttagtgcaactgtgcaagacattaaggagttcttttccttttcaggagatattgatcatgtggagatgcagagtggtgatgagtggtcccaagttgcatatgtcactttcaaagatgcacaaggcgcagaaacagcacttcttctttcgggtgccacaatagttgatctttctgtcatcattgcacctgctccagagtatcagccaccttctactgcctctgctccaccaatgagtggaaccagagttccag

SEQ ID NO: 1087 - DNA, 402 bp, Zea mays
  Clone ID: LIB3227-017-P1-K1-B4
gattcatctatttttgttatcgaggaagaaacggggaaacttttgaaccccaacccagttcagacagacaaaccctctaaagccatccttctgcagatgttggagttatcgcccaatgacacaccagcagtttcagataaccaagatacagtatcgaaggaatcattgctgctactttgcactgaaaatgcgatccgtttgttttccttgggccacgcaattcagggcacaaagaagataatcaataagaagaaattgagcagctgttgttgtttcgcctctcttattcatagttcttctaatgacattggacttatactcgtcttctccaatgggaaacttgaaataagatccctgccagacttgtccttgttgaaggatgcctttttacgaggttttgtg

SEQ ID NO: 1088 - DNA, 403 bp, Zea mays
  Clone ID: LIB3227-017-P1-K1-B5
caccaagccggcgatccgcaggttggcgaggaggggcggcgtcaagcgcatctccgggctcatctacgaggagacccgcggcgtgctcaagatcttgctagagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcggtggcggtcgtgttgtgttcttggtctagttagtctgtgttgtctttatcggtgctgttttctgtggtggttgtactgcatcgttctagtttctagtccatgtgctgtaatatctcgctgctgtaatcaatggaatgtcctcgt

SEQ ID NO: 1089 - DNA, 316 bp, Zea mays
  unsure (1)..(316): unsure at all n locations; Clone ID: LIB3227-017-P1-K1-B6
naaaaaaaaaaaaaaaaaaaaaaaaaaataataaataaaaaatagttaaaaaaatagagagaaaaaaataaaggggtgcccgttcttgggggtgcaagttttcgatgctcaaaggctgccgaaatcataagcttccaaatagttgaaccctaaattaattacactgaacttcatttaactgccccactactgaaaaatccctgccgttacaaaccttgatatcccccaagtaaatccctttttccccaattctcttttttccgaagaggcccacacctaaaaccctttaaaaaattcccaaaacaaaaatgcctaa

SEQ ID NO: 1090 - DNA, 400 bp, Zea mays
  Clone ID: LIB3227-017-P1-K1-B7
cggctaggtaatctggtggtacgacgactgacgacgacatggcggccaccagcagcaagtcgtcgtcgtcctcgagctcggcgcagcgggcagcagctgccgccctgctcgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgactgctagcagtgtgctagccaagccaagcc

SEQ ID NO: 1091 - DNA, 397 bp, Zea mays
  Clone ID: LIB3227-017-P1-K1-B9
gttggaagtgccgccctaaagatggtggaggaggtccgcagacagttcaacaccattcctgggttgatggagggaactgccaagcctgactatgcaacctgtgtgaagatctccactgatgcttccatcaaggagatgattcctcctggtgctctggtcatgctcactcccctcattgttggaaccctcttcggtgttgagactctctctggtgttcttgccggtgccctggtttctggagtgcagattgccatctctgcttccaacaccggtggtgcatgggacaatgctaagaagtacattgaggctggtgccagcgagcatgccaggaccctcggccccaagggatctgactgccacaaggctgctgtgataggtgacaccattggtgaccccc

SEQ ID NO: 1092 - DNA, 66 bp, Zea mays
  Clone ID: LIB3227-017-P1-K1-C1
aaaaaaaaaaaaaaaaaaaaaaaaaaaaaaaaaaaaaaaaaaaaaaaaaaaaaaaaaaaaaaaaaa

SEQ ID NO: 1093 - DNA, 407 bp, Zea mays
  Clone ID: LIB3227-017-P1-K1-C10
agcaaccaccgcctccccgatctcgtcgagaggaagcccaatcccgaaaccgtcgccgtattccaatggcgcccaaggccgagaagaagcccgccgccaagaagcctgcggaggaggagccggcggcggagaaggccacggcggggaagaagcccaaggccgagaagcggctccccgcgggcaagtccgcaggcaaggagggtggcgagaagaaggggaagaagaaggcaaagaagtcggtggagacgtacaagatctacatctttaaggtgctgaagcaggtgcacccggacattggcatctcgtccaaggccatgtccatcatgaactccttcatcaacgacatcttcgagaagctggcggcggaggcggccaagctggcgcggtacaacaagaagcctaccatt

SEQ ID NO: 1094 - DNA, 331 bp, Zea mays
  Clone ID: LIB3227-017-P1-K1-C11
aaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaaaaaaaggggcccctttggaattttaaaattttttatttggtgggcggcctttttagggtttcaaagtttatttacacttgtttgaatgttaatactttttttttagggaacttaattttaatttaattggccccctttttaaacggttggggtttgaaaaaaccttgggtttaccaaatttattcctttgggagaaattcccttttt

SEQ ID NO: 1095 - DNA, 402 bp, Zea mays
  Clone ID: LIB3227-017-P1-K1-C12
cctcgctctcgcactcccactcagacacgcggacgccggagtcggagatcgacgacgacccgttcccggagctggcctcgctgccggcactcgacgacatgatgggcccagcagcagcagcgcctgccggcgccatcttgcccaaggaggaggtggaagacttgggcggcctcggcggcgacgactggctcgcgggcatcaacctcgacgacctgcagatcccgggcgaggccgacttttatggctccatgctcgtgtcgccgatggccgccaagatggagcaggacgccgccggcttcccgttcttctgagaccttctgcgcaacgcaaactgtgtatagttcagatttcttcaggattcggagaaaaaaacagttctgctgatatctggttgtagtggtt

SEQ ID NO: 1096 - DNA, 401 bp, Zea mays
  unsure (1)..(401): unsure at all n locations; Clone ID: LIB3227-017-P1-K1-C2
ctggcagcatctacgagcactgggatattcttccccctaagaaaatcaaggacccagaggctaagaagcctgaggactgggatgacaaggagtacattcctgaccctgaggacaagaagccagagggctatgatgatattccgaaggaaattcctgaccctgatgctaagaagcctgaggactgngacgatgaggaagatggtgaatggactgcccctaccattcccaacccagaatacaagggaccatggaaacaaaagaaaatcaagaacccgaactaccagggtaaatggaaggcacctatgattgacaacccagattttaaggatgatccatacatttacgccttcgacagcttgaagtacattagcattgaactgtggcaggttaaatcgggcact

SEQ ID NO: 1097 - DNA, 400 bp, Zea mays
  Clone ID: LIB3227-017-P1-K1-C3
agcactctggtgaagctcgaagagagtgaccacatacgccatggtagccacacatgctccatctgccggtaccctatcattgggtcacggtttaaggaaacaaaacactcattcagcctgtgcaaccggtgctacagtgaagggaaggttccttcggccttcaagttggaggagtacaggttcaaagaatacggtaacgagtcagaggccctcattgataagtgcatgtgcttcaatttacattctaagaagctggaaaccgatgcctgatcattcaaacttggatctcaagtgctcaaagcatgaatctgtgtatttcctaggtgcaaagatgtctagtcagctctcccactctcttgtaaacaaaggtgccgtcattcggagtttctctaaatgtgtc

SEQ ID NO: 1098 - DNA, 380 bp, Zea mays
  Clone ID: LIB3227-017-P1-K1-C4
ctctttcaggggatcgccaacagactggtgaaggctgccttgaaggaggcagccaggaagagggaggtcaggtaccgtgacttgaggacgatcgacaagggagtgaggcggcatttccatgacgacatcagcgtcgtcgtggtcttccttgatcgccaccgtgagcgccgccacactagggtcgttgactcgagtagcaactgcatcagtgctcccgtcgacatatactcctccaacacacaccagtctgcggagcccttgcacggttaaaagagctgaactctggctagagtagaagactggggtttgccttgcgctctcctgctggtgaacggtggagttgtagagctgagggactgcagtgccatagccataggagg

SEQ ID NO: 1099 - DNA, 406 bp, Zea mays
  Clone ID: LIB3227-017-P1-K1-C5
atcctgacgaccctgatgcatattataattgggctctagtcctccaggagagcgcagacaatgtggatcccaattcgagttcctctaaagatgcattgctggaggaggcttgcaaaaagtatgctgaagctacccgacttagtccaactctttatgatgcatattataactgggctattgctattgctgatcgggctaaaatgcgaggtcggacaaaagaagccgaagaactctggaagcaggcaatactgaattatgagaaggctgtccagcttaattggaatagcccacaggctctcaataactggggtcttgggctacaggagctgagtgcaattgttcctgcccgggataaacacaccatcataaaaacagctatcagtaagttccgtgctgcaattcagct

SEQ ID NO: 1100 - DNA, 397 bp, Zea mays
  Clone ID: LIB3227-017-P1-K1-C6
gttgcattgtcctctggtagccagggtcagaaattagattcagttctagcaaaacctttgaagactcaagcttttgcttctcctgataaagttgctgagctagttcagaaggttgccgctgccattcaacaagatttgcccaaagtaatgaccaagatgaggttgtatttgcaaaatccatctactcggatgatcttattcaaacctatcaagacaaatatagttgaggctcatatacagctgcattcccttctgaagtcggagtactctagtgaagaaatgcaatccatcggtatgttgccgatacctgacctgcagtctcagcttgacagccttttgtagtttgcatacaccatacagcggcgctgctgtagtccatgttgacgttgcagtgcag

SEQ ID NO: 1101 - DNA, 393 bp, Zea mays
  Clone ID: LIB3227-017-P1-K1-C7
tgtgaacaagaagttcagcaaccagtacaaggctacgattggggcggatttcctcaccaaggaggtgcagttcgaggacaggctcttcactctgcaaatatgggacactgctggtcaggaaaggtttcagagtcttggcgttgcattctaccggggagcagattgttgtgtcctagtctatgatgttaattctatgaaatcgtttgataatcttcacaactggcgtgaagagtttctaattcaggcgagcccatcagatcctgacaatttcccttttgttctgttgggtaacaaagttgatgtagatggtgggaacagccgtgtggtgtcggagaaaaaggcaaaggcatggtgcgcctctaaagggaacatcccgtactttgagacgtctgc

SEQ ID NO: 1102 - DNA, 398 bp, Zea mays
  Clone ID: LIB3227-017-P1-K1-C8
cgagactacgtcgctggtgcagatcgagggggtgaacaccaaggaggacgtcgcgtggtactgcgggaagcggatggcctacatctacaaggccaagaccaagagcagcggcacccactaccgctgcatctggggcaaggtcgcccgcccgcatggcaactccggcgtcgtccgcgccaagttcaggtccaacctgccgccggaatccatgggccgtaaggtcagggtgttcatgtaccccagcagcatctaaagataatctgaatgtgtggaggacccttttcttctagattttatcttcagctgtccttgtaagggttgtgttcaggttgagagttagcaggttgagctgtctatctgagaaccatttaaagttctctgagttttggtgttatgga

SEQ ID NO: 1103 - DNA, 376 bp, Zea mays
  Clone ID: LIB3227-017-P1-K1-C9
tataatcgtatggtttgaagttcatgtaacttaaaatccaaaggaaatcctataacttcaactcaaagtatgaaagtttaaacatattccaaatttataaaacatgaatctagaactaatataacattatactataacagacttaagatgggggcgcttggcttcgattgaagctcaacggctgacagaggagactattattttcttccctcgatctcttcatattgtccatggtctcctttgacgcctgtgcctgagcctttaaggtgtctacttatccctgaaggccatggctctgtagcctatggggaccccgatcgattatgaagagatcgggggaggaaactaatggtctcctcggtcggccgtggggctc

SEQ ID NO: 1104 - DNA, 399 bp, Zea mays
  Clone ID: LIB3227-017-P1-K1-D1
gccatgttctctgggacaccctttatgttggtgatactgcatcaaacagggtggaggtactgttgagggaacttgaccctgtccttgagacgatatctggtatggtgcacaacaaagtgcggaaccgtgctattactgcactgatgaaagcaacttttgatggtttattgctggtgcttcttgctggtgggcctttgcgtgctttcacccgccaagactctcagataatagaagatgacttcagggccctcagagatctgtatttagcagacggggatggtttgccagaggaattagttgacaaagcatcctcccaggtcaagaatgtcctacccctcttccgagcagactctgaaagtctcattgagcgattcagacgcatgatggttgaatctaatc

SEQ ID NO: 1105 - DNA, 388 bp, Zea mays
  Clone ID: LIB3227-017-P1-K1-D10
gccagggagaagaagcaaaaggtgaagaagaccgagggcgagctttttgagacagaaaaggaggcatccaagtcactgcctgacttcaagaaggatgaccagaaggctgtggattctgctctgatcaaggctatcgaggctgtcccggagctgaaaacctatcttggcgcccggttctctctcagggatggtgacaagccccatgagatggtcttctaagctcttagttttggagttcggaggaagctgttttgtctgtgatcttgtacttctgagttttgtaccagtagcgaatgtttcattgtggttgaagtcttcctgccaaatattataagatctaagaaagttctatccgtgttggtggttcaaaaaaaaaaaaaaagggcgg

SEQ ID NO: 1106 - DNA, 221 bp, Zea mays
  Clone ID: LIB3227-017-P1-K1-D11
aaaaaacattttagacaatttgggtcaccctgtttgaacagggtgcaaccacgtctcattattttcgttcttatggtgtcggtatggaatgcctaggtgtttagctgtgcacaaataacagttaaactttgacggctcctatttcaactgctggagaaatgccagtgccctatttttgaccaccagggtgtggaatggaaatcggtaatgcatccattttg

SEQ ID NO: 1107 - DNA, 397 bp, Zea mays
  Clone ID: LIB3227-017-P1-K1-D12
atgaacttatgttgacatcaaaaaatatgcaggttttatgtagcagaggtgcttgttgctctggaatacctgcacatgcttggtatcatataccgtgacttaaagccagagaatgttcttgtgagggaagatggacatatcatgctgtcggatttcgatttatccctccgatgtgctgtgagccctactcttctcagatcttctaaccccagtggggataaccaaaagggcaacccagcttactgtgtgcagcctgtgtgcattgagcctgcctgtatgcagccttcttgtgtcacgacaaccacatgcttctctcctcgctttttctcttccaaatccaaggagaaaaaagataaaaaggcaaaggcagacttggcaaatcaggtcagaccacttc

SEQ ID NO: 1108 - DNA, 400 bp, Zea mays
  Clone ID: LIB3227-017-P1-K1-D2
gtcgtgggatcccagccaccgccgctagaagaagagctcggcgattcccaggtcccgcgagaagatgccgaagcagatccatgagattaaggacttcctcctcaccgcgaggaggaaggatgcccgctcagtgaagatcaagaggagcaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgtcgggttgaactaccaaagcttctttatcagtagcagagtatgctactctatgtacttttggaacctaagctattagacctgtcagtgttggatgtgtggatcttgcat

SEQ ID NO: 1109 - DNA, 354 bp, Zea mays
  Clone ID: LIB3227-017-P1-K1-D4
cgacgctcgcgttctatgtctttactgggtacaagttccggcctgaggtgcataacccatactttgccattgatgatgaggaagaggaggctgcagctgaggcgctaaagttggatgatgaattcgagctatgattgaggggttaggaattggcatatcctccgtgccagtggtgatattggtgttgtatgtcccagcagaggacaagtggcatagactggtacctagtccatatccttttgtttctccttttgagttggttacattttatcttaatgtaattgggtagtgacaacaaccctgtgtctgttaagcaatgcagtttggctttgccttaaattttatacacatatt

SEQ ID NO: 1110 - DNA, 359 bp, Zea mays
  Clone ID: LIB3227-017-P1-K1-D5
atggactatggacatgtgttgcgctgttcaacttactactaaaaaaaaaaaaaaaaaaaaaaaaaaaaaaaaaaaaaaaaaaaaaaaaaaaaaaaaaaaatgaccagaaggctgtgagaattctgctctgatcaaggctatcgaggctgtcccggagctgaaaacctatcttggcgcccggttctctctcagggatggtgacaagccccatgagatggtcttctaagctcttagttttggagttcggaggaagctgttttgtctgagatcttgtacttctgagttttgtaccagtagcgaatgtttcattgtggttgaagtcttcctgccaaatattataagatctaagaaagttctat

SEQ ID NO: 1111 - DNA, 226 bp, Zea mays
  Clone ID: LIB3227-017-P1-K1-D6
gtcagttcctcttcaaaataatactttaacaataattaacgccatcatacaacaacatgcatccatatgactagtaaatatttaactacagttaactactactacgccatcatagtaagaaacgagtgctccctctactttagttgaatatttactagtcatatggatgcatgtgtgtatgatggcgtcaattattgttaaagtattattctgaagaggaactgac

SEQ ID NO: 1112 - DNA, 395 bp, Zea mays
  unsure (1)..(395): unsure at all n locations; Clone ID: LIB3227-017-P1-K1-D7
ccagaaatcataggatcccgagggcgtggagagactctggtgaccgggagacttatatcgtaccattgtgaggataacctagctgcacatctgcgccttcctgagatacagaaaaaaaatgtaccagaatgtttctgttagttttctgattgttgtgcgatgaatgattaggctgttctgttttcatagcaagggcgagtagccttagttggggctgttacccagtgacccctttgtgtgaacgagtagtcaatgttattagtccggaccctttggctactggtccttctggtccaaagcaaaacgtaccgttactgctcaaaaaaaaaaaaaatttatnnntttaaaaaaaaaaaaaaaaaaataaaataaaaaataaaatatataaaatataa

SEQ ID NO: 1113 - DNA, 394 bp, Zea mays
  Clone ID: LIB3227-017-P1-K1-D9
gaaagcatggcggtcaccagggtatcaattatacagacaggtttcggacagtaaaattccatctctcagatctcttaatgagataaggtctcctgaaggaaggcctccctcttccatgttatcagcctgcagcaatgacttgtcagcagcaggatcctatggtgagtcatccgatggttggtcaatgcgcacattttctgaaatggtctcaacatcccaaagagagaggtggtcacttgacagtgagctctcgggatccatttctagtaaaatgacaagatcaagtgcttggagttctactacacgcccccctgaccaagacgtgtgcaagctgtgtttaaagctgctaaaggagagatcgacatggaacgctcaggagctggctgttgttgct

SEQ ID NO: 1114 - DNA, 398 bp, Zea mays
  Clone ID: LIB3227-017-P1-K1-E1
agacccaggagatttgcttgccggacttgagggatcctctggattgcagatatctgaagccctcaaactgcagatggaggtccaaaagcggctgcacgaacagttagaagtacaaaggcagctgcagttacgaattgaggctcagggaaagtacctccagaagatcatcgaagagcagcagcgcttaacaggtgtgaaatctgaaactcctgctggaggtgcttctgtcactgtatcaagtgatcaattcccagactcggagcggactgagccctccacacctgcaccagcatccgagtctccaactcaagttggtgcttccaatagggacactggagaccgaactgaagcaaccaagagcacctgtcatggtgattctctttcccgcaacgagccac

SEQ ID NO: 1115 - DNA, 399 bp, Zea mays
  Clone ID: LIB3227-017-P1-K1-E10
gcaatgtgacatcggcagggtcatctagcgtaaccacttcggagattggacctgaatattcaagcccggttgtgcaatgattttgctgatctttagctttttggctggaaacatactctagcagttgagaaaaacagggtgcctcaagaacgtacgaagattttggtgccttgcagtttttgtaagcttgcccttcccagactgattcaaggtggcactgcccctcgttgttattcaaggaattttggggctggcggggttgtttgtaagagcattgtaaaataacttgtttcattttttggtttctgtaacatgaatacatgacatgtgatagttgtatataagatctgtggactgggggcgtatcagcgcattctacacagctaagggttgcatagt

SEQ ID NO: 1116 - DNA, 381 bp, Zea mays
  Clone ID: LIB3227-017-P1-K1-E11
agccttccgggggttttggccccccaaaaggattttcctaggccggtgtggccatataatttgagcgggcggtcccttatatgaggtaagaattgatgaccagtcacagatcattttatgcgtctgttggagagggcagtcttcaaccctacttttttgagactccagcggcggcattaagatcttataaatggactgaggattggagttgggcatgtgctgagtctcagctataaatggactgacttcttaccaagtcgtgtgcgtgtgaatttgtggcaacggagttgccaacagtgcgtggtgcagacacgggagaggttggagtagctgtaacaggtttagcatggtttgattggattaaactagcgttgtagcaaa

SEQ ID NO: 1117 - DNA, 320 bp, Zea mays
  Clone ID: LIB3227-017-P1-K1-E12
caagaacaagcgcgccgacgcccatcctagcaccgaggccccctcgacgtcaagcaacacggcctctgcggacgttagcagtgcttctcagccggcagcgggcagtgcatgagcttatatatcaacaacaatggactaggatgtgagcttggggccgcgtagtagtccataagacttggtagaacagaccatgtgagtcagctcgatctgtggtggatcttctttacatgcgtgaaccagtacagtgtacatacaaatgtacaataatatgtactttgataaaccattacataagctattcaccttttttttctgatcca

SEQ ID NO: 1118 - DNA, 397 bp, Zea mays
  Clone ID: LIB3227-017-P1-K1-E2
gtacaactacaggctcgccgggcaagcgctgaacctgaacctggtgggcgacccggacctggtggcgagagaccccgtggtagccttcaagacggccatctggttctggatgacgccgcagtcgcccaagccctcgtgccacgccgtgatgaccggcgactggaggccctccgccaccgaccgcgccgcggggaggctccccggatacggcctgaccacgaacatcatcaacggtggtctagagtgcggcgaggaccgctccaccgacggcgccaaagccgccaaggaccgggtcggctactacaagaggtactgcggtatgctcggagtggggtacggggacaacatggcatgcgggagccagaagccttacggaggatgatgacactagtagctg

SEQ ID NO: 1119 - DNA, 396 bp, Zea mays
  Clone ID: LIB3227-017-P1-K1-E3
caagttgctaatgagtaaaattttggctttgcttttaaaaaatatgggttcaagttgttcctgacagatgccactgcacaaatggacgttgacacgttgtagtgatcacactgtcacgagagctgagcaaactacagcctgcaagagctacacgttgtagcctatactcctgccttgctataattttcttaattttcttttgttaatgagtgcagtttctctggctaatggtaaaaataatctattctacaggcatgcttgaccacatcatggtggagaatgcaagtgttaaagttgcattgaatcgcattgccgttgtgtctgtcctggatgcacataccctgtcagtgatgtcttatgaagcttggaggctcatacatctgtttctgttggctc

SEQ ID NO: 1120 - DNA, 367 bp, Zea mays
  Clone ID: LIB3227-017-P1-K1-E4
aagtattacatatgtgtctgccatgtccaagtgacggggcgctcgctctcaccagatttaatgatagacctctccgatcctgctggttactcgaacctcaagtatctgccgggtgccggtacaggcagatgaggcaactggccatggtgtacatgctgcttggacccgtgcagtttatggatgaagacgaagttgacttgcagatgtaggctttgttttccctgaaccggatcttgtgtatcctaattgaacggagcttgctctgataaatatagtgagaaaagatatgtgtcgctgttttaaaaaaaaaaaaaaaaaaaaaacaagaaaaaaaaaaaaaaaaaaaaaaaaaaaaaaaatttttaat

SEQ ID NO: 1121 - DNA, 52 bp, Zea mays
  Clone ID: LIB3227-017-P1-K1-E5
aaaaaaaaaaaaaaaaaaaaaaaaaaaaaaaaaaaaaaaaaaaaaaaaaaaa

SEQ ID NO: 1122 - DNA, 403 bp, Zea mays
  Clone ID: LIB3227-017-P1-K1-E6
cggggatctagggcaggtggatgagctaaggagattgatcggccaccaacttgtaaacttgcagcaggttttcaaagtcttgactgaaccaagtgagaatatctgtaaacctatagctactaaactggtcaatctatatcggacaggaaggcttggccgatataccttagaacatgtcccagatgttaggcaggaagttgtcgcagaattacctaccgcctaaagcatgccctgttttttttaccttaaaacaaggattatgcattggtttggccaggatacagtacagcccctcctagctgtaggttgcccatggagcatgaagcgcctccggtgttccattagaggccaaaaactgaatcaaccacagtgtactatgtaagtcttgcggattgactactcg

SEQ ID NO: 1123 - DNA, 394 bp, Zea mays
  Clone ID: LIB3227-017-P1-K1-E7
cccacgcgtccgggtcgaccgagtctacgttagctccccaaatgtagtagcagttattgaccatgagaagaaacactcgtttgtcataagaaaggaaggacttcctgacgttgttgtgtggaatccatgggaaaagaaatcgaagaccatggtagacctcggcgacgaggagtacaagcagatgctttgcgttgatgcggctgctgtggagagagcaatctcgctgagaccaggggaggagtggactgggaagctggagctttctgcggttttatccactaactgcagcgaccatcttgatcatcctgtcagcatctagcgtttattcccattgtagtgctatatatttgcctcacaagagaagtatgggccccttttgtaaatgagatcaata

SEQ ID NO: 1124 - DNA, 263 bp, Zea mays
  Clone ID: LIB3227-017-P1-K1-E9
gctgatgccatcaaagcaatggagaaacgtcaggtgaaccgcgagcagaattctgtggcgcatttgttagcgcagttagttaggactctgttcatacaactgttcgattaagccaaatacctaatttagttttatattggttgttgtcaaagaatttgtgaaatattgaggttgataatatatgtggcgttcgtttttatgtaaaaaaaaaaaaaaaaaaaaaaaaaaaaaaaaaaaaaaaaaaaaggaaaaaaaatataaaa

SEQ ID NO: 1125 - DNA, 391 bp, Zea mays
  Clone ID: LIB3227-017-P1-K1-F10
tagctattgcgcaggctgcgccttttttaacaagtataacagccagactggggtagcacccttgagagatacctcatttgctctacgaggtgctctaggcagttcaagctcatacctggatcaagacaacagctacacgtcttccactgtagcagctctgtgaccaaagatgtatgctactactagaaatcgactcctacactcgagttgccccctgtcatattctgtatcataccgaccgttgtcgacgtaccttcgtacgtagaagccacacatcagcgcgactttcttaatgttgtattgtatattctttgttgcgtagggaagtgccatattatatttttctctcgtcaccaaagtaagtctaaggtttggtgcttgagatcaattt

SEQ ID NO: 1126 - DNA, 326 bp, Zea mays
  Clone ID: LIB3227-017-P1-K1-F11
aggaaatggaggagtttgtctaacaaatctgttatgttcaacaatggtgtatatattattagtcagaatttagccttgcgctattatgatagaattagttgcctggtaaacagtggtaacaatgttgttttgtttatttaatgtattgatggaccatcttatgtatgagtgaattaagtagacattttcgtgtcgagtatgataaattgttagattgctaggttaaataaatctgttcttgtttttgaccacttgtctattcgataaggcatgtaacctgtaatatgcaatccactagtattcaattgctgtggctcgttttcatt

SEQ ID NO: 1127 - DNA, 404 bp, Zea mays
  Clone ID: LIB3227-017-P1-K1-F12
gtgaaatttctgaatcagaggcagagacaaagtatcgtctggacaaagaggagaagtggctcgaatggtgctctgaagttttaaatgaggaacaggaaactttgaagcgcctggacaggctgcagaatacaagtgtaaacctcccaaaggaaaaggttctttcaagaatccgcaagtatctcctgataattggggacaaaattggtgaagttgtccggcaacacagtgaatcttataggcaatcccgtaagtgtagccgcacctcccgcatgaccatgaggttatggaattatgttgccaccttttcaaacatgtctggggagcaattgcatgatctctatttgaaacttagtcaagaccaactggaaggtggagttggcccatctcatggtgccaatttcaca

SEQ ID NO: 1128 - DNA, 68 bp, Zea mays
  Clone ID: LIB3227-017-P1-K1-F2
aaaaaaaaaaaaagcaaaaaaaaaaaaaaaatttaaaaaaaaaaaaaaaaaaaaaaaaagagaaaaaa

SEQ ID NO: 1129 - DNA, 393 bp, Zea mays
  Clone ID: LIB3227-017-P1-K1-F3
agacaactggccagcttcgaagagtgactcaaacatgaaaggaaaaaataccaatgttgaaccaagcagagctgctaggtcatccgaatcaactttccgattggctccactaacaatccaggaagctactcctaacttctcacctcggccttttgtgaacagcatgcagtttacaagcgtaaaccctcagcctagtccattgccaaggcctaacgggaaggaagttttgttctgaccgtggatgctgcatgccatgtagagtgtcatttctatcaggcgcagttcggcctcaatgtgccttgcagagtcctgcgcagttaaaggatgttgggttttataagatcatctgtgtgaccacgccacattgtgactgctcatggagcactgcacatg

SEQ ID NO: 1130 - DNA, 406 bp, Zea mays
  Clone ID: LIB3227-017-P1-K1-F4
gccctaaaccctagctagggctaggccatccatggccgcctctccccagactctgtcagctcccccgcccgccgccgcggccgtcccgaacctcggcggcaagcgcaagaggcaacccaagggcaagaagaataagaagaacaaactcgcgcgctccgaccaggatgactccgtccgccgccgccgcaacaagccgagcgccaagttcctcaagctgctccgcaagcgggcccgcgactacaactccgacgacgaggatgaagctggtgacgaccggcagcaggagcacctgccgaatcctcaacgccgcgttgacgaggacgacgacgaggccctctctcactccgagccggaggagggcgaggacgaggacgaagaggagggggccttcagctcggccgtcacg

SEQ ID NO: 1131 - DNA, 402 bp, Zea mays
  Clone ID: LIB3227-017-P1-K1-F5
gcatgttatgttatgcgactgtcggagtttagtacatgcaatatcgtcacatgcatgctggcattttgttttaaaaaaaaaaaaaaaaaaaaaaaaaaaaaaaaaaaaaaaaaaaaaaaaaaaacaaagaagaaaaaaaaaaaaaaaaggggcggtcgggcggggggagccaaggtgtagtacgcctgcctgccgcgggcaaagctcgtcaatagggcccccctagggccacccaacaggccgtcgtttgcccacggtttgcccgggaaaacccgggcgaacccccgctgaacccccctggagaacatcccccttacgcccgctggcgccaaagggaaaagggccgaaccggccgcccctccccacccttgcccaacccggatggcccatggggcgcgccgg

SEQ ID NO: 1132 - DNA, 407 bp, Zea mays
  Clone ID: LIB3227-017-P1-K1-F6
ccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccga

SEQ ID NO: 1133 - DNA, 381 bp, Zea mays
  Clone ID: LIB3227-017-P1-K1-F8
gttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatgtttgaattgcatccaatgcatgaagtttctttggttacc

SEQ ID NO: 1134 - DNA, 305 bp, Zea mays
  Clone ID: LIB3227-017-P1-K1-F9
caaccggctataaggtctagttgatacctctgccaacaatctcgcctacgcagaaccatgcataaagctcaactccaaataaagtcgcaatcccaaggtcctcaaccttgaggtccttcctgttcttccatacctgcttgacaccatcaagctccttccagaatgactcataccgacctggtaggcttgcgaggcgggtgtagaaaagcttcttggagagctcctggcatttctcgatggtggggggctgcaccacgtactgcttgttcttctccatgagctccttgtagtatgagccgccgtgc

SEQ ID NO: 1135 - DNA, 400 bp, Zea mays
  Clone ID: LIB3227-017-P1-K1-G1
aaaaaaaaaaaaaaaaaaaaaaaaaagacaataaaacaaaaatgacaaaaaaaaaaaaaggaaagaaaaaaaaaaacatacacaaaaaaagaaaaaaacataagtaaaaaatagaggaatgcaactaggtgttcctggccctcagcgtgggcctgctcatcggcccggtgctcgtctgcctcaaggcgtggtacggcaagcccctgtccatctgctgaggagtgaggtggtggacgcctccggtgccaagaggcacgacccgcaagaggaggagatgacaccgtacgcgcgcgaggaagaaattaagaagggagtatttccgtccttttttggcggttgcgctcattattgacaggttcacttccctgccccctttccaccgtttctccccctttttttg

SEQ ID NO: 1136 - DNA, 403 bp, Zea mays
  Clone ID: LIB3227-017-P1-K1-G10
tagctattgtgcaggctgtgcagcaatggagaagtataacagcaagactcagttagcacccttgagagataccccatttgctctccgtggtgctcttggtagttcaagctcataccttgagcaagccaggggctacacgtcttcccctctagcagctctgcgaccaaagatgtcttctactactggaaatcgactcctgcactcgagttgccccctgtcatctcctgtagcaaaccgcccgctgtcgccccaccttcctctgaagaagccacagttcagcgcgactttctcaatctcgcatcgtatattcggtgtcgcgttgggagttgccatcgtatctgttcctctcgccaccaagttcagcctaatgtttggtgtctgagagcgatttgctgcgtctcat

SEQ ID NO: 1137 - DNA, 182 bp, Zea mays
  Clone ID: LIB3227-017-P1-K1-G11
aaaaaaaaaaaaaaaaaaaaaaaattaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaagaagaaacctaaaaaagggggcgctgggtccaaggttaacaacggggagaactgggaaatcc

SEQ ID NO: 1138 - DNA, 402 bp, Zea mays
  Clone ID: LIB3227-017-P1-K1-G12
cgatctgtgtgtgtgcagttggttgactgggtgctgtgccggctgtacaacaagaagaacgagtgggagaagatgcggctggggaagggggcagccgccggcgcagtcaaagaggaggaggccatggacatgagcacctcccactcgcagatcacccactcgtggggcgagacgcgcacgccggagtcggagatcgtggacaacgacctgccgttcccggatccggcgatgatggtgcccaagaaggagcgggtggacgacggcggcagcgccaggaccagcgacctgttcgtggatctcagctacgacgacatccaaggcatgtacagcggcctcgacatgctgccgccggccggcgaggacttgtactcctcgctcttcgcgtcgcccagggtcaggggg

SEQ ID NO: 1139 - DNA, 399 bp, Zea mays
  Clone ID: LIB3227-017-P1-K1-G2
gtgaaggtgagcggggtgcagatcgtgcccgatccggtcgaacccggcaagcccgccactttcaagatctccgcttctactgataaaaccatcgagaaggggaagctggttatcgacgtcaagtatttcttcttctacgtgcactcggagacccgcgacatctgcggagagacttcctgcccagcgaccggcgacttcgtgctgtcccaccagcatacgctgccaggcttcactccgccgggctcctacacgatctacatgaagattgtcggggacgacaacgaggagctgagctgcatctcgttcgggttcagcatcggcttcgtcgcgtccagctgaacgcgtccgagcctgggcacgagaggcagccagcccatgtatgtaaattacgtggagcac

SEQ ID NO: 1140 - DNA, 386 bp, Zea mays
  Clone ID: LIB3227-017-P1-K1-G3
ctgtcgagttttttttttttttttttttttttttttttttttttttttttttttttttcttaaaaggaaaagcccaaaaaaaaaaaaaaagggggcaacaaccaaaccaatcccttcgggggggccacccaaaaaaagacaaggggtccccccccccccttaaaataagggttaggcccccccctttcccggaaaattaaaaaccggttaaaacccccttccgggggggaagtttccccaaaaaaaaaaaacccccccccaaaaagttttgccgggggaccacaaaaaaaagaccaccggttgtccacaattaaaacataccccccaccggggggggggggtaaccttggggggcccccccacccgggccttaatttccccccaaa

SEQ ID NO: 1141 - DNA, 408 bp, Zea mays
  Clone ID: LIB3227-017-P1-K1-G4
cgctgctcctttggaagccccaagcccgccagggcgcctgcaaggagagacgacgacagcaatgccggtggtggacaagggaggcgaggccgccgagttgcccccggacatccgtgggctcggcgtcggcggggagaccagcaggccgtcgcaactccacggtggttctggctcgccaccgatgtagtccaatccaaggcgtccaccaccgccaagcgccgccgcgagacttggggctccaagtcggtgcgcgcgtcgtggaggtggtgtggatgcggcggtgcgtggaggtggaaggacaaggatgccatggtcagtcgcaagcgaagcgagcagggagggaatgaagccgtacggtccgggagctgctgtcgtcgtatacatgcatgcataaatacatatatatat

SEQ ID NO: 1142 - DNA, 283 bp, Zea mays
  Clone ID: LIB3227-017-P1-K1-G5
ataaataaataaaaaacaaaataaaaataatttttaaaaaaaaaacaaacaaaactaaagggggaactttcatacgcttgccacgcttacgatcacctggttctgctccgattcctttttccttttttctgccccgtttttgccccctggtcgtcttttttaatcgctgctttcccccatttcccttcccttactgttcatcgcccccctccctctattccccccctgtcatctcctgtatcaaactcgccgctgtcgccccaccttcctctgaaaaagtttc

SEQ ID NO: 1143 - DNA, 399 bp, Zea mays
  Clone ID: LIB3227-017-P1-K1-G7
ccgccaacaggatcaaggagagccggtcgtacccgctgtaccgcttcatccgccaggacctcggcgccgtgtacctgaccggcgagaagctcaagtcccccggcgaggagtgcaacaaggtgttcctggccctcagcgagggcaagctcatcgaccccatgctcgactgcctcaaggagtgggacggcaagcccctgcccatctgctgaggagtgaggaggaggacgccaccggtgccaagaggcaagacccgcaagaggaggagatgacaccgtacgcgcgcgaggaagaaataaagaagggagtatttcggtattctcaagcaggcttcatatcgtttgcgatctgaagatcattatatgttgttcctctgtactcatcttttttgtttggagcttg

SEQ ID NO: 1144 - DNA, 392 bp, Zea mays
  Clone ID: LIB3227-017-P1-K1-G9
gaagttctgtcgagtaggcaataactgtctatttgacgcgacaatagcaccataagattgtacatgcttaccttgtctggcttagggaacccctgtagtttaagtaggttttgtatgtcgattcacccgctgatgaaggcagtaacttgtaggtttcgtggtgtacccgcctaataagactaggcttgttgctgacaccgtcccttggtacaccgcacttttgctaggagccctctggctggcccagacagtactagcatgtacattagcggcagcttgaacgctgattttgtttagctgtgttgattgcagtatgtaggaaggcgactgctggatgcatttttttcttaattttgtttaacgtgacggatgaaagcattggcaggccatac

SEQ ID NO: 1145 - DNA, 309 bp, Zea mays
  Clone ID: LIB3227-017-P1-K1-H1
cagacgtcatcttcagcgtgtatgattcctcacatcaaatgatttccgacgcgaccttctcgacgaccttcagccagtgcccagctccagttaatcttatgcccccatgtcctccattttcatgctttgctcaagcttttggaagtgcctgaactgatttggaaccgcaagccttccggtggtgctttagaaagttgtttagtgcctgcatgcatccttaatcatatgcagccactctgtacatatctgacttcgctcagttaataggggactgtgcttgccccaaatggaggcagggccgtttgtgtc

SEQ ID NO: 1146 - DNA, 325 bp, Zea mays
  Clone ID: LIB3227-017-P1-K1-H10
cggcctttgcccatcccgagcgaactctggttcttctgcgacctgcgcattatgagtacctaccgatgctcccggggtccattgtgaagctgaggtgagtatataggcataaagagtgcatgaacactgtttgtggtacaaagctgcgcaccaaggagacagtcgcatgatgggtctgttgataaactagtgatgagcgtcgaagcaagctcccggcgggagacgagcctgaatggaccacattcgcttattcctggcgcctgaaacttacccagtgatgtggacgctgttctaagatgtaatctacgcagttttttccttcgag

SEQ ID NO: 1147 - DNA, 407 bp, Zea mays
  Clone ID: LIB3227-017-P1-K1-H4
accagatctacgcggtgctcggcatgtacgtgggaagaaactttttagagatgatgggcacaactctagtggtgaggaatctattggtgcatctgaccatcaggatcacggtgaagatgacgacagcaacggcgatgcagatcagcccttgatcaacacgatcaggtcttccgccgccaagctacggtccttgaagatctctcaacagggaccaagcagccaaaaaggggtccctggcccatccggaagcaatagctgagaggatgcatgcagtgcccctcatcgttggtgatgatttccagacattgactgaccgattcaagcagcacagggggctggcactaacatcagtttgacgaggacaccattccacgcggagctgcagtcatccgctgtttagctgcttg

SEQ ID NO: 1148 - DNA, 384 bp, Zea mays
  Clone ID: LIB3227-018-P1-K1-A1
actttttgaactgataactgccataaatccacaacaaggtctgatggagtacattaatctggcagcgattggaggggaggggagggttgattgggacgagatactggacaaggacctcctagtagggaacatccctgaagaggttcggatgcttgctgatgttgcctaccgatgcgttaacaagaatccgaggaagcgcccctggatatcagaggtcacacaggccatctcaagactcagacagcaccagctgataaagcatgatgcgataactctgccgaggagtgagaccaggaccgtccttaggaggatagactaccagcacgtggagcttagtgacctcactagcatcaaagaacttacgccgataagggcatcatgaac

SEQ ID NO: 1149 - DNA, 299 bp, Zea mays
  Clone ID: LIB3227-018-P1-K1-A10
tccatggatcaaagagcagcgccgtggttgggcatttttacccttcctttggtttaggtgaaagttggacctctgtagctcggagtcttagcaggtagccagtttttatttctgataagtttttaggcaagttgtaagttgtagcacaaaatcgatcacttgatagtattaacattgcattgatgtagacatgtagtcatctttgtagctgtactctaggcaagcaacacgaatccagtggcttacatcattcatttgtatgctgtagtcatcttgtaatatatggcccatttctttgc

SEQ ID NO: 1150 - DNA, 385 bp, Zea mays
  Clone ID: LIB3227-018-P1-K1-A11
aaatttaaggcgaatgatgatatgaagaaacagcaaagaccatttctcatgcagttcttctcaccaatttttctgaaggcattttctattacattctttggtgagtggggtgacaagagccagattgctacaattggcttggctgctgatgaaaacccgttcggtgttgtcctgggtggaatcatagcgcaagcactctgcactactgctgccgttcttggtggaaagagcctagcgtcccagatatctgagaagatggttggaactagactcattttctttgcactcctgtaaaatgtccagcattagttcgatgcttgtctggttgtaggttgaactgtcaagcggagtgctcttcctgctcttcggtatcatgtccttactc

SEQ ID NO: 1151 - DNA, 201 bp, Zea mays
  Clone ID: LIB3227-018-P1-K1-A12
gtgatgagccggactggtgcgctggtgcctttctgaccggcgccgtggtgtttgttcgtgatcgtaataaacctgagggcgtagctgtacgtgaggctgtttcttcggtcctggtactgtcgctgcagcatgcatagcagtggaccagtggtgataaataagttactgtgctttctacgaatgaaccctttttttgtgtct

SEQ ID NO: 1152 - DNA, 78 bp, Zea mays
  unsure (1)..(78): unsure at all n locations; Clone ID: LIB3227-018-P1-K1-A2
ccgggatggccggggggggccacgcgtccgacaatcngaactgataactgccataaatccacaacaaggtctgatggg

SEQ ID NO: 1153 - DNA, 122 bp, Zea mays
  Clone ID: LIB3227-018-P1-K1-A3
atcgcctgcaccgtcgagcgcatcaaggccgccgtctgtgcggaagccggcaacccgcagtagccatccatgcgatataagaggagggagaagggggcatgcagcagggttttgtggaaatg

SEQ ID NO: 1154 - DNA, 404 bp, Zea mays
  Clone ID: LIB3227-018-P1-K1-A4
ggcggctctggcgaggctcaagacgtacgagggcgtcccgccgccgtacgacaagaccaagcgtatggtcatccctgacgctcttaaggttctgaggctacagcctggacacaagtactgcctcctcggcgagctctctaaggaggtcgggtggaactaccatgacaccatcagggaacttgaggagaagaggaaggagaaggccaaggttgcctacgagaggaagaagcaattggccaagctgcgtgtcaaggccgagaaggcagccgaggagaagttggggtctcagttggagattcttgcccctatcaagtactgaggagctgtgctttgtcatcagttttggggaacatctagtctttgttttaagtgttcggtaacagtttgtgacagtataatctggt

SEQ ID NO: 1155 - DNA, 405 bp, Zea mays
  Clone ID: LIB3227-018-P1-K1-A5
gagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctg

SEQ ID NO: 1156 - DNA, 340 bp, Zea mays
  Clone ID: LIB3227-018-P1-K1-A6
gagaaggaaaaatatccccaaaccctagctcccgatctcgatggcgagccctaggggcttgttcgacatgaccgtcggcggtgccccggctggccggatcgtgatggagctgtacgcctacgaggtgcccaagaccgttgagaactttcgcgcgctgtgcactggcgagaagggcgagggcaagtccttgaagccggtccactacaagggctccaccttgcaccgggtcatccccgagttcatgtgccaggggggcgacattacccgcgggaacagcaccggcggctagttcattttctgcgagaagttccactacgtgaagttcgtgcgcaagcacacc

SEQ ID NO: 1157 - DNA, 187 bp, Zea mays
  Clone ID: LIB3227-018-P1-K1-A7
ttgaccgacgcgtccgatgactcatatgtggtgctgtacttaaagaagggagaaaccaaaaagaagacaagggttgtgacagacacgctaaatccaatatggaaccagacatttgatttcatggtagaagatgcactgcatgatttgctcatggtggaagtatgggaccatgatacatttgggaagg

SEQ ID NO: 1158 - DNA, 280 bp, Zea mays
  Clone ID: LIB3227-018-P1-K1-A8
gtttgtgtctgtgccgggaggtcatcttggtatctccaaaggtgacatgaagaagtacattgtgccttacctgacaaacaaaaaggcatcggtgacggtttctgatttgctagttgccatttggcacgctgtgcttgggctggcactggcagagggtgatgacgctgttttgatttgatgcatgggcttccgacagtggcttggattgtaacgcttgctttgctgggtggttggcactcatcaccaataagatcatctcaactcatattctgtctggtgg

SEQ ID NO: 1159 - DNA, 321 bp, Zea mays
  Clone ID: LIB3227-018-P1-K1-A9
gcgggaacaatttttgagcaaatctttgatccaccagccatatcactagttggagaaagaccacagggggttatcaggtactacattcctaaaggatttgagcatctaatgtcacttgtgccaactgctgtactaatcactggtgctgctatttaggaatcggttggtattgataaagctttggcagagaaaaatgcatttgagttggactctaacaaagagttatttggaaatgggaatacgaaatatatgtcgttaattcttagtagggattacctgcaacagtttttttttttttggtcatgcatttattttttgaaa

SEQ ID NO: 1160 - DNA, 401 bp, Zea mays
  Clone ID: LIB3227-018-P1-K1-B10
gctgtagtatacctggtagatgcgtatgataaggagcgatttgctgaatcaaaaaaggagctggacgctctcctgtcagatgattccttggcaaatgttccatttctcatccttggcaacaagattgatatcccgtatgctgcctctgaagaggagctgcggtatcacctaggccttagcaacttcacaaccgggaagggcaaggtcaaccttggcgactccaatgtccggccacttgaggttttcatgtgcagtgttgttcgcaagatgggctacggcgatggtttcaagtgggtctcccaatacatcaagtagggcccttgccggggcgcttgctcagcccagcgattttttgccttgtatttgttctggtggtatttcgtcacgtgaacgatgatcat

SEQ ID NO: 1161 - DNA, 413 bp, Zea mays
  unsure (1)..(413): unsure at all n locations; Clone ID: LIB3227-018-P1-K1-B11
nngggtgtcgggggggcgttaatagtatacctggtagatgcgtatgataaggagcgatttgctgaatcaaaaaaggagctgtacgctctcctgtgagatgattccttggcaaatgttccatttctcatccttggcaacaagattgatatcccgtatgctgcctctgaagaggagctgcggtatcacctaggccttagcaacttcacaaccgggaagggcaaggtcaaccttggcgacttcaatgtccggccacttgaggttttaatgtgcagtgttgttcgcaagatgggctattgctattggtttaagtgggtctcccaatacatcaagtagggcccttgccggggcgcttgctcagtccaatgatttgtttgccttgatatttgttatggttggtatttcgtcacgtgaac

SEQ ID NO: 1162 - DNA, 315 bp, Zea mays
  unsure (1)..(315): unsure at all n locations; Clone ID: LIB3227-018-P1-K1-B12
aataaaaaaaaaaaaaaactttttaataaaataaaattaaaaaaaaatattaataaaaggggattttatattttttttatgtgatnngtttattttttagtttatttctattcttcaatcattttttatttagttatttattaaattaattattgcttgtaaaataatcttttatttctctttactatttaatattttgattttaccttttttattttataatcaaaaatttttatttttgaatttcaattttatatttattatttaatttaatttttttttttaagttatttatttatttattgtttttattta

SEQ ID NO: 1163 - DNA, 325 bp, Zea mays
  Clone ID: LIB3227-018-P1-K1-B2
cagaagttgatcctggtgttgcatggtacttgtatccaaggcttgggtacctcccttatgttagcacaactgaggaaacagctatttcttcattgaagaggtcgcttggtgctctgaacacacaccttgcctcaaacacataccttgttgggcatgctgttactctagctgacattgtattgacatgcaacctctaccatggaattgcacggatcttgaccaagaccttcacgtctgatttccctcatgtcgagaggtatttctggaccatgggtaaccagcctaactttaagaaggtcattggtgaggtcaagcacgcagagtc

SEQ ID NO: 1164 - DNA, 353 bp, Zea mays
  Clone ID: LIB3227-018-P1-K1-B3
ataaaacattatttaaaaaaattaatcacacatacaatctcattccacttgtaaattaagacacgcgtactatatgcacaaagatcacgtgacactggcaaacatctaacagttctttttacacgaagttacaaacacatcccagcctggcaggcaaggcatctggaaaggacgcgccaaacaagaggatgcttcgcctccgtggatcgcattggcatccatggtagtccagacctccttgctgtagcctgtgggcccaacttccctcgctcggcatcatgcatggtacacgcaaaactaatcgtgcgctgccacgcggtgtattattggcctcccccggtgtacacgcatgc

SEQ ID NO: 1165 - DNA, 362 bp, Zea mays
  Clone ID: LIB3227-018-P1-K1-B4
cccacgcgtccgcatcaagctcgagaacacccgcgtagtcgaccaggacaagtatccccacatgctttcagtgcggaactgcttcatcaggggctcggtggtgcggtacgtgctgctcccgcaggacggcgtggacatcgacatcctccacgacgccaccaggagggaggcgcgcggaggctgatcctgatgcgcacccgctccctcacctgctggctgctgcttcatccccgattgtacgaagcatgcatgtacggtgtgtggtagacagatgccccagtttagttctttggtgcttgccttgacatagatattccaggttggatgatgacctgaatcacctgatatattattgtcatatc

SEQ ID NO: 1166 - DNA, 397 bp, Zea mays
  Clone ID: LIB3227-018-P1-K1-B5
gataatttggggaggggaaatcgctcgtaactgtgcaaacacttgttcctcgatcccccctcaatcaatcgagccgtggtgtttgttggctctctctctctttaagatggttgcacggaggaatccatccattattgaagaaggtagtagatctgaagaaatccaggtggagctggagcgtcctcgccgctcccagaccggtcatggtagaggccaagctcggggagatgttggtgggagtagttctcaacaacctgaaatcgtccatgccgctcgagaagaacctgtccctcagccacctctccatccatcttcatcacgggctgctgcagctgccgcctctcgccccatgagccgtggtaagagaagcaagaagagaggtgttcgtgcgctcatc

SEQ ID NO: 1167 - DNA, 269 bp, Zea mays
  Clone ID: LIB3227-018-P1-K1-B6
gctcattcgacgtgctgacacacctgctctctggccacacattccactgtgcctgcgcgcttacttaatttgagggcaccttatcatgcctctttttctgtttaagatgggtctactgaggaatccatccattattgaagaaggtagtatatctcaagaaattcaggggcatctggagcgtactcttcattcccacacctgtcattatatacaccaagctcctgtatactttattgggagtagttcttaacaactttaaattgtacata

SEQ ID NO: 1168 - DNA, 387 bp, Zea mays
  unsure (1)..(387): unsure at all n locations; Clone ID: LIB3227-018-P1-K1-B7
gttcctatgagagaactggttatagtgctcagggaacgggatctactttgattatgccagtcctggacaatcaactaaaatcaccaagtcctctattgctccctgccagggatgctgtcacaccattgtcggagtcagaggccatcgatctagttaaggatgtgtttgcatctgcaactgagagagacatctacactggagacaagttggaaattgtagtcatcaacaaagtcgggactaagcgcgagtacatcgacctgaggaaggactaagccaacgcttcagttgtgctgcagctgtcatttgcttcggacatgtntcctagtctggggatttatgtctaaaggccgtgctttcatagaaacatatngtaatacttgcatatgt

SEQ ID NO: 1169 - DNA, 201 bp, Zea mays
  Clone ID: LIB3227-018-P1-K1-B8
gtgatgagccgtactggtgcgctggtgcctttctgaccggcgccgtggtgtttgttcgtgatcgtaataaacctgattgcctagctgtacgtgaggctgtttcttcggtcctggtactgtcgctgcagcatgcatagcagtggaccagtggtgataaataagttactgtgctttcgacgaatgaaccctttttttgtgtct

SEQ ID NO: 1170 - DNA, 354 bp, Zea mays
  Clone ID: LIB3227-018-P1-K1-B9
aaaaaggggagcgggcgttttagaggatcaaagttaacttacccgggcatgcgacagaaaagctctcttatgggggcaccaaaattaaattaactggccgccgtttaacaacgtcgggactggaaaaaccctggctttaccaaacttaaaggcctgtgagaaaatccccttttcccaagggggccgaaaaacaaaaaggcccgaaacgattggccttccaaaaaattgcccaaccctaatgggaaatgggaccccccctttaacgggctataaagcgggcgggttgtggggtaaccccaaagtaaccggtcattttgcagccccttaaccccggttcttttgtttttttccttc

SEQ ID NO: 1171 - DNA, 353 bp, Zea mays
  unsure (1)..(353): unsure at all n locations; Clone ID: LIB3227-018-P1-K1-C1
gaagcctacaagggatactcctatcaaagttctcccaaattcaactactgaaagggcctgtacatttgttggaaccgctgcatatgtaccacctgaggtcctgaactctgccccagcaacctttggaaatgatttatgggcattgggatgcacactgtaccaaatgctttctggctcttcgccatttaaagatgctagtgagtggttaattttccagagaatcattgcaagggacctcanatttccagagtatttttcagctgaagctagagatcttgttgacaaattgctggatgttgatccaggcaaaaggccaggtgcaggacctgatggttattcttccttgaaggagc

SEQ ID NO: 1172 - DNA, 405 bp, Zea mays
  Clone ID: LIB3227-018-P1-K1-C10
acgtgacatcactaaggaggtggcagcagcagttgtgagggaggcagtagcagaggatctagctgagggataccgtgacatggatgcacgtgagcttgcacgactcagtgaggaagaaactaatgaatatgtcaagacgaacatgtggagtcctgtctatccaacaataatatacaagaaggactagatagctctatttgctattttgcatatgttcaatgatcatgtatgatatactttaggctgcgttctggaaggcactccagaagtgtaggcacgttagttataagaaaacagccttcattgttcattgaccttacttttaattgaatttagtacacgagacaccttaggccacagttcctgacgtactccatggtgctgaaacatttcccatctcaaata

SEQ ID NO: 1173 - DNA, 284 bp, Zea mays
  Clone ID: LIB3227-018-P1-K1-C12
atccacaatccatagattcttacctgaaacgcaccacatggcacgtattttgaacgaacgggggttcgatagcctttttaacctttttaaatacagcttcgcggcacacgacttcctaacaccggttccaagtacagcaagatcttgtacattgagaccaccaactcctgaaccctacgtgtaatcctcgtcattacagattagatattttgacccctgatttcatttatcacggtcaagaacatcaggacagaatcgcctttgtgaaggctatatctaagccg

SEQ ID NO: 1174 - DNA, 404 bp, Zea mays
  Clone ID: LIB3227-018-P1-K1-C3
aacgcgtgcagggacgccggggtggtgcacatcctcgggaacacagtcatcagggcccgcagagattcagggttcatcaagaagattgctatcaattacttgtatgctttccttaggaagatctgcagggagaacagcgccatcttcaatgttccccatgagagcctactgaatgttgggcaggtgttctatgtgtaagcactaaaaccaaacacatgtagtagatgagagttcagcttcggaaccactggagagaatctagctgtgttttgttcataggtaataggagtataatagttgaaagaattgtacagcaaaacaacatctttaatgtgaccatttggagcctgatcagtagtggctagggctggacgaaatactcgtggctcgataactcattcgac

SEQ ID NO: 1175 - DNA, 411 bp, Zea mays
  Clone ID: LIB3227-018-P1-K1-C8
cctagaggaggcctttgccatgatgggtgcgctcgcatggcaggccaggtattaataaaaagatgattattgtgtgccgggggaggagatcgcacgggggttgatgtttttggccccggggtctcctccctcatcttgttccgtgttcctgtatccgttgtttccgcgcctgttggtccgctgcgcacgccggatttttgcatcgagcacggagatctacaacaaaaacatggagctacgacgcgactcccaagcatgtttgaaccatagcaattggtggacgtgtgtagagaagattgcaaaactgcagtatgatggattccactattcatcaaccgagatcatggcgcgcttcaatcgtggctacgctgatggggaattgatccgttatggctcgtggctgtggagatg

SEQ ID NO: 1176 - DNA, 408 bp, Zea mays
  Clone ID: LIB3227-018-P1-K1-C9
atcttgaaagaatttgctccatctattccagagaagaacgttacttgcctgacccgtctggaccacaacagggctcttggccagatttctgagagacttaatgtccaagttagtgatgtgaagaatgttatcatctggggtaaccactcgtcctctcagtaccctgatgttaaccatgccacagtgaagacttccactggggagaagcctgttcgtgagcttgtctctgatgacgagtggcttaatggtgaattcatcacaactgtccaacagcgtggtgctgcaatcattaaagcgagaaagttctccagtgctctctcggctgctagctctgcttgtgaccacattcgtgattgggttcttggaacacctgagggtacatttgtttccatgggtgtgtactctgat

SEQ ID NO: 1177 - DNA, 95 bp, Zea mays
  Clone ID: LIB3227-018-P1-K1-D11
cgggaacttttccaactccgatgctaagcgtgtagcttgcttaatcagtcgatgtaccatgttaatcaagggctagccctttctctgctcaaaaa

SEQ ID NO: 1178 - DNA, 401 bp, Zea mays
  Clone ID: LIB3227-018-P1-K1-D12
ctcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagcttcggaagctgcttgcaggcg

SEQ ID NO: 1179 - DNA, 396 bp, Zea mays
  Clone ID: LIB3227-018-P1-K1-D3
ccaggtgcagcatctgatcgagaagtgcatctgctacaagctgaacaaggaggagtgcatggagacgttggagaagcacgccaagatcatgcccgtcgtcacgtccaccgtgtggaaggagctggagaaggagaacagtgagttcttcgagacgtacaagagggatcggggagggggaggaggaggaggaggccccaggaacctgcaggaagcggctgctggtcaccatgctcctccgcatctccaagtccaacagagctgctgctcacaagagccggcgctggtgcagaagaaccacccaccatctgatggagtacaggaacatcgcgtcgtcgtcgtcgtggagaaggagaagaggaaggacccaccatcggcatcggcgtcggctgatggaca

SEQ ID NO: 1180 - DNA, 391 bp, Zea mays
  Clone ID: LIB3227-018-P1-K1-D4
gagctgcaccgcccccttgctggccgctctttggattgaagggagctctgcatgctgatccacccctccattttttttgcttgttgcgtccttcctgggacctgagatctgaggctcatggtggctcactgtagcctcgctacactgttttcttcttctcctctcctctcctgtgctatttgctgtttctcccaagattctttaggccgtgcttatccgtgctggagctgaacgaagcagcaggttgctgctgctgctgctgccctcatgccctggtggtggactggtatcggtacccgtacttgcgtcgctttattatactctctatcttcgccggtgaggttccggccgttcggtacatgtagtttatgtcaaacactcgttttatttc

SEQ ID NO: 1181 - DNA, 272 bp, Zea mays
  Clone ID: LIB3227-018-P1-K1-D5
ctaggatccgaccacgtcgacgatggagctgagaagataatgatgatgacgacgacaacgacagatggttgtgtcatctgctctctttttttagcgccaacaaaactggaaatgaaaaagggaaatcaatccgaaaggagaatagaaattaggaagtataggtagaatctctctcttgctagtgactatagaaattaggaagtataggtagaatctctctcttgccatttatgatgcattggatttttttatatataagaacttcccagtgg

SEQ ID NO: 1182 - DNA, 403 bp, Zea mays
  Clone ID: LIB3227-018-P1-K1-D6
ataaaaaaaaaaaaaaaaaaaaaaaaaaaataaaaaaaaaaaaaaaaataacaacagggaaaaacaaatagttgataaaaaataatatattttgggtcgccccttctaaagtgtccatgcttacttgcccatccatccgaaatgataatttttatttggtggtatctatataaaatctatttgcctagtgtttataaaaattaggctggataaaccgtgtctttctctaactatttatgatgcattgaatttttttttatataagatcttgccatagcaaaaaggcccgaacaaggtcgccttctctacagtttccaagcttaattgcgcattggtaccccctcataactgttcttttaagcacgtaagttgagttgattacccgcagttttacaacttcatt

SEQ ID NO: 1183 - DNA, 376 bp, Zea mays
  unsure (1)..(376): unsure at all n locations; Clone ID: LIB3227-018-P1-K1-D7
cacatttccctttggcggatcgaaggaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtccgcgaattccatatgcaggacgaggatgcaggccggccatacaggaagttcctgtaagcggcgtccagggccgcaggagacgtcgatccctcgaccggngctgcgaggaggggagtttccattcagtttgtgtcggtattggtttagtctgaatctgatggagcagtttggaat

SEQ ID NO: 1184 - DNA, 372 bp, Zea mays
  Clone ID: LIB3227-018-P1-K1-D8
atccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgtgtcatacccgagttcatgtgccagggcggcgacttcacccgcggcaacggcaccggcggcgagtccatctacggcgagaagttccccgacgagaagttcgtgcgcaagcacaccgcccccggtgtgctctccatggacaacgccgggcccaacaccaac

SEQ ID NO: 1185 - DNA, 404 bp, Zea mays
  Clone ID: LIB3227-018-P1-K1-D9
catcgtctcgttcctgccctcggccctcccctcgctcgctccccaactccagcaggcagatcagatacatccattcgcggaccggaaggaaaggaaggggcgttgaactatgagcgccgtggcggtttcgtcgtcgctgaacccggacgcgccgctcttcatcccggcggcgctactacaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggggctcaaggcgctgaacatga

SEQ ID NO: 1186 - DNA, 405 bp, Zea mays
  Clone ID: LIB3227-018-P1-K1-E1
ctccaagccagtgctagcccggccccttgtgtacgtgagagacggcatcgtaccgtagagcagcacatccatggctcagggaagtggcagtgctcgtggcagcggcgccgccgccgcgcttgcgctggtcctcctctgcgtgctcctccacggcgagctggccgagtcggcggtgtacacggtcggcgaccgcggcgggtggagcttcaacagcgccaactggcccaagggcaagcggttccgcgccggcgacgtgctcggtcagtgctactagctaccagctctttgttcatgcatgtcagtgtcacggcccctccaccttcgttccctaaattaaggtccataccatatgcatggatggctgctgttttgcgtgtgcacgcgttcgtcgtgcagcgttcaggt

SEQ ID NO: 1187 - DNA, 291 bp, Zea mays
  Clone ID: LIB3227-018-P1-K1-E10
gaggatgaggattaagtcgaagggttcaatcatctagcacttaaatgcataccatgagagcaagtttgataatgctgcttcagcttgttatctatgccggatgacgtgtgatagaagtttcgagacgttgctcctttcaagttttgaaattttgactatatgccatgccaagtctgtgttatctttacacattccgagcatctgtatttattatgctgagacagactcatcaatttttgcttgtacaacctgatatgactgatgtagccatgtgttttaagattttttgac

SEQ ID NO: 1188 - DNA, 400 bp, Zea mays
  Clone ID: LIB3227-018-P1-K1-E11
cggccagccacctccccgtcgctctcacgctcttcgtgcccgccgcctcccctcttcccctccacctcactcctcccgtctgacgcacatggcctccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggtggacaaggtttgtgaaattgtgaagaagcagcttgctcttcctgaccacactgaagtttgtggtgaatcgaaattctctgaacttggtgcggattcgctggacacggttgagattgtgatgggccctgaggaacacttcgacattagc

SEQ ID NO: 1189 - DNA, 323 bp, Zea mays
  Clone ID: LIB3227-018-P1-K1-E12
atcagtgttacaggaaggaaaatgacagataagatttactactggcatacagggtatgttggccatttgaaggaaaggaggctcaaggaccagatggagaaagacccaactgaagtgattcgcaaagctgtgctgcgcatgctttcccgcaacaaactgcgtgatgatagggatcgcaagctgcggatattttctggaattgagcattcattccatgaccgccctcttgaagcttttgtgatgccaccaccgcaagttcgggagatgcgaccccgcgcaaggcgtgcaatgttaagggcccagaaaaaagagcattcaaacag

SEQ ID NO: 1190 - DNA, 404 bp, Zea mays
  unsure (1)..(404): unsure at all n locations; Clone ID: LIB3227-018-P1-K1-E2
gtgcaagtgttagatctcgaaggctgcaaaggtttcagggagagcgatgccaacgtttcagacatatgcgaaatgattctacttaagtatctgagcctacggaaaacagacataaaaaatcttcccaataatatttccaagctcaagtacctagagactctcgatgttagggagacagaagttaaacagctgcctacgactgtagggcagttggaacggataactaacatccttggtggtgataagagaagacagagaaccctgaaacttcctaaggagctcaagggaacaatgaaatctttacgcatattgtcgggggttgagattgtggagggatcaacagctgcatcagacttcagttacttcactactctgaggaagctggcaatntacaggatccacca

SEQ ID NO: 1191 - DNA, 402 bp, Zea mays
  Clone ID: LIB3227-018-P1-K1-E3
cgagaccaggaagtttatctctgaaaatgttgaggagcaaactgagcaggttatgaaaaacatgggcgagatattgaaagctagtggtgctagctattcttcagttgtgaagacaacgatcatgttggctgatctgcaggatttcaataaagtaaacgagatctatggcaaatatttcccggcgccagcacctgcacgatcaacctaccaagtggcggcgctgccactgaatgcccggattgagattgagtgcatcgctgctctctaatcagatcatccaaccactcattaaatcatcaataagcacccaggaatttgtggtagaggtacctgtaccagttcagtgtctgaaaactgcgggtaacaaacctttgtgtcccggataagtgatgtgtgtgtgtg

SEQ ID NO: 1192 - DNA, 343 bp, Zea mays
  Clone ID: LIB3227-018-P1-K1-E5
ggcctcggccgtcgcgcgcctcggctgtgtgctgcaagctccgtgtggccttccgtgtgcgcgtagcaaaagaaaaaaaggagtataggagcggtagtagtagagttgctgttgctttccctttctcgttttgtgttttgcggttgccctgcccccatgctcttgttgtttccgcgctgtcgctgtagcgtgtaaatactccggttcgcccttggcagcagagagtagtagagtgctcacgtggctgggccgatggtgtagcaccttttacgagctcagctcgtgtgtgtacatttgcatgctttcaattccaatttcccgagacaaaatatcgaggacaatc

SEQ ID NO: 1193 - DNA, 402 bp, Zea mays
  Clone ID: LIB3227-018-P1-K1-E6
gctccgctattaaagtctgcgtacagtccgccgcggctaggcgaccgcatccgcatctccccaacgtcttctcgccggtcgcgcacgggcaaagcagcgatggctacagcgacggcagttggcggacccgacagggtggagactgcggcgtcgtccgcggcggcagtgctggccgtcgccgttgcctcgcagaggttgctaggtctgctcgctcttgcggttcaaactgtaaatgttggagcagaaatatataataaagatcagcgggcaatatacaagttattatctggaagaatcaaatctgaaaatgtccctgaaaataaggatgggtcagacgacgacgacgatgacgacgacgatgaagacaatgacgatgagggtggtgacgacgatgatgatgct

SEQ ID NO: 1194 - DNA, 406 bp, Zea mays
  Clone ID: LIB3227-018-P1-K1-E7
gtgataaacacccagcggttaatgatattactgctgcagtttgcaagcaaaagatggatattcaagaagcagaaacacttgtaaaacagtggcaagacataaaatctgaagctcttggccctgactatcaaactgacatgctacctgagattcttgatggttcaatgctctctaagtgggaagacttagcgttattagcaaaggaccagtcttgctattggagatttgtgctgctaaatcttaatgttgttcgagccgagataatcttggatgaaataagtgctggtgaggcagcagaaattgatgctgtacttgaggaagcggctgagcttgttgacgattcccagcccaagaaaccgagttattacagcacatatgaagttcagtacgtattgaggaggcagaa

SEQ ID NO: 1195 - DNA, 408 bp, Zea mays
  Clone ID: LIB3227-018-P1-K1-E8
gttgacaatgcgggtttcaggcagtccagcaggttggggccatggcaccgccagatcagatccccctcttcctcactcaaccgcagtgttctcgtcggagcaggcgatgcaaccacccaccattgcaagcgttgtattcccgttgcagcagccactggcaccatcagcaatgaccaaaccacctcatgctgcaccaccactcgaactgaagctctttccagaagtggcatctgccgaaggccatgagccgtgtgaagaccacaaagctcccaaccatgtggcacgaccacaggcaaggtacccaacgcaatcagcctcatggcccgtaaacctgttctctggccttccacgaatggaagatgagcaatgcagtagcagcacaagcggcagcagcagagaggataacac

SEQ ID NO: 1196 - DNA, 402 bp, Zea mays
  Clone ID: LIB3227-018-P1-K1-F1
cgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatgtcgatggtgatggccagatcaactacgaggagtttgtcaaggtcatgatggccaagtgagccacagaaccataatctgaaggcagagaagattatgcattgcatattagtcaagatgcaactttttattccatcgacttctagtgaaacattctgctagttgtagttgctgaaaaaggcaatgtagttcctgctttgttcttccctccagtgtgttttcagaactgttgtttcatgtgaacttgtaatga

SEQ ID NO: 1197 - DNA, 312 bp, Zea mays
  Clone ID: LIB3227-018-P1-K1-F10
gcgatcagtgtttcaggacggaaaatgacatataatatttactactggcatacatgggatgttgggcgtttgaaggaaaggaggctcaaggaccatatggagaaagacctaactgaagtgattcgcattgctgcgcttcgcatgcttcctcgtaacatactgtgtgatgatagggatcgcaagctgcggatattttctggaattgagcatccattccatgaccgccctcttgaagcttttgtgatgccaccacgttaagttcgtaagatgctaaccccgtacaaggcttgcaaagatatgggcccataaaaa

SEQ ID NO: 1198 - DNA, 340 bp, Zea mays
  Clone ID: LIB3227-018-P1-K1-F11
agcagcgccagcggcggtcagcgtcagcgtcagcgcccgaccaaatttcccccctcacctccccctctcccgtcgtcggcatggccaccgacgtgctgcgcgcgcgcaacgtcctcttgccggcgccgccgcagaggatccgggcggcggcggcggcgcgccggagggcagctggtagcgacagccaccaccccggcgccaccgccaccaggaggaggtcgccgccggccgggacatcgtcccccgcggcggggcgaagacaccccggcggcagaagggcgaggcctgcggcggaggtgtacgccggcccatcgttctcgacgtcccccgacccgagctt

SEQ ID NO: 1199 - DNA, 202 bp, Zea mays
  Clone ID: LIB3227-018-P1-K1-F12
cccacgcgtccgcccacgcgtccgttcccctcccgtgaggcgtttaattttgaaggacggttattatgtactagtaatgttttccggatcggctagtgctgacatgcaaaaaaaaatgttccatatttatacattggttccagtatagtagtctttgcaaaacgtttggattttcaaaaaaaaaaaaaaaaaaagggcggac

SEQ ID NO: 1200 - DNA, 359 bp, Zea mays
  Clone ID: LIB3227-018-P1-K1-F4
cccacccatgcgcaagcccaggcccggacgaaggccaggaggaaaacagtatttttaacaatgtgaatggggacgtgaacgattacattgaccaggctgctaggcatgctgagaggtatgaggatatggataaggatattgagactgtggatatgactgagcatactgaagagctgactgaccttgtgcgtgacctatacactaatgcatacaagactgtgattgctgcatggcgcactgtatgttgcattgaacattacgttgaacacaaggaggactaccagcatatcgacctgcttgtggactatatcaaggagtttcatgctaagatcaacgctgtactgaacagcatctgggat

SEQ ID NO: 1201 - DNA, 403 bp, Zea mays
  Clone ID: LIB3227-018-P1-K1-F6
gcgaaaagttccctcccccacatcaagatggtgcggttggtgtccccttggatgcttcaaatcatatggatccactatacgaacctccggacccatcttccttcagcactgtgttcacttacgagaaaggcgctgtgcctacttggtctggaccattggttgatcctgctgcagtggtgaaccaaaagggcaagcacaagtccgggcgctcatcgaaacagccggccactgcccgtgctcggtaagatcctaaggatcgatatttacaggtaaaaaataaggagacttcaacatggtgggaaaatactccatggcggcacctgcacgctgttttgcaaacgaggcatgcaatgataaagtagtttgttggttacctgttgtcatgtgagtgatttttttttct

SEQ ID NO: 1202 - DNA, 256 bp, Zea mays
  Clone ID: LIB3227-018-P1-K1-F7
cccacgcgtccggcggggggcgccgacgagggcgaacgtgggggcggcgcctcccgtcccggcggagccgtcgtgcgacctcgggctgtggctcagccccgggtcgtgcccggcgccagacgagcggtggcagacgcggaccagcacgccgtacatgaccttcgaggagtacgagacgacgacgagcggcggtggtggcagtggaaggagggagcccgagctgctgaacctttttgtttgagactttagctacacc

SEQ ID NO: 1203 - DNA, 374 bp, Zea mays
  Clone ID: LIB3227-018-P1-K1-F8
tccacacctcgcagccgtattcctgtctcgaatcctctctcgccgctccgatggcccgcacgaagcaaacagcaaggaagtcgaccggcggcaaggccccccggaagcagctggccactaaggctgcgcgcaagtcggccccggccaccggcggcgtgaagaagccccaccgcttccgccccggcaccgtcgcgctccgcgagatccgcaagtaccagaagagcactgagctgctcatccgcaagctccccttccagcgcctcgtccgcgagatcgcgcaggacttcaagactgatctgaggttccagtcctccgccgtcgcggcgctgcaagaggccgccgaggcgtacctggtgggtctcttcgaggacacc

SEQ ID NO: 1204 - DNA, 220 bp, Zea mays
  Clone ID: LIB3227-018-P1-K1-F9
gataattcccagctgctagacttttagcttgacttttgatcgacgaagcgagggccaaatgaggcttcaagcaacgcactacccatctatcactagagtagctcttatgtgatgacatgcccaatccttctgatcacaaaacaaaatctgagactggaggaggtttctcgcatgtatgagtagacattatacaagatgctagagaagcggaagctgtgtt

SEQ ID NO: 1205 - DNA, 401 bp, Zea mays
  Clone ID: LIB3227-018-P1-K1-G1
agattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccccgctggcagcggcggccctggccccaagatcgaggaggtggactaagcggtttgttgtcagtcttgagcgtgctgcagttgctggctggcccagtcgctgccgcgagttatcgtcgtcggtcggtgcggtgtgtccgcttaaactttatttgtggtgggctggtacttttgtggtggttatttt

SEQ ID NO: 1206 - DNA, 410 bp, Zea mays
  Clone ID: LIB3227-018-P1-K1-G10
gagaagcagagcttcaccgtgacggtgcggtggaacgggccgccggccgtcgccggcgccgaggggaacctgaagtgggtgtcgagcgagcacgtcgtccggagcccgatcgtgataccgccggccaaggccgccgcgtaggcgtagctcccaatccaatctgctagacggccggcaggaccgttctcgtgtcgtgtctccgaggaagaaggtcatcagtattcagtagcggtaggtaatcgtgagtgtgcccggtgtacgtatggcgaaggaagtaggcaggcgactgttgtataggctggtggaggcaggcagggtacccgatcatctgcgacgcagcaagctcagctgcaatggcaatggcgccgttcgttccgtatgtaaaaaaatggcggaaataattaatcgca

SEQ ID NO: 1207 - DNA, 402 bp, Zea mays
  Clone ID: LIB3227-018-P1-K1-G11
gataatcaaaagatgcatatactttatgaaataaccaaaatacctggccagctaattgaagttgcatgcaacatgcatgggacacgtgtggtgcaaaaggtgatagaatctattagtacctcagatgaagtgtccatggttgtatctgctctgagccacggtgccattacactgatgatggattccaatggctgccatgttgcagaacgttgcttgctgaagctgtcacctgagggcaaagcattccttgtcaacgcggccacgaaatactgcgttgagctagcaaaggatcggcaaggctgctgtatcatccagaaatgcatcgctcatgcgagcaaggagcagaggaacaggttactgtacagcatcacaactcgggctctcgagctcgcagaagatgag

SEQ ID NO: 1208 - DNA, 405 bp, Zea mays
  Clone ID: LIB3227-018-P1-K1-G2
gaccagctgacattcgttaagtttgtgaattttagtgggacatggtgccagctgcagttgctcagcttcttcctggataagtcccctgtcctccagcagctggtgctggtcacgccggaaggggaggaagctctgggagacgaccgactaaaggtcatctatgagcgggtggccgcattggagaaggcgtcgagcgaggcaagcattaccatgtgccggcccaaggaagacgataccccgaaccatccacacacgaggtacttccacgaggagtatgaaactatgtaactatgttatataagcatgcatcgatcaggcatatgcatgattcaaactctttatcaattaggggtgaaaacgggtcaggtatactcgccgggtacaggatacagatagtgcaaatac

SEQ ID NO: 1209 - DNA, 366 bp, Zea mays
  Clone ID: LIB3227-018-P1-K1-G3
gaccgctgacattcggtaagttgtgaattttatgggacatggtgccagctgcagttgctcagcttctttctgtaaaagtccccttttctccagcagctggtgcttgtcacgccggaaggggaggaagctcttgggagacgaccgactaaaggtcatctatgagcgggtggcccgattggagaaggcgtttagcgaggcaagcatttaccaattgccgtcccaaggaagactattccccgtaccatccacacacaagggtctttacactgtggagtatgaaactacgtaactatgtttatttaagccatgcattgtatcatgcattatgcttgtattaaaactctttatcaaattatggggtgaaaa

SEQ ID NO: 1210 - DNA, 402 bp, Zea mays
  Clone ID: LIB3227-018-P1-K1-G4
gaagcggacaaagcgcggcgctgcagatttcgatccggttcccaatgcctcccatgctcgccgtcgccccgtgctagctcctctcccgtctccgcttcctccacctgccgcgccagcgccacgccgcctggatccgccgagcgcgtggccgggagcctcagatccgagcgaaacccagccttcccgtggtgacggccttcgctctagctccagattggctggcggctgccattcctcctcctcttctcgctcgaggtttcaaggctggtccgttcagctctgaaatctacggaggagtcttgctgccgccgctttaaacgtagaggtagagctgtagtatatattttggcgagtaatcctgcttcttgctccgttcccgtgctagtgctggcgtgacagtgg

SEQ ID NO: 1211 - DNA, 403 bp, Zea mays
  Clone ID: LIB3227-018-P1-K1-G5
gtcagagctctccgcctccgccggcggggctcgatactgatgggtgtcttcgggacctcgcgtcctgcctccgtcaccctctgcgccttcctcacattcctcaacctcttcgccttccttctcgccgtcggcgccgagcgccgccgcagcaccgggaaggtggtgccggacgagtacgacgagcggtcctactgcctctacgacaccgacgcctccacagtctacggcgtttccgctttcttcgtgctgctgctccagcaggccattgtcaccgccgccacgcgttgcctttgcttcggccccgtgctctcctcccgcggctgcgccgtcaccgcattcgtcctctcctgggcaacgtttctcatcgcagaagcctgcctcataggaggatcggtgaggaacg

SEQ ID NO: 1212 - DNA, 295 bp, Zea mays
  Clone ID: LIB3227-018-P1-K1-G6
cacgatacgtctatttacaaccagactaggcataagaagctctctatgtctaccggggccttgtattattagtaactgaagtaaggtcatgtgaatgatttcgtgatcccgtagctttgactccacaacgtgggacctgcgccttcttgaataacggaaatggtgaaacctttgaaggcttattaacgtgctagctgctatgatgaaacaaatcattttgattttcaggagattacaatttttttgtgctggtgattcaacaaggcattgttacacgtcgacacgcgttgacttt

SEQ ID NO: 1213 - DNA, 350 bp, Zea mays
  Clone ID: LIB3227-018-P1-K1-G7
aagtcaagcaatgtgatgaaaattgtgacgagacatgtgacaacgcaaggatttacatatcaaatttgcctcctgatgtcactgttgaggaattacaggagctatttggaggaatcggccaggttgggaggatcaagcaaaaacgtggttacaaagatcagtggccctggaacataaaaatctacactgatgactctggaaaagccaaaggagatgcttgccttgcctatgaagatccttctgctgctcattcagctggtggattttacaataattatgacatgagaggctacaaaatcagcgttacgatggctgaaaaatcagcacccagagcagcaccttcttatggt

SEQ ID NO: 1214 - DNA, 409 bp, Zea mays
  Clone ID: LIB3227-018-P1-K1-G8
gcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatccaggtggtcgtggacgccattatcaacagtggaccacgtgaggatgccacccgtattggttcagctggtgttgtgagaaggcaggctgtggatatctcacccctgagaagggtgaaccaggccatctacctcctcaccactggtgccagggagagcgctttcaggaacatcaaaaccattgctgagtgccttgcagatgagttga

SEQ ID NO: 1215 - DNA, 402 bp, Zea mays
  Clone ID: LIB3227-018-P1-K1-H7
aagccagccaaacgccaccgccgccgtgctcgggccgaacgcaactttaagttttttgacgcctcctcctccgtcgattccgacgagagagacgcaaaccaacgaggtaggaaggagcgcgaagatgggagcgggggacggtgaggtcgctgcgagcaaagacaaggccagcggcggcggcgccgagcggacgtcgctggacggcgtgcgggataagaacgtgatgcagcttaagaagcttaatacggcgctattccctgtccgctacaatgaaaaatactaccaggacgccatcgcctccaaggatttctccaaactagcatactttagcgatatttgtgttggtgcgatagcttgtcgcctggagaagaaggaggaggagcagtccgagtttatatcatg

SEQ ID NO: 1216 - DNA, 408 bp, Zea mays
  Clone ID: LIB3227-018-P1-K1-H9
gcaaagcttcgagcactcaaagaagaacatggagaagaaatctatgcaatggtgacaaaggcgctgcttgaaaccaacgagtacaaatcaaaaggcagctaccctgtgggggagctatggaacttcaaagaaaaccggaaggtgactctgaaggaagctgtccagtttgtcctgagacagtggcgaacaaacaggaggaagcgataagctctcggctactcaatgctcttggctttttttccccaccacctgatccgaaagccatgagttcgagagctagtaacctggaaacagtagtattaattcgtgataaaatcaacagggcgatacagccctgtggatctgttccttgttggatataagctggcactcctattgcagtgtcagcatcagtggactcgaacgcca

SEQ ID NO: 1217 - DNA, 404 bp, Zea mays
  Clone ID: LIB3227-019-P1-K1-A1
agtgaacacacttaatttcaatatgtcggtgccgactccatactgtttcatgagaaggtttctaaaggcagcacaatcagagaagaagctcgaactcctgtctttcttcatgatcgagttgagtcttgtcgaatatgagatgctccagttctgcccgtctatgctagcagccgctgccatctacaccgctcaatgcaccataaatgggttcaagtcctggaacaaatgctgtgaactgcacacaagatattcagaagaacatctaatggtttgctctaggatgatggttgaactgcaccaaagagcagctcatgggaaacttacaggggtccatagaaagtacaacacttctagatatagctatgctgcgaaaatcgaaccccaactttcttgcttgatgcctg

SEQ ID NO: 1218 - DNA, 413 bp, Zea mays
  Clone ID: LIB3227-019-P1-K1-A10
gactctcctctctcgcatccgcagcctctcgagctctactccatcccctcgatcgggaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagct

SEQ ID NO: 1219 - DNA, 139 bp, Zea mays
  Clone ID: LIB3227-019-P1-K1-A11
aacaggactttatatgttgctgggcttgaccccaatgttagtaaacatgagcgcaggaaagcattttttataatatcttaaacccacctctgccaaaattccttttgccaaccaatgttctttttttcaatttttaaac

SEQ ID NO: 1220 - DNA, 113 bp, Zea mays
  Clone ID: LIB3227-019-P1-K1-A12
cctttacacggctccaccgtgcctatcaaccagaccggcacacccgatttgtcccatattacgcgtcctcgatgtaatattaatgaaagtgaccggttacttggttgaactgg

SEQ ID NO: 1221 - DNA, 379 bp, Zea mays
  Clone ID: LIB3227-019-P1-K1-A2
gcaaataaagagccgttataggccgagtgcaaagataattacaaccatataatatcatccgattgcacgtagctgaatccccaagacactagcagacaagttgcaaaccaatatccatccaccaacgcagcaccaaagtgctccagacaacaccctcaccgcctactaataaaaaccacacttgagatatcaacaccaacatctggcctgcgcacacataacctctaggcagctcaatggaaaatactgcatcaaccaacatcaacaggccattctactgctgcttgcactccgctggttgttccgcatttccctgcgacaccttctgtggcgccttatgtctgcgaccagatcctgacttccttgctggcttgctttc

SEQ ID NO: 1222 - DNA, 419 bp, Zea mays
  Clone ID: LIB3227-019-P1-K1-A3
gtgaagggggtaccaaatttgctgatgtatactatacctctcctactggaaggggacggaggtctctggttgaagtcgataggttcctccaagagaatccggagtatggtgctcagggtgtaactttagctcagttttcgttccagatacctagacctctacggcaggactatgtgaaaaagaaaccgaagttgataaatccaagtgatgaagcaagtatgattgcctctaagtcttttcaaccagaagaagtgaaacccatagcctgggcagttgctacaaaacacgagggcgatgccagtgaagaagcttctctcaccgatgaggcacctacatcagaagtcatgctagccctgaagagaaaagcaggaagctctttgtcggtagagccaaaccatctctctgatgaacttgaacca

SEQ ID NO: 1223 - DNA, 227 bp, Zea mays
  Clone ID: LIB3227-019-P1-K1-A4
aaaaaaaaaaaaaaaaaaaaaaaaaaaaaaaaaaaaaaaaaaaaaaaaaaaaaaaaggggagaaaaaaaaaattttttataataaaatacaacataaaatacacactcatgctttcttttttcttcttctttactctcctccccctttccttccactttccttcctttttcccttcattttccctttcttaaccccccttccattcccttttccatttctttccccc

SEQ ID NO: 1224 - DNA, 98 bp, Zea mays
  Clone ID: LIB3227-019-P1-K1-A5
aaaaaaaaaaaaaaaaaaaaaaaaaaaaaaaaaaaaaaaaaaaaaaaaaaaaaaaagggggaaaaaaaaaaaattaaaaaaaaaaaaaaaaaaaaaaa

SEQ ID NO: 1225 - DNA, 236 bp, Zea mays
  Clone ID: LIB3227-019-P1-K1-A6
gcagtataaaacaacatcaagacatacatacacctctgctcaaatactggtatagatgtgtagatcccattgtttggtgaggtgatcatttgcgaggaagttgactattagcatgtattaagataaaaaggaaagagatgagaaaatgtttttgaaatttagtacgatatgccttgcagtgcctgtatctgttgcattcatatttgtgatcagctggaatgaagtggcttgcattc

SEQ ID NO: 1226 - DNA, 406 bp, Zea mays
  Clone ID: LIB3227-019-P1-K1-A7
gaaaaagaaaagctgatgcagtgaaggaagaaactacagagacacctaaaagtgatgctgttgatcatccaaagaaaagaggacgtccaaaaggtgtaagatccagcaatggcacacctagtaactcagctactccgagcacaaaggggaaaactgcgggcaagaataccaaagaaacaccaaaaactggccccaatcttataaaggaacttgagaagagctccaaggacaaagctagtgtatcaactgagacaaaggatgaattgcctaaagatgacaagagtgcaagcagacctaaggaggctattagcaaaggcaaggattcaaaagacgaaggcaagtccactgaaggaaaagctaggccaggtcggaaactaaaaaatgctggtactcctgcgggtgacgc

SEQ ID NO: 1227 - DNA, 404 bp, Zea mays
  Clone ID: LIB3227-019-P1-K1-A8
tgaagtcccaggaggaaatttttcatggtctaattgaggatattcacaagggcggagaggataaagaaaagcagtttgagaagttgttgcaggaagagcgctcaaaggccagacgctttgatgttgattctggaactatgaaagatcgtcagctaaggaaggaatatgtgcagaagttcattgattgccaagtcaaggatgtggcagagtttgaagttgagcgagatgagctgatcaaagtccacgaggacaagaagttgaagctcaagaaagaatacatggatctggagctggagctggagaaggagtttgacgcagccctgacgggcctgatggagaagcataagccagataccttcgaggcctccagctcgtaagggggcttcagcggcttagcgcttttc

SEQ ID NO: 1228 - DNA, 415 bp, Zea mays
  Clone ID: LIB3227-019-P1-K1-A9
ctccactcctccagctctccaagctgctctacctgtgggcgctggagccggcggaacgggacgcggtcgtggcgcgggaggcggtcgagggcggcgtcaccgcggccggctaccgcgccctcgtcgaggtgttcacgcgccggaagcaggaccagctcttcttcaccaagcaggcctacgcggccaggttcaggaggagcctggaccaggaaatggccaccgagccgtctcacccttaccacaggctgctgctggctctcgcggcctcccgcaggtcgcaccacgacgacctcagccagcacgtggcgaaatgcgacgcgaggaggctgcacgacaccaagaacagcggcgctggtgctggttctggttccgtcgtcgacgaggctgtgatcctcgagatgttcagcaagaggag

SEQ ID NO: 1229 - DNA, 415 bp, Zea mays
  Clone ID: LIB3227-019-P1-K1-B1
agagcactgagctgctgatcaggaagctgcccttccagaggctcgtcagggaaatggacaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagtgtcgaatacttaagttaacta

SEQ ID NO: 1230 - DNA, 310 bp, Zea mays
  Clone ID: LIB3227-019-P1-K1-B10
gtagtaaggcctgggcaccaaacaatggcattctgtgcagtgggtgctagggtggccgaacatcagggtttgctactacaccgtacggtgtctcctctggtgctaagagcaatgctatccaaaccattcttacatacaagcactggaaggtgacgaataaggatcttgttattaaagcacgtgagctgctgttcaagcaagggtacactcaacagcctgtactagggtgtagcgtttaccatatttcatgtatcattcataattcttaaaactggattgttacagggataggttttacatcattcttttg

SEQ ID NO: 1231 - DNA, 355 bp, Zea mays
  Clone ID: LIB3227-019-P1-K1-B11
caagaccgacctccgcttccagtcctccgccgtcgccgcgctgcaggaggccggggaggcctacctcgtcggcctgttcgaggacaccaacctctgcgccatccacgccaagcgcgtcaccatcatgcccaaggacatccagctcgcccgccgcatccgcggggagcgcgcctaggcggccggccggataggccgtggcccgtggcgcaggctcttctcggaagtttgtactagtggtcgggtcgtgtggaaggagtggtgtactgatcatcaatgtctcaaaccatgtcaacctctttgttgtcatcaatggaaatcgccacttatgtgtgcaattaaaacataatcattatct

SEQ ID NO: 1232 - DNA, 405 bp, Zea mays
  Clone ID: LIB3227-019-P1-K1-B12
tcgccaccgtggatgtgtcagttgtagacctcactgtcagaatctagaaggggggcgcctacgaggaaatctttaaagctattaatgccgcttctgagggcccactcaagggtatcatgtgctacgttgaggaggatcttgttttcacccacttcacccgtgacaggaagtctagcatctttgacgccaatgcctggattgccctgaacgaccactttatcaaacttgtcttgtggtacgacaactagtggggctacagcaacctcgtcgtctacctgatccaccacatgttcaagacccaataggctagtaaagagatagatttctgcctccctatcttgggtcgtccccaatggtctttggttgcataccatcttttgcttcttttttttacttagatataaa

SEQ ID NO: 1233 - DNA, 258 bp, Zea mays
  Clone ID: LIB3227-019-P1-K1-B2
taactattaagttcttgtatgtgtcaagttttggttggtgttactctccttgtcttggtaaatagggccctttaacacaatgcaagacctatagaaaggactgtaatatgttaacatatttttttgattgcctcacacctctttctttgccaagccattgaatgtttattccttttttccattaccatttatggaatgtcgaatcagtttgcacccaaaccttttgaggaacttgaataaagagagaacttacagttg

SEQ ID NO: 1234 - DNA, 377 bp, Zea mays
  Clone ID: LIB3227-019-P1-K1-B3
cccaccaacagcaagcgaaaatctcccgatcccctctagtctccgcggcgaaaatgtcggggcgcggcaagggcgggaagggcctgggcaagggcggagcgaaacgccaccggaaggtgctccgcgacaacacacacgggatcacgaaaccggcgataccgcggctgtcgcgcacaggcggcgtgaaacgcatatcccggctcatatactaggagacccgcggcgtgctcaagatatttctggagaacatgatccgcgacaccgtcacctacaccgagcacgcgcgccgcaagagcaccacaaccatctacgtcgtctactcactcaatagccaggggcgcaccctctacttacttttcggctagtttagttacgcc

SEQ ID NO: 1235 - DNA, 411 bp, Zea mays
  Clone ID: LIB3227-019-P1-K1-B4
cccacgcgtccgcccacgcgtccggaaggagatcccatctgaggtggtttatgagggtgagaaggttagtattatctatgccatcagggtagagttcctatcgtttataatgctatgaatgttagtatgttacactttaaaattaatgttgcctcaatgcctttgtcaccttggtgctatgttgatgttcctccttgatatgccattggtaaaactcaagaaccaggtatccctgcatattcctccttgaaattctgggctccaaaatctttgtaagttgtctctatcacccttgctgccatgtcagcagaggatctcacattcaaatctttaatgcttaagaaggatattaattggtctatcataaaaaaattgtgctcctgaaataacaccttgatttccttggcaagc

SEQ ID NO: 1236 - DNA, 411 bp, Zea mays
  Clone ID: LIB3227-019-P1-K1-B5
ggcctttgcatacgcgtgaaacttgtacggagtctccctcctcgttacaaggtggacataagggttgcccctggatcacatgcaactgaagctgctgtgaataagcaactgaacgacaaagaacgtgttgcggctgcattggagaacccaaacctactggacatggtcgaagagtgcttatcaccaacatttgattgaggcctgaatatcaatatatcggtgtgacatggtgttgatgttcaggagccacacatgctcattgccaatggagttcactcctgtctttcgagaaccaaaatgccttgggtgttaagtgacgtgttgcatgatttttttcctccgccccgttcagttattatatatgctactatggcgctaccctttttggacgtttttggtgcttgtgacctc

SEQ ID NO: 1237 - DNA, 61 bp, Zea mays
  Clone ID: LIB3227-019-P1-K1-B6
taaaaacaaaaaacaaaacaaaaaaaaagaaaaaaaaaaacatgaaaaatactcaaggggt

SEQ ID NO: 1238 - DNA, 411 bp, Zea mays
  Clone ID: LIB3227-019-P1-K1-B7
gtacaaccaggagctggacctcaccctgcagcagcggatgcgctgggtgcagcgcaagtacatgatctacaactactgcaccgaccccaagcgctaccagcagggcctccccgccgagtgctccatgcagtagcgcccggttattcctcgcccgtccaacaatggcgcgcgcgcgcgtgtgtgtgcatgtggtccgctctactgctaccgctacgacgatcggtgtcgatcaccggatcaaggcaagacgaaaggcatcgaaacatggtagataaataaaggacttgacgatttgtaacgcagtagctggtgcgtgcgtggtgtggtggtaagaaattcttctgctgcctgtgttcttgtagcctcctcgtcctcgcccacccttgtggtacgtgtacggtgtacgtagtc

SEQ ID NO: 1239 - DNA, 142 bp, Zea mays
  Clone ID: LIB3227-019-P1-K1-B8
aaaaaaaaaaaaaaaaaaaaaaaaaaaaaaaaggacaaacgatataaaaaaaagcaggattacctacccttttatgcgatccaaaatttcttactcttgcatacctaaattcaattcacttatcgggtgacctacaaccaat

SEQ ID NO: 1240 - DNA, 417 bp, Zea mays
  Clone ID: LIB3227-019-P1-K1-B9
ggagtaaggcctgggcaccaaacaatggcattctgatcagtgggtgccagactagccaaacatcagcggatgcaactacaccgcagggtgtctcctttggtgctctgagcaatgctatccaaaccattcttgcagacaagcacgggaaggtgacgaataaggatctcgtgatgaaagcacgtgagctgctgtccaagcaagggtacactcaacagcctggactatactgcagcgatgagcatgttcatgtcgctttcatatgctaaaacttggattgttacagcgattgctttcctccatccttttgtgttgatcggtgcaccagaggttgatgtttttcgtcccatgtatgttacagttatattgtatcagtgtttgttgcttgaggatatgtttcaatggactatgtcaatattg

SEQ ID NO: 1241 - DNA, 260 bp, Zea mays
  Clone ID: LIB3227-019-P1-K1-C1
ccccccaaaaccaccactgttttattgtccaaacaaaatacaaatacccctaaaaaaggggtacaaatagaaaacctggcctgccctaataattaaccccaccactggtggttttaaggctgtaatctcaaagaatggccaaacacgttaccatcccctccttgggttaaaacttgaaaaaaaaaaaataattttctcctccaacaaaatggatgcacccacccccaaatccttaaaggttctttaccaatgaaatttac

SEQ ID NO: 1242 - DNA, 299 bp, Zea mays
  Clone ID: LIB3227-019-P1-K1-C10
aaaaataaaaaaaaaaaaaaaaaaaaaaaaaaaaaaaaaaaaaaaaaaaaaaagggggaaaaaaaaaaaatttaaaaaaaaaaaataaaaaaaaataaaaaaaaaaaataatatttggtccgcctttttagattttccatttttacttcccattatttattactttttcgtttttttttaacgtcatctaatattaaattctttggccttattttaataatttgttttttggaaattcctttttttttcccatttttttttatttataattctttcactttttttccatttgtaatttt

SEQ ID NO: 1243 - DNA, 326 bp, Zea mays
  Clone ID: LIB3227-019-P1-K1-C11
aaccactcccctcttccccagttccccttgtcctttgcgcaggggaaaaggggggccgcataccgagggacggcgactaggtatccaatggccgaccctgacgtgatcgaagtgaccttcggcaacgacgtgattaacaccaccgtcacatcctccggccaggctgtggagcgctggatcgcggagatcctcgcgttgcaccgccccggcagcaacggctacagcatcatcgtcgggcttgacgttgagtggcgcccaagcttcggcccgcaccaaaacccggtggccaaactgcacttttgcttcggacacagctgcctaatttt

SEQ ID NO: 1244 - DNA, 72 bp, Zea mays
  Clone ID: LIB3227-019-P1-K1-C2
aaaaaaaaaaaaaaaaaaaaaaaaaaatttaaaaaaaaaaaaaaaaaaaaaaaaaaggggggaaaaaaaaaa

SEQ ID NO: 1245 - DNA, 414 bp, Zea mays
  Clone ID: LIB3227-019-P1-K1-C3
acgcgagcatggacggatatccggtgcttgctttgatgcggctttgggaatcattccagggctaaaggttcgtggaactgattactccactgcagatggaacttgtattagggactacatcgatgtcacagaccttgtagatgcccatgtcaaagctctcggtaaagctcagccaggcaaagttggaatctacaacgtcggaacaggccaaggtagatcggtgaccgagtttgtagaagcttgcaagaaggcaacgggagcttccatcaaggtcgaatatcttgcccgtagacctggagattacgccgaggtatacagcgacccgtcgaaaatcctcagggacctcaactggacagcccaatacacggatcttggccaaagccttgcccaggcgtggaaatggcagaaggcgca

SEQ ID NO: 1246 - DNA, 409 bp, Zea mays
  Clone ID: LIB3227-019-P1-K1-C4
aaacatatcatatatatgttcacgttattaccgtgctccagagctcatatttggggcaactgagtacacaacatcaattgatatttggtcagctggatgtgttcttgctgagctgcttcttggccagcctctcttccttggtgaaagtgctggggttcagttggttagaatattaaaggtcttgggaccccaacgcgcgaggaaattcgatgtatgaattcaaactacaccgagtttagatttcctcagatcaaagctcacccatggcacaagattttccacaagcggatgcctccagaagctatagatctcgcttcacgcttgctccagtattcaccaaatctaagatgcactgctcttgaagcgtgtgcacatccattctttgacgatttgcgagaaccacatgcga

SEQ ID NO: 1247 - DNA, 262 bp, Zea mays
  Clone ID: LIB3227-019-P1-K1-C5
cgggcttccttctctgtcgtaagcctccacgactttggcttcggccaagccggttccggaagacacaagatacggtgtattccggatgtgaataaacgtgtgtgagtaataacgcagacgtgtttaataaaaagctgcctgcacgcacccaatgtgtgtgcacaaataaaaatttcgccctggtttttctgtcgtcgaaatgtgttgattgattgatggtacaagagtgttgttcatttcatatattactatctgatgaaaa

SEQ ID NO: 1248 - DNA, 251 bp, Zea mays
  Clone ID: LIB3227-019-P1-K1-C6
aaaaaaaaaaaaaatataataaaaacaaaatttatataaaaaaaaaaaaaaacaaaggggggaaaaaaaaaattacttaaatattactaatactaaaaaaacctataaaaatctttacactaactttacatatataaattctcactgcgctctcctaatatatgttcacaatttcatattttctcacttttcttactcttctactttcatttattacttcattttttttactaccactctttttttttaat

SEQ ID NO: 1249 - DNA, 411 bp, Zea mays
  Clone ID: LIB3227-019-P1-K1-C7
atcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacg

SEQ ID NO: 1250 - DNA, 419 bp, Zea mays
  Clone ID: LIB3227-019-P1-K1-C8
ctccctttccccaactcgatctcgcacctagggtttcgtctcgccgctctcgtggtccgcgaagatgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggacatcgtcctcgtcggcctccgcgactaccaggacgacaaggccgacgttatcctcaagtacatgaacgacgaggcgcgcctgctcaaggcctacggtgagcttcctgacacgctcaggctcaacgagggcg

SEQ ID NO: 1251 - DNA, 414 bp, Zea mays
  Clone ID: LIB3227-019-P1-K1-D1
ggtttgtccctcaattggccttcagttagtgactaggatcctgtgcaacttcacccgagatgagttttgccctgatccggttccaagcacggtcttagaagagctgaattcggagagcttgctggagcgtcacgccaacaaagacgcgaccagtgtgtttccgtgcaccgctgcccctatagtgtaccacacaccttcaacgttggacgcggcagagagagcagcagacataggaggtggcgcgaagctggacaggaaagcctcaatggtgcagaggagagggtacaccagtgacgacgaccttgacgacctggattctcccctcgcatccctaatcgacaggagcgccccaccttctccgtcaaacggtttcgcacagttcagtgctcggagaggagtttccatggagaatac

SEQ ID NO: 1252 - DNA, 383 bp, Zea mays
  Clone ID: LIB3227-019-P1-K1-D10
ggcatcagcagagctttcccgtgaggaaaatgtgtacatggcgaagctcgccggggaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttcttgaatcttaacttgtgccggttttcaccggttccgagtccaagggcttttatctta

SEQ ID NO: 1253 - DNA, 411 bp, Zea mays
  Clone ID: LIB3227-019-P1-K1-D11
gcaaggccgacgaggggttcagcgccactgtccgcaacggcgccgtgtgcctggcgcccaccaacccgttcgacgagtaccagcactggatcaaggacatgcgccacagcaacagcgtaaaggacgaggaagggtacccggccttcgcgctcgtcaacagggtcaccggcgaggccatcaagcactcccagggcgagggccacccggtcaagctggtgccctacaaccccggctaccaggacgagtcggtgctgtggacggagagccgcgacgtcggccacggcttccgctgcgttcgcatggtcaacaacatctacctcaacttcgacgcctttcacggcgacaaggaccacagcggggtgcgcgacggcaccaacatcgtgctcttgaagtggtgcgagggcgacaacc

SEQ ID NO: 1254 - DNA, 417 bp, Zea mays
  Clone ID: LIB3227-019-P1-K1-D2
ggcataccgtcatcaacagcacaggtggacttgtggtgctgccaacctcttcaggaaaatggccggggacattgttataagcaagggggcgactgtatggaagaagcttcaccttctgtacagcttcttcttcgtccgaagggtcatcgctcccatcctaacgttcctgttctactgcgtcgtgatcccactgtctgtcatggtccccgaagtcagcatccctgcctggggaatgttctacattcccactgccatcaccatcatgacagccatcaggaatccttggtctatccatctggtgccaatatggatcctgttcgagaacgtcatgtccatgcaccgaatgcgcgcggcgctgacggggctgctggagaccacgtacgtggacgagtgggtggtcaccgagaaggtgggcga

SEQ ID NO: 1255 - DNA, 405 bp, Zea mays
  Clone ID: LIB3227-019-P1-K1-D3
ggtactgctgcctaccgcgcgtctcgtcccttcgctgccgctctatctatctcggccggagccatgggcggcggtggcgcggcgctgctgctgctggtgatgtgggcgggcgtggcgtcggcggccgtgtacgaggtgggcggcacgattgggtggaccgtcatgggcaaccccgactacgccgcctgggccagctccaagcagatcgtcatcggcgacactgttgtgttcacgtataacaagcagttccacaacgtgctggcggtgagcaaggcggactacaagaactgcatcgccaccaagccgacggccacctggtccacggggaacgattccgtcgtcctcaacaccacgggccaccactacttcctctgcggctacccgggccactgcgctgccggccag

SEQ ID NO: 1256 - DNA, 416 bp, Zea mays
  Clone ID: LIB3227-019-P1-K1-D4
ctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgt

SEQ ID NO: 1257 - DNA, 303 bp, Zea mays
  Clone ID: LIB3227-019-P1-K1-D5
cgcttgtattgctccgttatttcagttgctatacaagcggcacaaacagggaaccggggggacggcagcattaacgacggattggcttctgacttgagcctgaactctggagcttcaagagaagagagcctgaactctggagcttcaagagaagaggggtgactttaaggtgccttctcatttatttcaaagtggcaactctaaggaagccagatcgattttggtggaaagctattccaaccaacgtgccatatctctgcccacctttctttagttgaagcttcagagtacatgcttcaaatt

SEQ ID NO: 1258 - DNA, 386 bp, Zea mays
  Clone ID: LIB3227-019-P1-K1-D7
ccgacggggatgtacgggtgcgtgaactacctcaaggagaagtatgggaatccagcgatctacataacggagaacggaatggaccagcctggaaacttgacccgagaccagtacctgcgcgacgccacgagggtgcggttctacaggagctacatcggccagctgaagaaggccatagaccagggagcgaacgtggctggctacttcgcctggtctctcctcgacaacttcgagtggctggcagggtactcgtccaagttcggcatcgtctacgtggacttcaacacgctcgaacgccacccgaaggcgtcggcctactggttcatggacatgcttcagaagcattgagatctccagagccgagcctgagcacggaaggtaccatt

SEQ ID NO: 1259 - DNA, 415 bp, Zea mays
  Clone ID: LIB3227-019-P1-K1-D8
gtggatatggtccttggtggaatgagagggatgattggaatgctttgggaaacgggcctacttgacccagaggagggtattcgttttaggggtctctcgattccagagtgccaaaaagtgctgccaacagcagttaagggtggtgaacctttgcctgagggtctcctttggcttcttttgacagggaaggtcccaaccaaagagcaagttgatgcactatcaaaggaattgcttgcgcgctcaactgtcccagctcatgtctataaggcaatagatgctctcccagtaactgcacatcctatgacacagtttaccacgggagtaatggctcttcaggttgagagcgaatttcaaaaagcttatgacaatggattgccaaaatcaaagttttgggagcctacttatgaagactgct

SEQ ID NO: 1260 - DNA, 385 bp, Zea mays
  Clone ID: LIB3227-019-P1-K1-D9
ccagagactcagtgccctccagtccagcatccaagaacttaaaacgaacgccggggcatccgaagaggtagaactcgggagtgtcaggtaccaaataacagaagctgagggtaccatcatgcagctgatcgataccaacagtaagctatccaagaaggccgaggagttcacgtctcccgatggccccgatgcggagaacagtgacttgaggagcaggcatcagcgtaagatcttggagcgtgcaaggaagatgtccgagaagatcgggaggctggaggtggaaatgcagaaggtgcagcaggctctgctcaaatacgaggaggagcagagttccaggagtacctcaaaagccctgcagcggcggtccaaagtgcagctcgtggag

SEQ ID NO: 1261 - DNA, 415 bp, Zea mays
  Clone ID: LIB3227-019-P1-K1-E1
gaagcaccaccagctaccagggatgtctggcgaggaggaggagaacgccgcggagctgaagatcggcgaagagttcctcaaggccaagtgcctgatgaactgcgaggtggcgatcatcctggagcacaagtacgagcagatccagcagcacgcgtcgtcggagtcggacccgtcgtcgcaggtgtcgcaggtgttcgagaagtcgctgcagtacgtgaagcgcttcagccgctacaagaaccccgacgccgtgcgccaggtccgcgagacgctgagccgctacggcctcgccgagttcgagctctgcacgctcggcaacctctgccccgacaccagcggcgaggccaccgcgctcgtcccctccctcaagtccggcggcaggttcgtcggcgaccccggtgacgagaagatcgag

SEQ ID NO: 1262 - DNA, 341 bp, Zea mays
  Clone ID: LIB3227-019-P1-K1-E10
cgggaatgttgagctcctctagttggatcacgagactggctaaaagttgggtgctaagatttgtagttggttaccgttgtgaatttctcaagtgatattatcctatgcttgtctcaatgactcaaatttggttgtggtttctatgcttttggctgtgtcaatggtttgccattgttgaaattcaacccttaatgctgcctcttataataaaaagtttttttattggtctggttcaaaaaaaaaaaaaaaaaagacaaacattataaaggatccaatcttacgtacgcatgcatgcaacgtcttagcttttctataaagttacctaatttcaattctctggc

SEQ ID NO: 1263 - DNA, 411 bp, Zea mays
  Clone ID: LIB3227-019-P1-K1-E11
cttcaagaaggatagggatggctattggaagtggtttgctggcaacctggcctggggtggtgctgctggtgcttcctctttgttttttgtgtactccctggactacgcgagaacaaggttggctaatgacgcgaaggctgccaagggaggaggtgaaaggcagttcaatgggcttgtcgatgtctaccgcaagacactcaagtctgatggtattgctgggctttaccgtggatttaacatctcctgtgttggaatcattgtttatcgtggtctgtactttgggctctatgattccatcaagccagttgtccttactggcaacctccaggacaatttctttgccagtttcgctctgggttggctgatcactaatggtgctggtcttgcatcttaccccatcgataccgtccg

SEQ ID NO: 1264 - DNA, 395 bp, Zea mays
  Clone ID: LIB3227-019-P1-K1-E12
catctacttccgtgatggcgtgagcgtctggcagttcgatatggtcctgaacggggagctggctgacctggagaaggcgatcaaggtgaatggctatgcgccaaccatcaccgcggtcgtggccaagaagcggcaccacactcggctgttccccagggacgaacagcagccgcatacgaagaccgtgaacgtgcctactggcacggtggtggacacgggcgtggtggacccgtccgcgtacgacttctacctgtgcagccacactgggattctggggacgagcaggccgacgcactactacaccctggtggacgagcacggtttctgctccgacgacctgcagaagctgatctacaacctgtgctttgtgttcgcgcggtgcaccaagccggtgt

SEQ ID NO: 1265 - DNA, 392 bp, Zea mays
  Clone ID: LIB3227-019-P1-K1-E3
cagaagaacaagatcacaatcaccaacgacaagggccgtctctccaaggaggagatcgagaagatggttcaggacgctgagaagtacaagtctgaggatgaggagcacaagaagaaggtggaggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgagga

SEQ ID NO: 1266 - DNA, 409 bp, Zea mays
  Clone ID: LIB3227-019-P1-K1-E4
gggtggaaccttggttgatcgcaaggccgctggcagtgggcatgggccatcaccggatgacaacggaagcatgccagaatctttctataccaatggtgggctgaaactccgtgtcgtatggactatcagctgtttgatcgccgcgtcgacaaggcactatcttctccggtcgatcatcaacgaccatccgacgctgaggagcctggtcttggcagatgccgagggacagggcacactctccatgggggcagagcagctgaatgatttcagggaacaccagttgtcagcctcaccatgttctaacaggacgcaggtgccggcatgcaacatgaagctgaagtacgctcggtacctcgaattgcctggtggcttggcactgcaaggtgcaaccttgcttgtcatcaagcct

SEQ ID NO: 1267 - DNA, 370 bp, Zea mays
  Clone ID: LIB3227-019-P1-K1-E5
gggcggacgcgtacgtgtgaatgttctggacgtgcatgtggcctttggctgaaatcaatcaagccataggggagtgctcaattgctggtgctgttgttggctgaaagagaagtcattttggaggatgtacaaccaagtgcagtttctacaagatcatctgctcttacaccaagtgaccctgtcacaggggacatatatgagaagctcaatgttgttgctaaaagagacggcggtattagtatcttttatgttcaaggaacacttgctcttgacgttcttaatgatactgatgggttgatacatccgcggattgaccgacctgatatgcctgggcttaacttcaaaacacacccatgtattaataaggatt

SEQ ID NO: 1268 - DNA, 150 bp, Zea mays
  Clone ID: LIB3227-019-P1-K1-E6
gttttgacctgtcttacgaagcaaaaaatttaaaaaaaaaaaaaaaaaaaaaaaaggggaaaaagggcggccgttctagaaaaatccaaagcttacaaacacgtgcatgcaaacgaaatagcttttctatagtgtcccctaaattcaatt

SEQ ID NO: 1269 - DNA, 412 bp, Zea mays
  Clone ID: LIB3227-019-P1-K1-E7
gatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggccgtcggcgcgttcgttgccggagcctctgtctgcggctacagaggaaagagtattcagtcagccctcatcggaggctcctgtctggctttcacatctgctgtgctggacattggcggcaatacgaccagagttgacaacggcaaagagtactatgcct

SEQ ID NO: 1270 - DNA, 415 bp, Zea mays
  Clone ID: LIB3227-019-P1-K1-E9
cactgcgccacgggcgactgcggcgggcggctccagtgcggcgggctcggcggggcggcgcccgcgacgctggcgcaggtgaacctccaccacggcaacgaccagacctcgtacggcgtgagcgtggtggacggcttcaacgtgggcctgtccgtgaccccgcacgagggccgcggcaactgccccgtcctcgcctgccgcaagaacctcaccgagacctgccccggcgagctgcagctgcgctccccggccggcagcgtcctcgcgtgcaagagcggctgcgaggccttccgcaccgacgagctgtgctgccgcaacatgtacaacagcccgcacacctgccgcgcctccaagtactcggagttcttcaagcgagagtgcccgcaggccttcacctacgcgcacgacagcccct

SEQ ID NO: 1271 - DNA, 375 bp, Zea mays
  Clone ID: LIB3227-019-P1-K1-F1
aaaaaaaaaaaaaaaaaaaaaaaaaaaaaaaaaaaaaaaaaaaaaaaaaaaaaaaaaagggaaaaaaaaaaaaaaaaaaaaaaaaaaaaaaaaaaaaaaaaaaaaaaaaaaaaaaaaaaatgggggggccgttttaggggttcaaagtttatttccccttgcttgcaacttattattttttttttagtgtcccctaatttaatttaattggccttttttttaaaacttctttattggaaaaaccttgtgtttcccaaatttattcgctttgctttaattcccttttttccaagttggtttattaccaaaaaggccctccctttttccctttccaaaaagttgcccaccttgtttgttaattggaccccccccttt

SEQ ID NO: 1272 - DNA, 410 bp, Zea mays
  Clone ID: LIB3227-019-P1-K1-F10
aaacaaatcaagatcttatcatggcagaaggaggtgtaaccttgttgtctatggcggcatctgatgcataggatccacaaactcttagaatggtggctggagcaatagctaacctttgtggcaatgacaaactgcaaatacggttgaggggagaaggtggaattaaagcattgcttgggatggttaggtgtgggcaccctgatgtccttgctcaagttgcacgtggcattgcaaattttgcaaaatgtgaatctagagcagctactcaaggaaataaggtgggaaaatcactattaatcgacgatggatcgcttccttggattgtaaaaaatgccaataacgaagctgccccaattaggcggcacatagagctcgcactgtgtcatttggcacagcatgaagtaaattcg

SEQ ID NO: 1273 - DNA, 411 bp, Zea mays
  Clone ID: LIB3227-019-P1-K1-F11
gtcaaaactggagggtcattctccccaatatcaacgtcctcgtcaaagagctgagttacttcctcgttacacactgacgcattgatgagttcatattgacttcgagacttaacctcatgaggatcctgttctgtaaggtttcttgatgggttaactctgtcatagtcatcaagtagcctcagtaattcaaaaagtgtatcatcacctagagcatccatatcaagctctaattcctcttcgttggcgtcgcaatagtcagcgtgactccttatgagctcaactacatgatctggaatgaatgcaccatatgactgtaatcttgcacttaaatcatatttttgctcactcgtcattattctctttctggttggaacaatatcccctaccaaaggagcatcttgtaccaaagga

SEQ ID NO: 1274 - DNA, 365 bp, Zea mays
  Clone ID: LIB3227-019-P1-K1-F2
cagacgctgcgccctttcttcgacgagtggcccaagtcgagggactcgtggccggagctgggcgaggacagcagcctcggcttctcggccacccagctctccatctccattcccatggcgacctccgacttctccaacaccagctccagatcgccgagtggaataccgtcgagatgaacgagtaccgtgcatgtggatcccagcgtcttagggttgacgactcttcggtgctgacctcgtcgtatcatgctcctaaattttcgaacgatatatgccttatgtaacgctatttctctcattgttacaacaccctttacccgtttggaattgtgttgaagtggatggtctgcgttgctcggttgttc

SEQ ID NO: 1275 - DNA, 413 bp, Zea mays
  Clone ID: LIB3227-019-P1-K1-F3
ctcgcagacaggaaggaggcgcttgacagccgcaagatcatatttgctcgcgccaagcagtacgcccaggagtacgacgcccaggagaaggagcttgtgcagctcaagcgtgaggctcggttgaagggtgggttctatgtgagcccagaggccaagcttctgtttgtggtccgcatccgtggtatcaatgccatgcaccccaagacccgcaagatcttgcagctcctgcgtttgaggcagatcttcaatggtgtctttctcaaggttaacaaggcaactattaacatgctacggagggtggagccatatgttgcgtatggatacccgaacctgaagagtgttagggaattgatctacaaaagaggttatgggaagctgaacaagcagaggattccgcttagcaacaacaatgt

SEQ ID NO: 1276 - DNA, 418 bp, Zea mays
  unsure (1)..(418): unsure at all n locations; Clone ID: LIB3227-019-P1-K1-F4
ccccactcccgggtctccagcattcctatcctctccccgcccgcccgtgccgccgccgccgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaagctgcaagatctgcttccgtcgattatcaaccagctnggtcctgac

SEQ ID NO: 1277 - DNA, 408 bp, Zea mays
  Clone ID: LIB3227-019-P1-K1-F5
gaccaagatcggcgtcctcaacacgcccttgtggtacaccgccggcgagcagcagtacgttcaccgacaccaccaccctcttcatcatcgagctcatcctcatcggctgggccgagggccgccgctgggctgacatcatcaagcccggaagcgtcaacaccgatcccatcttccccagcaacaagctcaccggcaccgacgtcgggtaccctggtggcctgtggtttgacccgctcggctggggctccggctcgccggagaagatcaaggagctgcgcaccaaggagatcaagaacggacgcctcgccatgctcgccgtcatgggcgcttggttccaggccgagtacaccggcaccggccccatcgacaacctcttcgcccacctcgccgaccctggccacgccacca

SEQ ID NO: 1278 - DNA, 418 bp, Zea mays
  Clone ID: LIB3227-019-P1-K1-F6
cgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagaggcttttgaaagcatcgagatcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagg

SEQ ID NO: 1279 - DNA, 409 bp, Zea mays
  Clone ID: LIB3227-019-P1-K1-F7
gcacccttttagggtcgtcacaattgatggaaaggagatggcaataatcgaggatgatgcaaagcttcgagcactcaaagaagaacatggagaagaaatctatgcaatggtgacaaaggcgctgcttgaaaccaacgagtacaaatcaaaaggcagctaccctgtgggggagctatggaacttcaaagaaaaccggaaggtgactctgaaggaagctgtccagtttgtcctgagacagtggcgaacaaacaggaggaagcgataagctctcggctactcaatgctcttggctttttttccccaccacctgatccgaaagccatgagttcgagagctagtaacctggaaacagtagtattaattcgtgataaaatcaacagggcgatacagccctgtggatctgttcctt

SEQ ID NO: 1280 - DNA, 207 bp, Zea mays
  Clone ID: LIB3227-019-P1-K1-F8
gtgaagcttgagaggcctgtcgagggagatgaggctgggcaggaggttgctgctgccgagtagtttgtttgctacttctgtatctaggcgagtctggacatgaggttgcttatgacgtgaacttattgagttgtcttggctacgtgttttcatctggccctaagattttgtcttgaaacaagtttaaaattaagattactcgtggcg

SEQ ID NO: 1281 - DNA, 411 bp, Zea mays
  Clone ID: LIB3227-019-P1-K1-F9
gtgccctccaggctctgatggagggtcttcaggtccttcccttggaggacgtggggtctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagg

SEQ ID NO: 1282 - DNA, 363 bp, Zea mays
  Clone ID: LIB3227-019-P1-K1-G1
cacagaatcattcccagcttcatgctccaaggaggtgacttcactcttggggatgggaggggtggtgaatctatctatggcatgaagtttgctgatgagaacttcaagatcaagcacactggaccaggccttctgtccatggccaatgctgggagagatacaaacggatctcagttcttcatcaccaccgtgacaacaagctgattgtacggaaagcatgttgtgttaggcaaggtgttgtctgcgaatggatgttgcgtacaaggcggaagctgacggccagcagagcgggcaaccaaagagcacggttgtcatagcacatagcaggaacctgccgatgtgatgagctgaactgatgttcta

SEQ ID NO: 1283 - DNA, 412 bp, Zea mays
  Clone ID: LIB3227-019-P1-K1-G10
gatggctcaagtggtgtgaaccccagcgctggtgattcaagagtcattccggggggtcctagagagctcgaggaatacattgcaactgcatattccagcatccgccaagaggaggcgaagtcaaatgcaccaaccttctacacaactatcagaacacttttgagcatactcctgatctctattgacttggcaagactgagtgtctcaaaaactgtggctcatagcgatgtccacgaagcactgcgactgatgcaaatgtccaagtacttattatactcatacgaccgccagcggtctggccttgatgcaatatctgacatattttccattctgagagacgaagctgctaggacgagcatcatggatgtgagatacgctcacgctcttaacttgatctccagaaagggataca

SEQ ID NO: 1284 - DNA, 148 bp, Zea mays
  Clone ID: LIB3227-019-P1-K1-G12
tccagagcccctaaaaccctatatgggtggactagagttgctctccccaaaatgcaagttaccctcttctgtcacccgctgttgtgcttgtgtggacttaaaactgtctggctgaagtacaagttaaaggaaggtcatttcttacttc

SEQ ID NO: 1285 - DNA, 319 bp, Zea mays
  Clone ID: LIB3227-019-P1-K1-G2
ggaggacgcacttctgggaagcctggccccagcccccgcgccggccgttggcggtgccgcggggctgcctggcggcaagccgggggcgtgggccgtcgccgctctggtctctctcgtcgccttcctcgtgatctgagggcgtggggatcgtgctgcgcatcgcgggagatggagggacgaatcctgcgatctggatcgcagagagagaggagagggggatatttatgttcgttctgtttgttctagggtgcctctcttttgcctgtataagagaggatcatgattttttttatataataataccgtttatttgtcattc

SEQ ID NO: 1286 - DNA, 160 bp, Zea mays
  Clone ID: LIB3227-019-P1-K1-G4
aaaaaaaaaaaaaaaaaaaaaaaaaaaaaaaaaaaaaaaaaaaaaaaaaaaaaaaaggaaaaaaaaagggcatcttatctaaaaagaatccaaagcttacatacgcgtacatgcagacgacaaaatttttctatagtgtccacctaaattaaattcaggg

SEQ ID NO: 1287 - DNA, 301 bp, Zea mays
  Clone ID: LIB3227-019-P1-K1-G5
cagctcaagaagctcgtcgccggcggcaagctgaccaaggtgaagaactcgtacaagctgtcgtccgccaccaagccgaatcccaagcccaaggccgccccgaagaagcccaagaccggcgctaagaagcccaaggccgctgccaagcccaaagctaagacccccgccaaggcgaagcccgccacaaagcccaagcccgccgcgaagccgaaagccgtagtgaaaccgaagacaccccgcaagcccaagggcaagccagctgccaaggcgaagcccaagaccgccggcgctaagccgaagc

SEQ ID NO: 1288 - DNA, 252 bp, Zea mays
  Clone ID: LIB3227-019-P1-K1-G6
atgttgatcattctgctggagatctaattgatcttcttcaaggacttcttcggtatgatcctaatgagcgcctgaaagcacatgaagctctacaacaccctttctttaccagatgcatcagaagatgtggtttctgaggctacactgagattgaaaatgtcaatgctgtatttcttcattttgatgtgtaagaactacaaaaaagtggagatgttctacgaaaaatgaaatatgctaacttgcattctgttc

SEQ ID NO: 1289 - DNA, 408 bp, Zea mays
  Clone ID: LIB3227-019-P1-K1-G7
aaaatgctgaagctgcgggagaagttctgcggtatgttggagtggtggatgtggtcagcaagaaggggcaggtggagctgcgagcctacaagagggaccacccgttcgcgcagctatctggttccgacaacatcatagccttcaccacctcgaggtacaaggatcagccactgatcgtgcgaggtccgggggctggtgcagaagtgactgcaggaggcgtcttctgcgacatactgcgcctgtcttcctaccttggtgccccctcgtagtctgtcaaggttttgcggtgccgtggtgttgtgttgctgctctactactggttttttttgttgttgttagtgcttggaatagctggagtaagtatggattaagtgagttctggggtgttaagggttgggtgtcttagtt

SEQ ID NO: 1290 - DNA, 411 bp, Zea mays
  Clone ID: LIB3227-019-P1-K1-G8
aaaccttctcatggcagtactactactggtacctcaccaacgatggcattgagcacctccgcagcttcctcaacctgccatcagaggttgtgcctaataccctcaagaagtcttccaagcccccgtctcgccccttcggctctggcccacctggtgaccgccccaggggccctcctcgttatgaaggtgacaggcctaggtttggtgatagggatggttacagaggaggtccacgtggcgctccaggtgactttggtggtgataagggtggtgctcctgcagatttccaaccatcttttaggggtagcagacctggctttggccgcggtggcggcggtgctttcggtgctggtggatcttccatggagtgatgtgtcaacatgagctagcataacattcgtctttgaacta

SEQ ID NO: 1291 - DNA, 395 bp, Zea mays
  Clone ID: LIB3227-019-P1-K1-G9
ctgaagtgcatcttgagccagtcatggaagagaggagcacatatgctacatgcgggaaattcagcaccagctgtactaacttgctggagtcaatttcacagtgggcaggtctggagttcttccaggagcttcttcggcgtggaggacttcgtggacgaggacaacagtaggccatacacgtacaagaaggagaagaggtccaagaacccccacaagcacatctcgttcaagcagcgcaccatcgcccacatggagccgttcacgctggacgtgttcatctccaagcgcttcgtctcggcgtccctcacgcaccggtcgacctgcatgcaggtcgcggtcgccttgaccaactccaaggacatcaaggcggcgctcaggtcgaggtccgacgtgcc

SEQ ID NO: 1292 - DNA, 404 bp, Zea mays
  Clone ID: LIB3227-019-P1-K1-H1
gcgcatattctctctgtgagagcccgacgacgaggtagcctgcgactgctataaacccggggcgcccaagccgtcgcacccgcccaagaccaagccctcccacccgtcgccgtcgccgaagcccaagaatcccaagccacccaagggcagcaccggttacccagcgccggggcaccaaccgcccaagagcccctcctaccccccggtcgtcggccctgccaagggcccggtcacgcgcccgccagtcatgcgtacgccggtcgtgggtccttccaagggccccgtcacgcgcccgccggtcacgcgtacgccggttgtcggaccaccggtgacctacccgccgatcaccggccctccgacgacgccgcctgttgtcggaccaccggtgacctacccgccgatca

SEQ ID NO: 1293 - DNA, 212 bp, Zea mays
  Clone ID: LIB3227-019-P1-K1-H10
aaaaccaaacatccgccctttctttctatatataatcaactattacaacgggggcttttttatttttttttactccacactcacacagcccaaaaaatcccaactaaccccaaaaattctccattaaatcccaccattgcacaaacaaaatacaattcccttcaccccccacacccaccatacacttattaaagccccccttttccccaaaa

SEQ ID NO: 1294 - DNA, 401 bp, Zea mays
  Clone ID: LIB3227-019-P1-K1-H11
ggtattcttggttggggtccagttgaaattagacggtatggtaatgagagggcggaacgtgctgttcattctagtcatttccctactgggcatggacctttgctgtagctgaaggaagtagatgatgcgaacaaccttgtccattttggcataaccgttcccagtgaatttcagcttccatatagttataaatggtggatctccgtaggaattgaaattctttttccaaaacaaaaaggaacttagagcaacctaacccggatcacagttttgaattatatgccttaaaaggtaatgccaggactctagaggcgacttatggaattgataacagctacactgaatattgttttgacaccatcacagcaacacaaatacatggtggcttgtgaactgccaag

SEQ ID NO: 1295 - DNA, 96 bp, Zea mays
  unsure (1)..(96): unsure at all n locations; Clone ID: LIB3227-019-P1-K1-H12
aaaaaaaaaaaaaaaagcataaataataaatnttgttgtatccctcgctgctgcacggggggttgtaactttctttaatcctacattaacatcgat

SEQ ID NO: 1296 - DNA, 410 bp, Zea mays
  Clone ID: LIB3227-019-P1-K1-H3
gttgacgcggcagatcgagaaaacatggccattgcaaagggggaacttcatgacctggtgagcaagccatctttgaccgggattccgttactagtgattggcaataaaattgacaaacctgaagctttccccaagcaaacctttacagaactaatgggcctaaagacaatcactgaccgagaagtggcatgtttcatgacatcttgcaagaactctaccaacattgattctgtcattgagtggctggtgaagcactcgaaaaagaagaattgaacttaaatctgcactagctcttaaagcgcactccagtcttcctcttttttgcatgtcgcatagcattggagctgtaaattacgcaagaggtattgatcagggattttgtgtttataattctgttaacccggtttggc

SEQ ID NO: 1297 - DNA, 400 bp, Zea mays
  Clone ID: LIB3227-019-P1-K1-H4
gtttctagcccatttggtgtaatattttcactgctattatcaatggaaagccctcgggtctatcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgcccctttaaaagaaccaaagttaacttccccttccatgcaacgaaaaaactttttaatagggcccccaaaataaaatccatggcccctgttttaaaaacgtgggtacggaaaaaaccctggctttcccaaattaaaatcctttaaaaaaaatccctttttacaaattggtttaataccaaaaaggccccaaccaatcccctttt

SEQ ID NO: 1298 - DNA, 335 bp, Zea mays
  unsure (1)..(335): unsure at all n locations; Clone ID: LIB3227-019-P1-K1-H6
nnnnnntaaaaaaaaaaaaaaaaaaaaaaaaaaaaaacaaacaatataaaaaaacgggagcttacatacacttgtatagcaaataaataaatataaaataaaaaaaacaaaaaaacggggcggccgttctagaggttccaactttccttacccgtaaatcccaggcgttacctttcttattgggccaccaaaataaaattaattgccccggttttaacaacatcgaaactggaaaaaccttgggtttacccaattaaatccccttgcagaaaatccccttttccccaccttgtttaataacaaaaagccccgaacgtatcgcccttccaaacatt

SEQ ID NO: 1299 - DNA, 189 bp, Zea mays
  Clone ID: LIB3227-019-P1-K1-H7
aaaaaattcaagctatattaacactaaccaaaaaaaaaaaaaaaaatccaaatggcgaggtaattattattatctccccacttaaaacaaaccaatctaacctactcaaaaattctacactatacattttcttccaatttacctaaactcaatatacacaccaacaccatacaaaaaatcaccaataaa

SEQ ID NO: 1300 - DNA, 409 bp, Zea mays
  Clone ID: LIB3227-019-P1-K1-H8
gtttcgccggttgtcgattttcctattcgctatggtcatcacgtcagtcgtgcggatccgaacttgcgagctcgccgactgaccgtcgtgttccttgaaatccctcgtcggtcgacctcgcgacttaattcgtccgtcgtgctggtcactggcccatactggacctattagcttggattctggccaacttgtcgtcgtatcgtttaccgtcgagtcgtcaaacacgtcatctgcggctggaccccccaccttaccaactcgctccaaacacgatctcgtcgtcgtttcgtgtgtcatcaagaaatcccaagaatcgggtgaagacgaagctagcaacgcaatatttcccaagcgctcgacatattgcctgtatccgaaaattgctaccgatctcgttgattcatgtcag

SEQ ID NO: 1301 - DNA, 216 bp, Zea mays
  Clone ID: LIB3227-019-P1-K1-H9
ataactcccattttctactctactattcactatgcacaacacatcacacatggcgatccttacttttttttcttcctactaaccaacataatcctctaaatactaataacttctacctctccactttactccttcatcctactgttcacttttccatactcaacctattacctctcaacctcaccaactcttatacatataatttaccactcattc

SEQ ID NO: 1302 - DNA, 379 bp, Zea mays
  Clone ID: LIB3227-021-P1-K1-A1
accgcgtgcgaaccaagcagaccccagcagaagaagcgaagtcgccgccggagcagggggaagagcgagcagcaagatgttgtggcaggcgtacgttgatgaccacctgctgtgcgacatcgaaggccagcacctcagcgccgccgccattgtcggccacgacggcagcgtttgggcacagtccgagaactttcccgagttaaagcctgaggaggttgctgggatgataaaggactttgatgaacctggaactcttgcaccaactggtctttttgttggaggttcgaagtacatggtgatccaaggtgaacctggagttgttattcgaggaaagaagggcactggaggcattactatcaagaaaactggcatgtccttg

SEQ ID NO: 1303 - DNA, 323 bp, Zea mays
  Clone ID: LIB3227-021-P1-K1-A10
ctttaccaaatacaccgccggctctgtttgcccatcttcacgccaagcacggaatgtccgatggcttgtttcgaagcatacagcgctcaagtcgacgggcggtaaggcgccccctaagcagctgtccaccaaggcattacgcatgtctgtccccgcaaccggtggcattaagaatcctaaccgcttccgtcccgacaccgtttcactacggaagattctcatgttccatatgagcacggagctgctcatgtctatgctgaccttccagcgccttttccgtgtgatcgcgcaggattttaagaccttccttctcttccagtcct

SEQ ID NO: 1304 - DNA, 398 bp, Zea mays
  Clone ID: LIB3227-021-P1-K1-A11
gttcttcagtctcaatgcaaatgcaccataccaaacttctccttcagacgctgcaccagtcaagaaggagcccgagagccaggcatggcttggattaggaccgaatgccgtcaagtccaacctgaacctgagctagcacacaacgacacagccaaataagacggcacagcaaacctcaccaaagcctttgcaggacgatctgaaaatatgctttgccactagagtaccgaaaccatgctttgccactagagtaccgaaaccataaatatcctctcgttatcgtgttttagtgttctgtttaggccatggtcctacgccctcttgtcacatagttctggatgtaaagataagtagccagccatgaccgagagaagttttttttggggggtgttaacaca

SEQ ID NO: 1305 - DNA, 340 bp, Zea mays
  Clone ID: LIB3227-021-P1-K1-A12
gtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccggcacctacaccgagcacgcgcgccgcaagaccgtgaccgacatggacgtcgtatacgcgctcaagcgccagggacgcaccctctacggcttcggaggctaggctaggcgcctcttcatagtcggggactggttaggggacatgtgtctgtgtgatgc

SEQ ID NO: 1306 - DNA, 401 bp, Zea mays
  Clone ID: LIB3227-021-P1-K1-A2
accgcgtgcgaaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaacctggagttgtcatccgaggaaagaagggcactggaggcattactatcaagaaaactggcatgtccttgatattcggatctatgatgagcc

SEQ ID NO: 1307 - DNA, 411 bp, Zea mays
  Clone ID: LIB3227-021-P1-K1-A3
cttgtttctcccagttcggtgagcggttagtgttatgatgaagacgacgactacgacgacgatggcgtcccagcgattaacccgtgctgtaatatttgatagaagaagccgtagcccacagtggttttgctgtctctatcctctcctcccttcctccggctcaggattcttttgtagcttggtttgttctcacctgcttcgattcgctctccgatgaatgcagcttgaaatgttggttcagaaaaaaaaaaaaaaaaaaaaacaaacaaacgaaaagataaaaaaaaaaaagaacgattaagaaaaataaactaaattatgaaaaaaaagctaataaaaaaaaagggggggccgttttagaggatccaagctaacgtgcccgttcttgcaagaccataacttttttatggg

SEQ ID NO: 1308 - DNA, 401 bp, Zea mays
  Clone ID: LIB3227-021-P1-K1-A4
gccaaggacacgcgcgggaccgcttacgttgtctacgaggacatctacgacgccaagaacgccgtcgaccacctctccggcttcaacgtcgccaaccgctaccttatcgtgctctactaccagcccgccaagatgtccaagaagtcggatatcaagaagaaggaggacgagatcaccaggctccaggagaagtacggaatcgggtccaagacgcccggcccgggctccagcgactgagcggccagggtattgcctctgcagcctcttgtatgatgaagagcaatcaaaaggaacaaattggttgcgctgtgctgtgttacatccagcgtcgctaattactctgttgttattcaggctccataacaattgaatagatatgtgcttgtctaatcgccagcgat

SEQ ID NO: 1309 - DNA, 374 bp, Zea mays
  Clone ID: LIB3227-021-P1-K1-A5
gtcaaggacacgcgcgggaccgcttacgtcgtctacgaggacatctacgaggccgtgagcgccgtcgaccacctctttggctacaacgttgtcaatcggtaggttatcgtgctctactaccagcccttcaagatgtctaagtagtcggatctcacgaagaaggatgacgagatcaccaggctccaggagaagtacggaatcgggtgcaagacgcccggcccggtctccagcgactgaacggtcagggtattgtctttgcaaactattgcatgatgaacagcatttaaaatgaacagattggttgcgctgtgctgtgttacattcagcgtctataattactgtggttggattcaagcttcataacaattgtgatg

SEQ ID NO: 1310 - DNA, 401 bp, Zea mays
  Clone ID: LIB3227-021-P1-K1-A6
acgggcaagggcgggaagggtgtgggcaaaggcggcgccaagcgtcaccgcaaggttctccgcgacaacatccagggcatcacgaaaccggcgatccgtaggctggcgaggagggtgcggcctgaagcgcatctcggggctcatctacgaggagacccgcggcgtgctcaagatcttcctcgagaacgtcatccgcgacgccgtcacctacacggagcacgcccgccgcaagaccgtcaccggcatggacgtcctctacgccctcaagcgccagggtcgcaccctctacggattcggcggctgagaggcgctaccgccgctggtggccgagggaaaagtcttgggtcgcggtcaagaaatctagagtattctggatgacctgcttagcttcgtagaattat

SEQ ID NO: 1311 - DNA, 403 bp, Zea mays
  Clone ID: LIB3227-021-P1-K1-A7
accgcgtgcgaaccaagcagaccccagcagaagaagcgaagtcgtcgccggagcaggaggaagagcgagcagcaagatgtcgtggcaggcgtacgtcgatgaccacctgctgtgcgacatcgaaggccagcacctcagcgccgccgccatcgtcggccacgacggcagcgtctgggcacagtccgagaacttccccgagttaaagcctgaggaggttgctgggatgataaaggactttgatgaacctggaactcttgcaccaactggtctttttgttggaggtacgaagtacatggtgatccaaggtgaacctggagttgtcatccgaggaaagaagggcactggaggcattactatcaagaaaactggcatgtccttgattatcggtatctatgatgagcca

SEQ ID NO: 1312 - DNA, 398 bp, Zea mays
  Clone ID: LIB3227-021-P1-K1-A8
aacgatcactgattactgataacaaacccaaacaaaactattgaacaatgaaatagataacatgtacaaaaacggataggaactaagtacaaagaagacaaaaatgggggtggaccttttagagcaccaaagttatgaaacgcttgctggcactggctaaattcttataatggggcacttaaataataaaactgggccgcggttttaaaattcttgtattggaaaaaccttggcttacccaaatttattggcttggaagaaaatccccttttacctagctggctatttaaaaaaaagaccacaagggtttgctttttcaaaaatttttcaatttatattgaaaatagggaccccccttttatcctataataaaacccggcgtttgtggtggttccccc

SEQ ID NO: 1313 - DNA, 405 bp, Zea mays
  Clone ID: LIB3227-021-P1-K1-A9
ctttcccaaatccaccgccggctcggctcgcccatcttcgcgccaagcaccgaatctccgatggcccgcacgaagcagacggcgcgcaagtcgacgggcggcaaggcgccccgcaagcagctggccaccaaggcggcgcgcaagtcggcgccggcaaccggtggcgtgaagaagcctcaccgcttccgccccggcaccgtcgcgctccgggagattcgcaagtaccagaagagcacggagctgctcatccgcaagctgcccttccagcgcctcgtccgtgagatcgcgcaggatttcaagaccgacctccgcttccagtcctccgctgtcgccgcgctgcaggaggccgccgaggcctacctcgtggggctcttcgaggacaccaacctctgcgccatccacgcc

SEQ ID NO: 1314 - DNA, 256 bp, Zea mays
  Clone ID: LIB3227-021-P1-K1-B10
aaaaaaaaaaaaaaaaaaaaaaaaaaaaaaaaaaaaaaaaaaaaaaaaaaacataaaaaaaaaaaaaaaaataagaaaatataatagataagggggggtccgtttttttggatcccagcttacgtccccgtcttttcgcccccctgccttttctatactgctccctgaattaagtttttctcccctcgttttcctacgccctctctggggaccccctggttttccccagcttattccccttgtagaccctccccct

SEQ ID NO: 1315 - DNA, 284 bp, Zea mays
  Clone ID: LIB3227-021-P1-K1-B11
caagaccgatctccacttccagtcctcctccgtcacctcgctgcatgaggccgacgtggcctacctagtaggactgtactattacaccaacctttgatccatcaacaccatgcgcgttatcatgatgccaaaggacattcatcttgttcgaccaattacaggagagcgcgtctatgctaccgaacagataggacaacatctgtggaacagactctttttcgaagccagtactagtggaagattcaggccaaatgagtggtatactattcatgaacgattaaaac

SEQ ID NO: 1316 - DNA, 398 bp, Zea mays
  Clone ID: LIB3227-021-P1-K1-B12
ctcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatccttccatgt

SEQ ID NO: 1317 - DNA, 407 bp, Zea mays
  Clone ID: LIB3227-021-P1-K1-B2
agtagtctcagacgagaagaggtgaatatgagttccggcggcggcaggggcaagcccaaggggtccaaggctgtgtcgcggtcgaccaaggctgggctgcagttccccgtcggccgcatcgcgcgctacctcaaggccggcaagtacgccgagcgcgtcggcggtggtgcgcccgtctacctctccgccgtcctcgagtatctcgcggcagaggtgttggaactggcgggcaacgcggcgcgcgacaacaagaagaaccgcatcgtgccgcgtcacatccagctcgccgtgcgcaacgacgaggaactcagcaagctgctcggagctgtcaccatcgccgccggaggtgtgttgcccaacattcatcagacgctgctgcccaagaaagccggtgggaagggcaaggc

SEQ ID NO: 1318 - DNA, 163 bp, Zea mays
  Clone ID: LIB3227-021-P1-K1-B3
cgtgtgccaagcctaccacgtatggaacggcgaagattcacagaaaaggtgtgtgcccctagacgtgggcctggcggcccaagcacgggtctgaccagacaaacctgccacgatgggggccggccaagatggcgcgtgcgtaagccgaccatattttgctcag

SEQ ID NO: 1319 - DNA, 402 bp, Zea mays
  Clone ID: LIB3227-021-P1-K1-B5
cctgaatcacctgttactcagtgtgacctggaccgacttaaattgtcaactgccccctttatggaaaggaacttggaatttctgattgggtgcatggatgatctttcatcagagcagaacaagttccaatattataaccgcaacctctcaagacaacagtcacagcagcaggcatggcttcaaaagagaaggcaggagaacatggcaagaaaagcagctggcgaggagccactgccagaagaagatccatccaatcctatatttaagcctattcctgagccatcacgattggaaggctatcttgtaaccaatcagatctccagttactgcaaccatatcaacggggttgctggtcagaatttcgacaggctatacctgatgaaggccttgcatgaggattag

SEQ ID NO: 1320 - DNA, 346 bp, Zea mays
  Clone ID: LIB3227-021-P1-K1-B6
tcgatcaaagcttgcgttcttgtactagaggtcggcagcaagcgctggtagagccaggggtggaaaagatgaagagcagcactctggtggcgatcctagttcttcaggcccttctggtctctgcggccgtggccaaaggacctgcttggtcgacgacgaaaaaacaatgctggtgcggtgagtgcaccagctggtcgggcgtgtggacctgcgactacctcctcaccaagtgcgccggcacctgcaagaactgcgttcccgttttcccgtgaccagggggcccctaatttcaggggcctcgtctttctccccgaaaactgcggctgcaagatccactaaagactca

SEQ ID NO: 1321 - DNA, 287 bp, Zea mays
  Clone ID: LIB3227-021-P1-K1-B7
aagaattggcgtggttattcgttagagttgagttgttattcctgagcgtacaagttccatagaatgtcataaacgctagaaaaaaaaacgaaagaatatggctcgcctgaaaggtgtatgcccgctacaccaatgagaacacatgtgatcagtggacccaaatatgttaaaccgtgtttggaagtcaggtacatgacagcaagaataatcgcatcgtaccatgtcacatatcagctcgccttgagaaacgacaaggaacttaatatgctgtttcgagctgtcaccat

SEQ ID NO: 1322 - DNA, 388 bp, Zea mays
  Clone ID: LIB3227-021-P1-K1-B8
accggccgttgttcgccgccaaggacctaaccacgttttacttgagaaccggccgaagatttttccacaaaaaaagggttgggttgttgccccccttaaggaacctgttgggcttggggcggggccccaagaccaacgggtgtttcttgaccaccaggacaaaagccttgacccacaacttcagggggggggcaccggggcccaacgtattgtgcccgggtttgaagttaaataccttgcagccaatattttttttaccttccagggccaaaaccacgcccttaaaaaaccgcaccttttccacattttgattaaaacgttgggggggcccacctattttcccggggcactttttaaagaccaaggccaccgacggccggcccccccg

SEQ ID NO: 1323 - DNA, 342 bp, Zea mays
  Clone ID: LIB3227-021-P1-K1-B9
cagcaacagctaagcctctcccacaagttagcaacatggctgaggaggaggccaagaaggtggaggtggaggttaccaaggagcccgaggcggcggcgaacgaagacttagccgatgacaaggccgaaatccccgcaaccgacccgccggcgccgacgccgtcggccgacgactacaaggccctggccatcgtggagaaagttgcagatgaacctgctcccgagaagcctgcccctgcgaagcaaggtggcttcaatgacagggatctcgctcttgcacgggtggaaacagagaagaggaactgtttgtccaagattgagaagagaatgagaagacaaaatc

SEQ ID NO: 1324 - DNA, 403 bp, Zea mays
  Clone ID: LIB3227-021-P1-K1-C1
gaactcgtacaagctgtcgtccgccaccaagccgaatcccaagcccaaggccgccccgaagaagcccaagaccggcgctaagaagcccaaggccgctgccaagcccaaagctaagacccccgccaaggcgaagcccgccacaaagcccaagcccgccgcgaagccgaaagccgtagtgaaaccgaagacacccgccaagcccaaggccaagccagctgccaaggcgaagcccaagaccgccggcgctaagccgaagccacttgctaagaaggccggccgccccgccaaggcggcgaagacgtcggccaaggacacgccagggaagaaggcccctgccaagaaggccgctccctcgaagaaggcggcgaccccggtgcggaaagcgccgtcccgtaaggccaag

SEQ ID NO: 1325 - DNA, 336 bp, Zea mays
  Clone ID: LIB3227-021-P1-K1-C10
gctttctggcgttaaagacaagcttctgaagagaagagtacgagaaatggtccaacaatgcattatttcactcagcagggaggccaaaccctaaagataagtgaattggattattacacttgttaccggactgcaagtgggtacagtatcacctttggtctcactaaaattgcaaaaaaataaaaggtcaacccagtgtcttatctgtttcttcaaacgtagtgagtagatctatcctggcatcaagatcatgacctggccgaccattgcacgaagacagcattactcatactgacatgtaagcataaatgttgtttatgaaattctttatatgat

SEQ ID NO: 1326 - DNA, 298 bp, Zea mays
  Clone ID: LIB3227-021-P1-K1-C12
acatcttaccaactaacccttccttgaagttccctgcctttcaaaaaaaagcgcggcgcatctatctttttttttctattatacagcacatacacacacttgctgtgcatcaaaggggggaaatacaccctttgaacaacactgaccaccaatacaagcacaaagaaggtgctgggaaccctcacattttaaacttcacgcaccccccacccaaataccgagcgttttcctccaaaccaataaagcgggagctttttacttccacagttcaagcatatcatttatccaccatgtttca

SEQ ID NO: 1327 - DNA, 219 bp, Zea mays
  Clone ID: LIB3227-021-P1-K1-C2
gcccatgttgacattgatatgtacatgtccgttacctgttttctttttgttggacaatccatatatacttttctgcatggcatgtggtcgatgtctgtataagtttattacatatctgattgaacccataaggcagaaagcttgggtgatatctaaacaatgatgcatctccatgttttttcttctttctttcaagtgtcatatttatgttgttggaga

SEQ ID NO: 1328 - DNA, 405 bp, Zea mays
  Clone ID: LIB3227-021-P1-K1-C3
tcctgagcacgagttccttaatgatctagaacccttgggatggatgcatacacagccaaatgaagctccacagctatcgccacaggacctgacatcacatgccaagattctggagaacaacaaacaatgggatggtgagaagtgcatcattctgacatgcagcttcaccccaggatcttgctcgttgactgcatacaagctgacaccaagcggttacgagtggggacgcagcaacaaggacaacggaagcaatccacatggataccttccaactcactacgagaaggtccagatgcttctgagcgaccgcttccttggattctacatggttccggataacgctccttggaacttcaacttcatgggagtgaagcacgacccacagatgaagtacaacatgaagct

SEQ ID NO: 1329 - DNA, 400 bp, Zea mays
  Clone ID: LIB3227-021-P1-K1-C6
gtggacttcttccgcatgaacccttccgcgaagctccctgtcttccagaatggagcgcatgtcatctatcgcgctatcgatattattcagtacatagacagacttgcagtgcatttaagtggtgaaatcccccctgtgaacactgaggtccaccaatggatgcagaaagttgatgcttggaaccctgagatgttcaccctcacgcacaccccagccaagtaccgtgcgtttgtctccaagttcataaggcgggtgctgattgctcgcatggctcaagcccctgatttagccagcatgtatcatgtcaagctccgtgaggcttacgagacggatgataaagtgaaggaccctgacatcatgaagcaaagcgaggaagaactaagcaaactccttgatgatg

SEQ ID NO: 1330 - DNA, 399 bp, Zea mays
  Clone ID: LIB3227-021-P1-K1-C7
gacgcgccggcggcttgtgttccctttaaagcttggctgctcgtctgctcctgctgctgtctttcttctgctcttccatcgcgccagtgttttgagaagctggtcggcgctcctagatcccttcgcctctctcgcgttcgaggctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcgacaacactgtggaggtcaatggaaatgacaagacagatattggaatggtggttatcaggggaaacagtgttgtcatgatcgaggcactggagccagttgccaagtcgcag

SEQ ID NO: 1331 - DNA, 400 bp, Zea mays
  Clone ID: LIB3227-021-P1-K1-C8
tgttgatggtgatgatggcagctatgcacaaacagttgcactggatttagcgtgtctgcaggttctatcacaaagaattcatattggtaaatatgttgctgaggtgaagttcaaagacgctcctcaagaatatagtcgactaataaaagaaaaggacagcaattctctgatggatatgctgacattcaaggctgcggaagagaaggtcaagaagagagtagagaagaaggctaggacgttcgggcagaacgtcaccttggatgacaatgccactgctggtgacagcgagtgcaaggtcgatcccaaagtgctctacaagctgtatgatcagtgggtgatgccactgaccaaggatgtcgaagtcgagtatctcctgcgccgcctcgactgatcagtgatc

SEQ ID NO: 1332 - DNA, 319 bp, Zea mays
  Clone ID: LIB3227-021-P1-K1-C9
cgtgaatcagttgacatgcatgacaactttgaccaaataggtcttgcccagaagctggagaagcatgaattgcttgagatgaggaggattgctgcctacatttacaagaaggctggcaggtggaagcaatccattgctctatcaaagaaagataacatgtacaaggattgtatggagacatgctcacaatctggtgaccgtgaactgtcagaggacttgcttgtgtattttatcgagcagggtaagaaagaatgctttgcttcttgcctcttcatttgctacgacctgatccggccggatgtcgctcttgagctggcgt

SEQ ID NO: 1333 - DNA, 194 bp, Zea mays
  Clone ID: LIB3227-021-P1-K1-D1
ggtttgtccctcaattggccttcagttagtgactaggatcctgtgcaacttcaccccagatgagttttgccctgatccggttccaagcacggtcttagaaaagctgaattcggagagcttgctggagcgtcacgccaacaaagacgcgaccagtgtgtttccgcgcaccgttgcccttatagtgtaccacacac

SEQ ID NO: 1334 - DNA, 394 bp, Zea mays
  Clone ID: LIB3227-021-P1-K1-D10
atctcttaaggctgccaccgccagcgccgccccctcggtgcatcctcagtgcgtactgtctgtgcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaag

SEQ ID NO: 1335 - DNA, 366 bp, Zea mays
  unsure (1)..(366): unsure at all n locations; Clone ID: LIB3227-021-P1-K1-D11
gggcgaccacgccgncgatcnttaaggctgcaccgccagcgcctccccctcggtgcatcctcagtgcggggtgtctgtgctaagtcgaccattccttcttcactccttccccggcgctatggttaagtacttgcaggagccgggcaaccctaccaaatcggccaaggccatgggaagggacctgagggtccactttaagaacacaagggagacagcttttgcgcttctcaagctggctttgaccaaggctaagcgataccttgaggttgttatttgttcacaagcaggcaattcccttcccgagatactgtggaggtgttggtcggacctcacaaacaaagtttttccattccaatgggcatgggt

SEQ ID NO: 1336 - DNA, 389 bp, Zea mays
  Clone ID: LIB3227-021-P1-K1-D12
gtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtactgtggtggcc

SEQ ID NO: 1337 - DNA, 367 bp, Zea mays
  Clone ID: LIB3227-021-P1-K1-D2
ccggggcggcccacgcctacgcattggtgtagaattgctgagttgatttaatccttgaaaggtggtggaacatgcagagccgggttaaaatgggggggaaaacatgtacacacatttttgcgatgcttctataaacttgggatacttggattagacaaaggggacttgtgggttttcacttggttttagggccggccctgtgggcgtgcgaactgtgcgctccccccccccccaaaaaaaaattatagggccccaatatctatgataatccataccgatattatagataaaaatattattttgcataaaatatttgttaaaatataccctagaattgcaaaaaccttgaaatagatatgttcttatt

SEQ ID NO: 1338 - DNA, 180 bp, Zea mays
  Clone ID: LIB3227-021-P1-K1-D3
tgatgcggttgttactgttattgtgtactgttaagctctgctgcggcgtgccctgttgtttgggtagcgtcaacgtcgagcgccacttgcgggtgtgcctttgtctgctatcagtagcggcaaaaattgaaagctctcgagacttatgtcccttttgggcgccgttgaactgattatttt

SEQ ID NO: 1339 - DNA, 455 bp, Zea mays
  unsure (1)..(455): unsure at all n locations; Clone ID: LIB3227-021-P1-K1-D4
ccgtccgcantcctcaccggaccccagcagcgtttgggatctttcgctggcnnaagcagctggnnaggatggccgcnnacccttgcggattaccaacanntccagaagggagagcnnaccctccacctggtnngctccgtctcagngggtgnngcatgcagatnnctttgtgaagacccactcactggcnnaagacaatcnnacccttgagggtgganngtcttcggataccannttgacaatgtnncaaggccaagatctcacggacaaggagggcattcccactcggacccagcagcgcctcatcnttcgccggcaaggccagctggaggatggccgcacctctggcggactacaacatccagaaggagagcaccctccacctggtgctccgcctcaggggtggcatgcagatttttgtgaagacattgactggcaagaccatcaccttggag

SEQ ID NO: 1340 - DNA, 205 bp, Zea mays
  Clone ID: LIB3227-021-P1-K1-D5
acttcttcacctgcggcttcgtttaatgctggcatgcaccagttaccctaccacttcactcaaaggcctgggaagggagctgaggggtcatttcaaaaaaacaacggagacagggcctgttttccgcaagctgactgtgtccaacgctaaccgaaacctctcggatgtgattgcttacaaacaggcaatgtccttcccctgatac

SEQ ID NO: 1341 - DNA, 288 bp, Zea mays
  Clone ID: LIB3227-021-P1-K1-D7
agctcgcccgctacaacaagaagcccaccatcacctcccgggagatccagacctcggtgcgcctcgtcctccccggcgagctcgccaagcacgccgtatccgaagggaccaaggcggttaccaagtttacatcctcttagggtgccgccgcacgttgctacgatcctgtttaattctcatatttaggcctgtgctaggttgcttctgcaacaatgtagaatttgttataattgctgaatgaatcagttacccctgttgaagtttctaatatattgtaatcttgctagt

SEQ ID NO: 1342 - DNA, 353 bp, Zea mays
  Clone ID: LIB3227-021-P1-K1-D8
atgggatcaagtattgcttgctgaaaaagcgcttgctgatgatctgatggaagctctgatgcaactgctaggcaaatacattcccagaggcttgccggatagcatgctcacttccagtctaattaatcaatcaaatgacgactatgttaaccacgattgttacaaaaaccttttgctggctccgcaactgatgtctcttcatacatctgttctagaatccggagtgcctgtcgattggtaagcccactggtctggatattgcgaacggttgaagcatccagtgtaggaacatgtgtcggctccaaatgggtcagaacacgtctgatgtgcttgccgctaccctaaacaatacc

SEQ ID NO: 1343 - DNA, 400 bp, Zea mays
  Clone ID: LIB3227-021-P1-K1-D9
ccagagactcagtgccctccagtccagcatccaagaacttaaaacgaacgccgaaacatccgaagaggtagaactcgggagtgtcaggtaccaaataacagaagctgagggtaccatcatgcagctgatcgataccaacagtaagctatccaagaaggccgaggagttcacgtctcccgatggccccgatgcggagaacagtgacttgaggagcaggcatcagcgtaagatcttggagcgtgcaaggaagatgtccgagaagatcgggaggctggaggtggaaatgcagaaggtccagcaggctctgctcaaatacgaggaggagcagagtaccaggagtacctcaaaagccctgcagcggcggtccaaagtgcagctcgtggagtatctttacggccgg

SEQ ID NO: 1344 - DNA, 252 bp, Zea mays
  Clone ID: LIB3227-021-P1-K1-E1
cccacccgtcccaatatatttatgatagtttgtggtttgtaggtggcggccacgtaacgtgccgggtgttcctatttgcggtgcgtcacaccatgtttgtaacaaacagccttggggttagaactcattttttcccccattcctaaacccagtgtggggcctcattttataaacccgcgagagcgggtacgccccttgcaagaagagagaagggtttcttccgcgctccttaagttcatttccagggagact

SEQ ID NO: 1345 - DNA, 396 bp, Zea mays
  Clone ID: LIB3227-021-P1-K1-E10
tgacaactgaaagactgaatcagtccactgacagaattaaagagagccgaagaactatgttggagacagaagaacttggtgtctcgattcttcaggaccttcaccaacagaggcagtcactactacatgctcatactactttgcacggagttgatgataacattggcaagagcaagaagatcctggctgcaatgtcaaagaggatggataggaacaagtggatcattgggggaatcatcacggctctcgctctggccatccttttcatactctacttcaagctcgctcattaagcttgcctgcaggtaggttccttccacatatctgtgctcagtaattgtgtgataagagttgtctgaatgctgtgtattgagcgacacacggctcttgaagcat

SEQ ID NO: 1346 - DNA, 396 bp, Zea mays
  Clone ID: LIB3227-021-P1-K1-E11
gccaaaaggcctaaggattgggatgacagagaatatattgaagatcctgatgaagttaagccagagggctatgattctatcccaaaacagattcctgatccgaaggacaaaaagcctgacacatgggatgaagatgaggatggaatatggaagcccagaatggtatcaaatccagcatacaagggaccttggaaacgcaagagaattaaaaatcctaactacaagggtaaatggaagaccccatggatcgataatccagagtttgaggatgatccagatctttatgtgctgaagcctttgaagtatattggaattgaagtttggcaggtaaaagctggttcagttttcgacaacattctgatttgtgatgaccctgagtatgcaagaaaggttgtt

SEQ ID NO: 1347 - DNA, 395 bp, Zea mays
  Clone ID: LIB3227-021-P1-K1-E12
tgagtggtgggccaagcaaaatgatgtaagtagatcttttttttttgttttgtagactaacaatagtatttggccatctcaaactaggactgcataggagcaattgatggtagtcactttccagcggcagtcccggcctcagagcaagccaaatacattagacggcacggttacacttcgcagaatgtaatggtcgtttgtgacttcgatatgaggttcacatttgttgtcacaggatggcctggatccgtacatgacactagagtactacaagatactttgataacttatgcggacaggttcccccagccaccagaaggtaaatactatcttgtcgattcaggttatccaaatagaaagggctacttgcaccttataagggtcagaagtaccac

SEQ ID NO: 1348 - DNA, 389 bp, Zea mays
  Clone ID: LIB3227-021-P1-K1-E2
ctcttatttttttttttttagaacctttatatttttttttattcttcagttgtatgagtttttgtttttttttactccagagaaaccggaaaaaggcgaagaagggtgccggcggggcaagggagtcggacccagtacgaactaagagacgccgtccgtaaaaaacgggctgcaattccccgccggccgcaaaaaacgcgggctgaagaaggcccgccactcgcagcgcgtgggcactggcacccccgtataccgggacaacgccctgaaaaacctcgccctcggggaactggagtaggcaaggaacgcggccaaagaaaacaagaagacgcgcggggggccgcgccacaagcttctagcgatccgcaacgacgaggagcttgggaagc

SEQ ID NO: 1349 - DNA, 406 bp, Zea mays
  Clone ID: LIB3227-021-P1-K1-E3
catcgtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatcc

SEQ ID NO: 1350 - DNA, 400 bp, Zea mays
  Clone ID: LIB3227-021-P1-K1-E5
ggcggcggcactccaaactttagcgacatggcaatgcggttggcggctgcggccacgttcgtgcggcgcctggcgccggcgcgcccaccagtacgcatcctggcggcggcatctacggcggaagcggaggcagtgacgtgcgggcgcggggacaagaaaaccaagcgcgggaagcggttcaagggctccttcggcaacgcacggcccaagcgggagaagaagattgagcgcatcaaggaccgcgtcgaggtgccccgctccacaccctggcccctccccttcaagcttatctgagttggagactcccccccccctcggttcgcgagggcacctagggtttactgcaacagttgctgctacttggccgtttccaattagctgcaaccctgcatgggcgtgt

SEQ ID NO: 1351 - DNA, 397 bp, Zea mays
  Clone ID: LIB3227-021-P1-K1-E7
aatctatctatgacagtttctggtttgtagctgccggccaagtaacgtgctgtctttccctatttgcagttcgtcacatctgctctgaagcagccaggcttggagttcgaacttatctctcccgccattcctaagccgcgtgtggtgcctcattttccaaacccgggagagcgggcacgcaccttgcaagaggaggagctggtcccttccgcgctcctcaagttcattcccagggagactgattccgtggtcttcaccggtttgcttgatgagcttctggaggccagtgagccgcttcctgctgcatcacaatgaagtgtgtgtatatagcagttcgttctgttgctgtttctgcttgctgcatcacaggattacttggataacggtacgtatttgt

SEQ ID NO: 1352 - DNA, 399 bp, Zea mays
  Clone ID: LIB3227-021-P1-K1-E8
ggcaatagctgcaaccatactaggtctgatcaatcctggcgacgaggtgatactgttcgccccattctacgattcatacgaggctacactgtcgatggccggtgccaacgtgaaggccattaccctccgcgctccagatttcgcggtcccgcttgaggagctggaggctgcagtctccaaggacacgaaagcgataatgataaacacgccgcacaacccaaccgggaaaatgttcaccagggaggagctcgaatccatcgccgccctctgcaaggaaaacgacgttttgctgttctcagatgaggtctatgacaagctggtgtttgaggctgaccacatatccatggcttctatcccgggcatgtacgagaggacggtgaccatgaactctctggggaa

SEQ ID NO: 1353 - DNA, 398 bp, Zea mays
  Clone ID: LIB3227-021-P1-K1-E9
gagttgcttaactcgttgactcatgcccttcaaagctcaggtgtagatttgtcccaagccaacatctctgtgcagatcaacatgggaaagcgtgccgtcaagagacccgctgctggtgtatccaccaactccaaggaaccagctgatccggcatctagcaacgaattagggcatcagctgacgctgtctggtggcggtgccggtgccgacggcctctctcacgcaacaaagcggcataaacggggtagcagctgatgtccgctgtccctcacctcgctccccaacggacggatgacggattggtgacattcttcttttccctcccagccaacggggaggctgtacattgtgtgctgtgcttggtgacaagctgagacctccggcgtattctttgattc

SEQ ID NO: 1354 - DNA, 285 bp, Zea mays
  Clone ID: LIB3227-021-P1-K1-F1
aaaaaaaataataaaacaaataaaaaaaaactaaaaagcgaaaaaaaaaaaaaaaaataagggaaaaatagtacgcaaaggcgaaagatgaattaaacaaagaaaacaacggataaacttggggccgccggttttggatgttccaactttttgtcctgctcttttaccggtaatactttttttttggggaagccgatacagattgagtccggccggattatacaagagcgcctttggtaaagctcccgcattcccaaatttattaccttgggaagtttccccttt

SEQ ID NO: 1355 - DNA, 396 bp, Zea mays
  Clone ID: LIB3227-021-P1-K1-F10
ctcaactacgaaggtcccttttttttctcggtctggaagcgccgcagtcgctgacatggacgtgagcgtagcatgcagaaaggcgaagaaaggcgcggtcagtcgcaaggccggctggccgacgaagaagtcggtgtcgcggtcctacagggccgggctgcaattccccgttagtcgcgtctggcggtacctgaaaaagggccggtacgcgcagcgtgtacgcacgggtgcgcccgtctacctcgtcgacgttctggagtacctagcggacgaggtgcttgtgctcgacggctactcggcaagggacaacatgaagacgcgcatgataccgcgccacgtgctgctggtgatccgaaacgacgaggagctcagtaagctgctggccggcgtcaccat

SEQ ID NO: 1356 - DNA, 311 bp, Zea mays
  Clone ID: LIB3227-021-P1-K1-F11
ctgcccttgccgccgccactgcccgatccaggtgtgcagactgctccttcctcgtgtccgttccgaatgcccgcacaaagcaaacggcgcgcaagtcgaccggcggaagggccccgggaaagcagttgcccacaagggcggcgcgcaagtgggcccggcccacgggcggggtgaagaacccgcaccgtttccgcccgggcaccgtcgcgctccgggagatccgaaagtcccagaagagcacggagctgttaatccgaaagttcccctccaagcgctttgtccgagagatcgcgcaggactaaaagacggac

SEQ ID NO: 1357 - DNA, 302 bp, Zea mays
  Clone ID: LIB3227-021-P1-K1-F2
cacaggctgaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaccatccaggggatcacgaagccggcaatccggcggttggcgcgcaggggcggtggaagcacattccgcctatattacaaagaacccgggtgctctaaatttctctaagaacgtatcgagccctgcatatacacagagcacgcgcgcaggagaccacacacat

SEQ ID NO: 1358 - DNA, 400 bp, Zea mays
  Clone ID: LIB3227-021-P1-K1-F3
agcaaggatagacaagtgttacaggcagttgtacagactgcaccaggtgaatcaccatcatcttcagcctcagacattgataatttaaataacaatggattatccaagggcccttcaagcaaggatgccaattcaccacaagtggttggaaatcatttgttgctggccactcgaaatcaaccacacttgatgcggttacttgcttatacaaatgatgtcaatagtgcctttgaggctactcggaagtctcacatggcaattgcttctgcttctggcaatcatgaaaatggagttgatggtctttcttcagtaaaaacagtactggattttaacttccgaagtgtgaatgatctactaaggtttgtgcggatttcaatggagtctatcagctgctgatgtg

SEQ ID NO: 1359 - DNA, 393 bp, Zea mays
  Clone ID: LIB3227-021-P1-K1-F4
gctggcgcttgggctggagcgcagcgtgcagtgggtcctgtgggtggtgcgcaggcccagcgaccacgaatgcacgctcaacggcaactactacgacgcggagagcaagaaggacccgttcgcgtacctcccggagggcttcgtcgagaggaccaaggaggcgggtctgctggtgccctcgtgggcgccgcatacacaagtgctggcccacggcgccaccggcgggttcctaacgcactgtgggtggaactccacgctcgagagcctggtgcacggcgtgcccatggtggcctggcccttgttcggcgagcagcggctcaacgcggtgatgctgtccgagggggcaggggctgccatacagatgcccgagaccaacgacaaggagagcatcgt

SEQ ID NO: 1360 - DNA, 174 bp, Zea mays
  Clone ID: LIB3227-021-P1-K1-F5
cttaaattttaatgttcattttttttttcaaactggaagcgcaacagccggtgcggtgtactttagcttagcagccccaaaagcgaaaaagcacgcggccagtcgcaaggccgcttggccaccaaaaaaaaagtaatatcggtcctccacgacaggcttgaaataccccgtcat

SEQ ID NO: 1361 - DNA, 401 bp, Zea mays
  Clone ID: LIB3227-021-P1-K1-F6
caacggcacgattctcctcctccgtccgcgtagctctcggtttcggcgatgtcggggcgcggcaagggcggcaaggggctgggcaagggcggcgccaagcgccaccgaaggggcttggccacaaccttcaaggcattaacaaacccgccattccttagcttgcccagaaggggcgggttaaaccccttttttggcttattttacaaggagacccgcggcgtgttaaaaattttcttggagaacgtattccgcgacgccgtaacttacaccgagcacgcccgccgaaggaccgtaaccgccatggttgtcgtttacgcgctaaagcgccagggccgaacgctctacggtttcggcggttaggccgcctccctttctgatgctttgatgtgacggccgtggtc

SEQ ID NO: 1362 - DNA, 394 bp, Zea mays
  Clone ID: LIB3227-021-P1-K1-F8
ccgagacatggatatcagcttagactcagagttcttagtttcaacatccattgatggatctgcgagaatatggaagatagatgagggcgcaccactggtcaatttgactcgatcctcggatgagaagatcgagtgctgccgcttttctagggatggcatgaaaccgttcctgttttgcactgttgcaaaaggtcccaaagttgttacagttgtctggaacataagcgattgggagagaattgggtacaaaagacttctggggaagcctatctccacactctcagttagcttggatgggaagtatctggcattaggaagccacgatggtgacttctgtgctgttgatgtgaagaaaatggaagtttcccactggagcaagaaggtccatcttggc

SEQ ID NO: 1363 - DNA, 398 bp, Zea mays
  Clone ID: LIB3227-021-P1-K1-G1
gttggaagcaagcccctttatgtagctcttgcgcagcgtaaagaagacagaaaggcaaagctacaggcacaattttcacaaatgcgtcctgttgcaatggcgccttcagtaggtcctcgcatgcccatgtttccacctggtgtccctggagttggtcagcagctgttctatggtcagccaccaccagccttcatcaaccctcaggctggatttgctttccagcaacctctgatgcctggtatgaggcctggtggtccaatgccgaactttatgatgcctatggttcagcaaggacagcaaccacagcgtcctgctggtagacgtgctggtggaatgcagcagcccatgccaatgggtggtcagcaacaggtgttccctagaggtggtcgtggctatcg

SEQ ID NO: 1364 - DNA, 223 bp, Zea mays
  unsure (1)..(223): unsure at all n locations; Clone ID: LIB3227-021-P1-K1-G10
acccacgcgtncgaaaaaaacaacacaactaaacctttactttcaagaaccaaaattcatacctggtgttcctaaacatcttttttaacacattccaccaacacatacacacataccccaaaacgactctaaatcaaatccaccaacctcctacacaactatcaaaacactcctcaacatactacctatctctattgcctattcatgactgaaattcttacaa

SEQ ID NO: 1365 - DNA, 364 bp, Zea mays
  unsure (1)..(364): unsure at all n locations; Clone ID: LIB3227-021-P1-K1-G12
gtgggaggacgggaggaagaagttcggtgcggcggccaccttcaagatccccgacgaggtcgacatcgctcatctcagttagaatctagaaaccccgccggctgcttctgcgtcggttggtggtgcggagtctgtgcatttcagagcgtttgctgctactgctcccttttttttttgtttttttggttgcctccacgagctcagatttcagaagctaaccactgccgttgatgaaactgctcgttatgatcccccattgttctgtaaattttcaagttttagcagcctagtgtattgcactggctgataattttttttgtgtgctatgtaatttgaaacgtggaaacgatttttggagcggnag

SEQ ID NO: 1366 - DNA, 353 bp, Zea mays
  unsure (1)..(353): unsure at all n locations; Clone ID: LIB3227-021-P1-K1-G2
gtgaaccgaaccagtatgttttgcacggtggctggagcgagatatgactatgagtttacctatatgctatggaccatccttgttggcggcatatgattctaccagtgattagatctagccaattataatcagttctgtgagcagactgtttccttgtgttgtcagatctcggtagctagtgtgtgcgttccaggtctttttgatcttatcacaagatgtgctcgtgatacttgtgttgaaggaactgtggtatcttagcgcctcanaaaaaaaaaaaaaagaaaaaaaaaaaaaaaaaaaaaaagaaaggggcgggggctctagatgaataaaagctaacgtacgcgtgcatg

SEQ ID NO: 1367 - DNA, 253 bp, Zea mays
  Clone ID: LIB3227-021-P1-K1-G3
ccgcaatcgcaagaaccctatcgccgccgcacccgcaggaatgggtattgacctcctcgccggggggaggaataagaagaccaaacgcactgcgcccaaatatgacgatgtctacctcaagctcctcgtcaagctctaccgcttcttgttcaggaggaccaacagcaattttaacgctgttgttcttaagaagctttttatgagtaaaaacaaccgaccaccaatcttcatgcgccgccttgttaagtttatt

SEQ ID NO: 1368 - DNA, 401 bp, Zea mays
  unsure (1)..(401): unsure at all n locations; Clone ID: LIB3227-021-P1-K1-G4
caaaaacaaaaaccactaacaccgccgcacccgcaggaatgggtatcgacctcggctgcggggggaggaataatatgaccaancncactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagccacagatgacaaaaggatccaggaggttccagcaatgaaggttactgccctgaggttcacggagacagcaagggccaggattgtcaatgctggtggcgagtgcctcaca

SEQ ID NO: 1369 - DNA, 408 bp, Zea mays
  Clone ID: LIB3227-021-P1-K1-G5
cgtccgcagctcaagaagctcgtcgccggcggcttgctgaccaaggtgaagaactcgtacaagctggggtccgccaccaagccgaatcccaagcccaaggccgccccgaagaagcccaagaccggcgctaagaagcccaaggccgctgccaagcccaaagctaagacccccgccaaggcgaagcccgccacaaagcccaagcccgccgcgaagccgaaagccgtagtgaaaccgaagacacccgccaagcccaaggccaagccagctgccaaggcgaagcccaagaccgccggcgctaagccgaagccacttgctaagaaggccggccgccccgccaaggcggcgaagacgtcggccaaggacacgccagggaagaaggcccctgccaagaaggccgctccctcgaag

SEQ ID NO: 1370 - DNA, 64 bp, Zea mays
  Clone ID: LIB3227-021-P1-K1-G6
tagaggatccaagctacgtaccggcatgcgacgtatactcttttatacttcacctaaaacaatt

SEQ ID NO: 1371 - DNA, 87 bp, Zea mays
  Clone ID: LIB3227-021-P1-K1-G7
aaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1372 - DNA, 398 bp, Zea mays
  Clone ID: LIB3227-021-P1-K1-G8
ggcggtggccaggaaggtgctgaccaccagcctcggcggcgacctccacagcgcgcgcttcagcgagaaggccctgctcaccgccatcgaccgcgaggcggtgtacgggtactacgacgacccctgcagcgccaactcgcccctgatgaggaagatccgggccgtgctggtggaccacgccctcgccagcggcgaggccgagaaggacgccagcgcgtccgtgttctccaagatcaacaggttcgaggaggagctgcgcgaggcgctgcccagggagatggaggccgcccgcgtggccttcgagaccggcgccgcgcccatcgccaacaggatcaaggagagccggtcgtacccgctgtaccgcttcatccgccaggacctcggcgccgtgtacctga

SEQ ID NO: 1373 - DNA, 375 bp, Zea mays
  Clone ID: LIB3227-021-P1-K1-G9
atcgctaggaacgcatatcagcgcccgtacctcgtagaatgggtatatacctcacctgcggggggtggaataagatgtccaagcacactgcgcccaaaactgaccatgtctaccttaagctcctcgtcaagctctaccgtttcttggtcaggaggaccaagaccaatacaaacgctgtcattctcaatacgcttttgatgagtgaaaccaacccaccaccaatctcctttcgccgccttgtcaagtttatggaaggaaaggagaggaacattgctgtcattgttggtacagtcacatatgacaaaaggatccaacacgttgcaccaattaaagttactgccctgacgttgacgccaacagcaagggccaggattg

SEQ ID NO: 1374 - DNA, 404 bp, Zea mays
  Clone ID: LIB3227-021-P1-K1-H1
gcagacgctgcagacagaggccaccacgctttcggcacagctcactcttcttcagagggacacctctggtttaaccactgagaacagggagctgaagctccggctgcaggccatggaagaacaagctaaactccgagatgctctaaatgacgccctgagagaagaagtccagcggcttaagatagccacagggcaggtccctaacataaacgggaatcccttcaacggaggactaccccagcagcagcagcagcagcaggtgccgagctatttctcacaaccacaggggatgcaatacttcagcagccaccagggccagcatcagcatccgaaccatcaccctcagagttcttcaaacggtggtggccagtccttgagtgactccatggatttcatgtgaggac

SEQ ID NO: 1375 - DNA, 376 bp, Zea mays
  Clone ID: LIB3227-021-P1-K1-H10
gataaaaaaaaataaaagaaattttttaatcaaaaaacataaaaaaaaaagggtaaataaaaaaaaaccatataaaaaaggacaaaaaaaacaaaaaaataaataataaaataaatactaagggggggcgcccttttggggtttcaccttttcctccccgctgcttgcaaaagattactttttttttgggtaccctaaatacaaacaccacggcccgggtttttcaaagcttaccagtgggaaacacctggggtttcccaaattttttcccttgcgccaaaatccccttttgccgcggtcgggaatacggaaaaggtcccaccccatccgccttttaaaacaattgcccactttatttgcacatggatccacccct

SEQ ID NO: 1376 - DNA, 400 bp, Zea mays
  Clone ID: LIB3227-021-P1-K1-H12
gtcctcgcggccttctctccctccactcgaaccgcgccgacgagcgacgacaaccgttgctgcattcttcaatggcgactgtgccagttaacccaaaacctttcctgaacaacctgacggggaagcctgtaattgtcaaactcaagtggggtatggagtacaaaggttatcttgcttcggtggactcctatatgaatctccagcttgccaacactgaggagtacattgatgggcaattctctggaaacctgggagagattctgatcaggtgcaacaacgttatgtatctgcgaggtgttccagaggatgcagagatagaggatgcagagtgagaagatgtgaatgtaatttgattctgacatgtatgtttgaatatgccggtgacaactagacctatcgg

SEQ ID NO: 1377 - DNA, 384 bp, Zea mays
  unsure (1)..(384): unsure at all n locations; Clone ID: LIB3227-021-P1-K1-H2
agcacgcgtccgnaaaacatgctcccgacctctcactcctttatacgacgagttctcataccgcgacggggggggagacccggtgtctagaaggtacccctacccgcagacctcgcttgtccacatcattgcagcttcgaacaccaccacgggtggcaaccggtctagcaacaagccttaagacatcgacggattggtggactgttcgtgaagcagcccgaccagtgctggcaccagcacagcttcaggaaaggggcagacgtcggctccgaagctaccatacaagcaatactgtttccagggggacttcagagaggggagcgatccggataagctgtctgagagcgtcttggacagcctgcagaaagcactgcgcgcctaaaa

SEQ ID NO: 1378 - DNA, 250 bp, Zea mays
  Clone ID: LIB3227-021-P1-K1-H3
cccacgcgtacgcccacgcgtccgcccacgcgttcgcccacgcgtccgcttgaccctgtgggctgctctcctcttctccgatggctaccctgcagcagaaccacatcgtgcgggagaccaccgacgtggccaaagtacccaaattctacgaggccgagcctggattcgagcgcataccttaccccacctactttgccatacaggtttcatggctccggcctgtggggtttcgctacgtcctggccccaca

SEQ ID NO: 1379 - DNA, 387 bp, Zea mays
  Clone ID: LIB3227-021-P1-K1-H4
ggggtttgatagcagacacgtcctcaagccaaagcactaaaggcaacccagctgaatcatacagcacacagaccaacatgaacagctctcagtttagcacaactgatgtatcaccacggtgacgttgtcgactattgtttgacgtcttcagaggtgtctcgcgcctcccacaaggtttattgtgctgagcccggacaaaatcgcttgatatggaaggcctgatccattttcatcctgttttagagctacgtaggatgcgaaggccgctgtgaattgctgatgtacaggaattgtagctcatctgtttttcttttctgcggaggatgatttgcagttaaatttgacattttttttatgttctccattaaagcctgttgtaggtataca

SEQ ID NO: 1380 - DNA, 412 bp, Zea mays
  Clone ID: LIB3227-021-P1-K1-H6
gtcgaccacgcgtccggtggatatggatatcagagagctgatttcattggatgatgttatggaggagattgggttggggccaaatggcggtctcatctactgcatggagcatcttgaagacagcttggatgattggtttgatgaacagctagagaactacttagatgatgattatcttgtgtttgattgccctggccagattgaactcttcacacatgttccagttctgcggaactttgtcgagcacctgaaacgaaaaaatttcaacgtttgcgctgtttaccttcttgattcacagtttgtcagcgatgtaacaaaatacatcagtggttgcatggcttctctatctgctatgattcagctggaacttcctcatatcaacatcctttcaaagatggatctggtctccaac

SEQ ID NO: 1381 - DNA, 399 bp, Zea mays
  Clone ID: LIB3227-021-P1-K1-H8
ggaggatggaggtgggcaggactccgcggcgacgggcgtccccagcggcggctgtgccttcgctgcttctgttcgccttgctattcgtgtgccgggcggcggcagcgttgggcggcccggcgccggcgctatacaagcacgcgtcgttcttcgaccgcgacggcgacggcgtcgtctccttcgcggagacgtacggcgcgtttcgggccctcgggtttggactcggcctgtccagcgtcagcgccgccttcatcaatggcgcccttggcagcaagtgcagacctcaaaacgcgacgtcgtcgaagctggacatctacatagaggacatccggagagggaagcacgggagcgactccggctcgtacgacgcccaaggaaggttcgttcccgagaagttcg

SEQ ID NO: 1382 - DNA, 399 bp, Zea mays
  Clone ID: LIB3227-021-P1-K1-H9
ctcaagcaccacacgggcttcagggagtcagaggcagagctcatgtaagattcttccattgccaatcgccatctttttctctgcctaaatccacatttgacctttgtgatctgtgactgtttcagtgaatgcacgaagatgctggtgatcgcgcactcgactgcccctgagagcaagctgagggttgtatacaagaagtattccagcgagcagttcggaggggtcgcgctgcgtccacccgcagaggagatctgcaagtgaacgaaggctactttatccgtgtttgcctattgcttgctttaggggaagtggcgatggaaggcgagtctgacattcgctaggcttttttatgtttgcttgtttcagacagccgattgtttgctaggctgttctcagagt

SEQ ID NO: 1383 - DNA, 278 bp, Zea mays
  Clone ID: LIB3227-022-P1-K1-A1
gcaagccctcgcctgtcctcactcctaaccctcgcccgactcaaatctatctgccccgcgccgccgtcgccatgccgttcactccgggtccctactctggcgtcagcaccctcgcccttgtagcgagggcatcggtcttcggcttcggtgtcgtctacgggagcatcaagctctcaatcctcaaggcaacaaagcctaaaaaggaagaagcgcatgctcatcactaaggacgacagggctgctacatgttaatttctatgggaggatgatataaaaat

SEQ ID NO: 1384 - DNA, 361 bp, Zea mays
  unsure (1)..(361): unsure at all n locations; Clone ID: LIB3227-022-P1-K1-A11
gggggaaccacgcgnncggtcanntaatcaaaaaaaagtttatccgggttagggatttaaacagcggtgggggcggcgggcttactttttgctgctatggctgcgaccgcttcaaccgctgatgccagtgcccccgagggcgagggcgcggtggacttcaaggaccttcatcagcagagcaaggcgctcgacaagctcactgatcatgtcgaggaccggcagctcgattttatccccgttcaatacgccatggcagcacttgcttcatccaaagaagctgactggaactcgattaggcttatggataaagaattggcttctgttaagatcaaccctgccgatgttgaaattatttcttctt

SEQ ID NO: 1385 - DNA, 174 bp, Zea mays
  unsure (1)..(174): unsure at all n locations; Clone ID: LIB3227-022-P1-K1-A12
aaaaaaaaggtcgaacccaacaanaacagaaaggggaagccaacatatcaaagctcttattcgcgtccgcggagctattttttctgagacatatcacaacaggacctaaagacaatgcagctttcagtctttgaattactatccccaacaaaactcgatttttgcattcattca

SEQ ID NO: 1386 - DNA, 304 bp, Zea mays
  unsure (1)..(304): unsure at all n locations; Clone ID: LIB3227-022-P1-K1-A2
tcggcaaagctgaacgatctggggcataatgatggccagaaaggagacggctgcggacccagctatgtgaaactggattagatggcaagatatattgcatattgagtgattatatggtcatagacttcactggggcattgggaaatgggatattgatgagatgggctagtcacgggtgttatcatttatgaagcatgcatacaactgtcaactatgactgattctctattttttttttctagcgtgcatgaaaatctatggaacttgtacgctgacgaataacaacgcaactctcacggtttnt

SEQ ID NO: 1387 - DNA, 393 bp, Zea mays
  Clone ID: LIB3227-022-P1-K1-A4
gacttctcgagaagttttgggaggacatttgatacagctggtttagaggtcgcgactcctatcctagtccagacagacgatgggcataaacacaggagaggaagccatggtgatatcatctttttgacaagccggggagaggtgacatcgtactctcctgggctgctcgggcacgatgcggtgtggagatggcaagtatcatcaggggcgacatggtccaacctttcatctccatcgggaatgatggagaacatattggtgcctaccttgaaggccttctccctacgtgcctatgacccgaaagaggtgatcatcgcgggcggtgaccaggaagcggaggtgctctctccttctggtggcatactggccatgatcgagctcccaccgcccccc

SEQ ID NO: 1388 - DNA, 70 bp, Zea mays
  Clone ID: LIB3227-022-P1-K1-A7
gaattccacgcgtcgactccacgcgttcgtcaaagctgaacgatctggggcataattgaggccagaaagg

SEQ ID NO: 1389 - DNA, 152 bp, Zea mays
  Clone ID: LIB3227-022-P1-K1-A8
agcagattttttagaaaaggagagcagcacttgatcactgtgatgggttcaaaggcatgcttgcaaaaaagggtggggctatcaaccaagagctcaccaagttggagaaagcacccacggcggaatggggatatgttataggacggcatgtt

SEQ ID NO: 1390 - DNA, 110 bp, Zea mays
  Clone ID: LIB3227-022-P1-K1-A9
gtgactctgggaaatccatattgacaacgcttatataattaagcactgttggagctgagctactgtggtctatattctagatttttgaagcagtattggtttgtttcgac

SEQ ID NO: 1391 - DNA, 225 bp, Zea mays
  unsure (1)..(225): unsure at all n locations; Clone ID: LIB3227-022-P1-K1-B1
cgccccgggccccggnccgggattcgcgccacgcgccccgacgagggggtctctgaggttggccttactgccactcgacggagctgacctgctgtgcggtcaatactatatttttggcagacaatgaccaacgctgctggtggcgacatgtcgcttcactggccggagcttaaaggatttccggtatttgttatgggacgacacccagcgggccatgccactggg

SEQ ID NO: 1392 - DNA, 91 bp, Zea mays
  Clone ID: LIB3227-022-P1-K1-B10
gcaatgcatctcgtcgtccatcgcatgttgttgtcgttgttgtgtgtgttttcgatgatcctgtctctgttataaatatcattattattac

SEQ ID NO: 1393 - DNA, 203 bp, Zea mays
  Clone ID: LIB3227-022-P1-K1-B11
gttctgtgaccaactgctataggatatttgagttttcaaatctgctgctgtgagtttcttcttaatataggataaatttgatgactattactcttgacagttttgtggtatgtttaacttgtaatcattcaagagtgttgtcctccatgcaacaaaataactaaaatatatagaaatataaaaaacaaaaaaatgaccaatgt

SEQ ID NO: 1394 - DNA, 387 bp, Zea mays
  Clone ID: LIB3227-022-P1-K1-B12
aaaaaagcctacgtgggaaatttgatgacttccccacaccactagatgggggcagggtataaaatgggactgacgcgccgcacaaaaatggctaaccaggctggcacgccctttaaacagcctgggaaatcatataacggtcagcaagagacaacatcattaaaggatttcaaagaaccgaacccatcaaaagatgcatagcaaccaaagccatcggacgattcaaaggagccaaatccacccaaggtttgagatttcacccatggacgtgcgaagaacaaaagaaggggacgctgtatgatccttagaaagcaccaaatgattctatatgactgacgaaagcgcttcgtgtttcggttgaacaagaatcattgttagacccaaagg

SEQ ID NO: 1395 - DNA, 397 bp, Zea mays
  Clone ID: LIB3227-022-P1-K1-B2
cccgcacaagcgcaagcccgacatcagccgcgccaaggagttcctcgggtgggagccgaagatccccctgcgtgagggccttcccctcatggtctccgacttccgcaagcgcatcttcggcgaccaagacgctgctgccaccaccggaaaccagcaaggttaggatgaaggagcgcacatgacatggaaatttttggtggcctgcttctagctgcttggttgctctctccttactgacaaaagctatgggccacgtagttcgttgggaatgtgttactggaatacctcggcacggctgatgctgtaatgccattctttttttcccctgtattttttctttctcagttctctcagtccttagctatacaaaaaaagttcagttgaacagttggagatg

SEQ ID NO: 1396 - DNA, 398 bp, Zea mays
  Clone ID: LIB3227-022-P1-K1-B3
gcttcgggcagtacgactaccagggcttcgtcccgaacgggccctccatcaccacgcggccggtgccgggcccggacgccggggcggaggtcacggagtcggacttcctggcgagcgtcacgccggtcaccgaggcgctcggcttcatgtccatcgcctcggggccgatggggctcaagggcacggaggtgtacctggggcagcgcccggacacggagcagtggacgcgcgagcggagggcggccgaggcgctggcggagttccgggcgaggttggaggaggtcgcggacaacatcgacaggcggaacgcggaccctgcgctgaagaaccggacggggccggtggaggtgccctatacgctgctcaagccgacggcacagcccggactggtgctccgt

SEQ ID NO: 1397 - DNA, 397 bp, Zea mays
  Clone ID: LIB3227-022-P1-K1-B4
agaccatctacactgcatcggtgtgaatgcgcaattagatcaaggctctgaagtgcgcttcacgcggatgtctatctgggttcttgaggactatgatacacaagcatggatcctaaagcacaatgtgagctctttgcagttctttgaattactgagtcacccaatcaaagacttcgatattatggccattcatccagatcacaattcgttcatccttgttcagcactggaaccagaaacttgtatcatataacatggatactcaggaactgcgtggtctctgcactcttgaaaagggctatgtggttattaccccttacataccctgtttcttggagtcatcggttcttgccaccaaacactgaagttgttgtttctgggggacttctctgcatgtt

SEQ ID NO: 1398 - DNA, 397 bp, Zea mays
  unsure (1)..(397): unsure at all n locations; Clone ID: LIB3227-022-P1-K1-B6
gttctctctcacgcgagcagtgcatccttgagccaccgccgccgtgaggagctccgcccgtccgccgtcatccgtcaaatcaggtggccatttggtacaggcgtcggactcccaggaggatgaccggtggcaagaggttcggcggcgggcgggtgccgacggggaccccgtccctcgcgtggtcgtccgtcgtcatcgtcgcctccctcctcgctggcgcctccatcgtccacaacatctacaagcctgacatgaccattccacctgtggagggtgccgccgccngcggcggcggccaagaaagctgagctacgaatggctggacactgcatgcaagagaggaggctgggcatgggagtagtgaggggccggccatctgcacctttttttttgttct

SEQ ID NO: 1399 - DNA, 393 bp, Zea mays
  Clone ID: LIB3227-022-P1-K1-B7
ctcttgtgcccatattatatataaaaacaagagctttatttatttcaattcgctcatcatcgtcgggtgtaaattaaataaataaagctcttgtgcccatattatatattcaaacaaaaaaaaaaacaaaaaaaaaaaaaaaaaaaaaaaaaaaaaaaaaaaggagacaaaaaagaaaaaaaaaaaaacaagggttaacaaacaaaaaaaatgggaaaaaactagcattaaacaaaaaaaaggggggggccctttaaaaaaaacaaattttcccccccggggaatgcaaaaaaaaattttttttttggggccccaaaaaaaaaatccccggccggggggttaaaaaggggggggggggaaaaacctgggggaacccacacaattttttttggg

SEQ ID NO: 1400 - DNA, 393 bp, Zea mays
  Clone ID: LIB3227-022-P1-K1-B9
gctgaactctggctagagtagaagactggggtttgccttgcgctctcctgctggtgaacggtggagttgtagagctgagggactgcagtgccatagccataggaagggaagaactcgagatgtacatagatagcgtgggtgtgtagcatcggaaaagatcatttggtctggaactacgtagcgtaattggtcagtcagatcattttcttgtttctttttgtctgattatgcttacccagtggtaaatccgtccattgtatcggatttaatttaagaaatctgtaatacagaggtgtcgtgaaatagttgatgacgcaactggaggttagtggtgactggtgaccaaagaacatatgctctgcttatgatctaaaagttaggttgtgacatgag

SEQ ID NO: 1401 - DNA, 403 bp, Zea mays
  Clone ID: LIB3227-022-P1-K1-C1
cccacgcgtccgggccaaaagcccccaaagagaccccacaaaactccccgttatcccccacccggacaatcttccttcagctgtccgcccgcggcccacccctccgtcgtctccaccattccgccgttcccaccacgccactcgccagttcgtcactccctcctgtctccccccttgccgagacggcgcggacgccccgtcgcccaccccgatggcttccactctcctccacgccgccaccgcctcgctccagagctccttccagcccgcacgcgcgggcgccgccaccgcctttcaccccctcgcgtgcaccccatccatacgcctcgcgcgctcctcgttctcgtccaatcgccgcctcgaggtttcactccgggcggtttcggccggtcaccggttcgcg

SEQ ID NO: 1402 - DNA, 316 bp, Zea mays
  Clone ID: LIB3227-022-P1-K1-C10
aagaaagacaagggcgccaaggagaagacgaccgatcctgtgaagctcagagcaaagctggagaaggtggacaccaaactgcaagacctacatgccaagagagaagatatcctgaggcagctgaaagagctggaactggaagaagaaagcaaggggaaggccaacgaagaggagcctgcacatgtacagaatctggaacagggtggagagagcgtggtcaaggaacagagtcatgtcgccgcagcctgatccggttacacatgcacatgcatcacactgtaaatgaaggaacatacatcagctgagtggtgaaaat

SEQ ID NO: 1403 - DNA, 340 bp, Zea mays
  Clone ID: LIB3227-022-P1-K1-C11
tgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaaaatctgcacgagtgcatcacagaagagcacccgggatgggagcttaa

SEQ ID NO: 1404 - DNA, 174 bp, Zea mays
  Clone ID: LIB3227-022-P1-K1-C12
gcgatattgttatattgacagtcatggcagaaacatctcttcccttccgttctgggataacttttgttccctggcccccgaaagatttctttttaaaatcgggggcccttttttggtcaaactttctttccccgtcttttctccttaatgtttttttttttgtcccctaattta

SEQ ID NO: 1405 - DNA, 308 bp, Zea mays
  Clone ID: LIB3227-022-P1-K1-C2
ggcgagctggctttatgaggaagttggagggttgttgaacaataaaaccctttttggtggttaaggattattgctttctttgaacccacatacattggagggatatgaatcttgtactggtggcaaggggagagttggatctgtcattaccttggaccaacttattgagcctgctcttttacccccaccacccatttcgtggtacttgagagggattactacaaggacaactgagatgctggtgaacgatctgatagcggaaactgctcgattgcgcaccatctcaaacaacgcgaatgccgagcaag

SEQ ID NO: 1406 - DNA, 230 bp, Zea mays
  Clone ID: LIB3227-022-P1-K1-C3
gcatatggcacctcaacagcatagtgatctttctggagcaagtgcagtacccaatgtgcagagtaatactcaaacattgcagcagggccaaacctcatctgccaattcagcccttggttcaaaatcacagcatcagcgacagcaagcggaacaaaatttgccggttagcttttaatttccaaaccaacctgcaatttttccccaccagaggcggaggaaccaccgggacc

SEQ ID NO: 1407 - DNA, 404 bp, Zea mays
  Clone ID: LIB3227-022-P1-K1-C4
cctcagaaaaaaggccttcttgggaaatctgatgacttcctcacagcacttgataagttcattgaagaaaatgggactgacgcgctgaagaaattggcgaacaaggctggcaagccatttaaacagtctgggaaatcatctaaggatcagaaagagacaaaatcatcaaaggattccaaagaaccgaagccatcaaaagatgcaaagcaaccaaagccatcaaaagatacaaaggagccaaagccaccaaaggtttcaaagtcacccaaggactccaaagaacagaagaaggcaacgctgaaagatccgaagaaagcaccaaaggattctaaaggactgaagaaagcgcttaaggatccgaaagaacaggaatcattggaagacccaaaggaacatacagcaaa

SEQ ID NO: 1408 - DNA, 395 bp, Zea mays
  Clone ID: LIB3227-022-P1-K1-C5
tgatgatcgaactgttaacctagctgatataactaatggcacaaaggaaaacaaaggtgaaaagaattttgctctagttgagaagcaagtttcagaagattctgtgaagtcgctgagcacagaagaacatagaagtccagagtttgaaccacttcttgttcgtctgaaggctaaaattcaggagatgaaggaaaaggacactgatcccctgagcgataaagatgggaactcacatgtctgcaaagtttgcttcgaatctgcaaccgctgcagtattgcttccttgccggcatttttgcttgtgcaagccttgctcgcttgcctgttcaaagtgccctctgtgccgcccaagaatagcagacaggataatcacattcacatgaacggcgtgctagc

SEQ ID NO: 1409 - DNA, 275 bp, Zea mays
  Clone ID: LIB3227-022-P1-K1-C6
aaaaaaaaaaaataaaaaaaaaaaaaaaaaaaaaaaaaaaaaaaaaaaaaaaacaaaaaaagaaaaaaaaaaaaaaaaaaaaaaaaaaaaaaaaaaaaaaaaaaaaaaggggggggccgttttaaaggatcaaagtttacgtccgcgggcttgcaaagtaaaagtttttttttagggccaccaaaattaaattcattggccggggttttaaaacggggggacgggaaaaacccgggcgtaacccaatttaatcgctttgcagaaaatcccccttt

SEQ ID NO: 1410 - DNA, 344 bp, Zea mays
  Clone ID: LIB3227-022-P1-K1-C8
aatttttttgtgttgttttttaattttgtctttcttttaacccacatacattggaggaatataaattctgtactggtggcacggggagagttggatctgccattacacaagaccacattatcgagcctgctcttatacccccaccacccattacgtggcacttgagagggataactacaaggacacctgagatgctggtgaacaacctgataggggaaactgctcgaatgcgcaccatcttaaaaaacgcgaatgccaagcaaggtactgaagaaacacggcgatgctaacataggtgatccaactagagagtgtggtgacattaaagaaaggtggcgacatat

SEQ ID NO: 1411 - DNA, 59 bp, Zea mays
  Clone ID: LIB3227-022-P1-K1-C9
aaaaaaaaaaaaaaaaaaaaaaaaaaaaaaaaaaaaaaaaaaaaaaaaaaagaaaaaaa

SEQ ID NO: 1412 - DNA, 400 bp, Zea mays
  Clone ID: LIB3227-022-P1-K1-D1
agcttggttctccatggagcatctggtctatctcatgagctcgtaaaggagtgcatagacttgggcgtgagaaaattcaatgtgaacactgaggttcggaacagctacctggcgtccctcagaaagccagaaaaggacttgattcaggtgatggcgtctgctaaagaggcaatgaaagctgttgtagcagagaagctgcgcctgtttggatcatgtgggaaagcctgagcgaagtacttgcgttgcgccggcaacatgcagtacaagaccgactgcatcatcgggttcgtgatgctgctgctactgtgcagttgcttacggatacagctcattgcgttgaacagctgaagtggttaattgtactttgcagtgtagcgcaactaaggctaattcataaatc

SEQ ID NO: 1413 - DNA, 346 bp, Zea mays
  Clone ID: LIB3227-022-P1-K1-D10
gcaccttattctggtactcttgctgttgttggcactgttctgtacgtgctgtcatttgctctaggagcgggccctgttccagcgctacttcttcctgaaatatttgcctcgagaataagggccaaggctgtcgcattatctctaggcatgcactgggtatctaactttttcattggcctgtacttcctgagtgtcgtgagcaagtttgggatcagcaacgtgtatctgggatttgcatcagtatgtgcccttgcagttctgtacatagctgggaatgtgggcgagaccaaggggagatcacttgaagagattgaaagggagctaagtgtagcagaatgatgtactt

SEQ ID NO: 1414 - DNA, 265 bp, Zea mays
  Clone ID: LIB3227-022-P1-K1-D11
ccagccatgaacgtgaccgtggtcacatgcatgagagggatgcagactatggcaatggtgggacaaagcatgacaaaaatctgtctagttatgggcaggattatggctatggtcagtatgagcaacacaaaggtcatgatgcatatggttacagtcaagatgtacgtggacatgaaactgaacactcaaagcggcatgagcacgaatattatcgtgttgactcgtatggtaaaatggaagctaactatcagatgccgccaaacaa

SEQ ID NO: 1415 - DNA, 392 bp, Zea mays
  Clone ID: LIB3227-022-P1-K1-D12
gttgttgactccaagatggtcgtccagagaggccgcgagggagggccccagggaagacagatgaggattgcggagtgcttggttggtgatgaaaccggcatcattgtcttcactgcaagaaacgatcaagtggatgtaattaggcctggaacaactgttgaactgaggaacgcaaagatcgacatgttcaagggttcgatgcggcttgcagtggacaagtggggaattgtgaaagctgctgaaagctcagctgagtggacagtcaaggaggacaacaacctgtccttaattgagtttgagctggtgaccgtgacggagtgaaaaccgccattgcttaagagtattgttggtttgctgtgttgttgaacctaatcatcatcggcaatcaataa

SEQ ID NO: 1416 - DNA, 143 bp, Zea mays
  Clone ID: LIB3227-022-P1-K1-D2
acgcgtctagataccgagcgtacgcgccaactacattaaggcaatgcgtctatttgtgggtgagcctgcctggacaccatacaatcgggcgcatgaccatctcccggcttggatggagtacgttaagaaaattatgaaccgag

SEQ ID NO: 1417 - DNA, 250 bp, Zea mays
  Clone ID: LIB3227-022-P1-K1-D3
ggaaaagattagatgctaacagatataggtggtggttggggttacgatctcatttttttggtttccatcttcctcaatttttgttttgaggagttgtatatactctgctcacctataatcaaagctgcagctcttatcagaatttcccttggaaaaaaaaaaaaccaaaaaatgaaacactactgacaacttagcggaaggcaacaaaaagtgccggagccaagggccaagacgtcgacgggtccaaggt

SEQ ID NO: 1418 - DNA, 398 bp, Zea mays
  Clone ID: LIB3227-022-P1-K1-D4
ctcacgcgtacggaaaattcacttttctagagcacggagttaatgctcaatgcttcatactttggcaatcctttgatttggtcagtacggttcgtatatctgtgaaattggttgacaatgttcgtgcatgtgcgaccatggaatacctatccgctctaagatctgggagattataagattgtttgaaccttgatttcattgggtgccataggttacctgaaactaggtttatactgtggtcatgtgcaacaatccgtctggtggattatttgactccatctcaaagaggaccagttttatttgatggtcgttagggtgtataacaagggtagtggagaacttggtgtgtccatgaattataaacatccttgtagcctgttaattgtaatgacacaaaa

SEQ ID NO: 1419 - DNA, 352 bp, Zea mays
  Clone ID: LIB3227-022-P1-K1-D5
cgcgccacgcgtacggaaccttataatggtactcttgctgatgatggcactgggctgtacatgctgtcattggctctagaagcgggccctgttacaacgctacttattactgaaatatttgtctcgagaataagggccaaggctggcgcattatctctaggcatgcactgggtatctaactttttaattgacctgtacttcctgagggtcgggagcaagatcgggatcagcaacgtgtatgtgggattggcatcataatgtgcccttgcagttctgtacatagatataaatgggccccagaccaaggggggatcactagaatggatagaaagggaggtaagggtcgcggaat

SEQ ID NO: 1420 - DNA, 401 bp, Zea mays
  Clone ID: LIB3227-022-P1-K1-D6
cttgaatgtcagtcatgaagaaatcgacgtcagccatcctgatttctttagcagcgctaagctgaatggatacaccccacccaataaagaggactgtggacagccaggattcaccccagcagagagacggcgttttggcaacatattattccagattttatggaagtgaccactgccctgtttcgcttgagctttccgaagctgtagcagaagaagcaccaggacagcccaagccagccatctaaatataccaccatggtgatggtcattgttgagacatttccggtccttcattaaacctgactgtcccatgcattgcctactctaggtagctgaggtttgattgtaggtattattatgatcccagcaggttagcagttctgtggtcagggctggtatag

SEQ ID NO: 1421 - DNA, 394 bp, Zea mays
  Clone ID: LIB3227-022-P1-K1-D7
agttgctcttgcggtagttcccccaactgtcaccatgcagaacgaggagggtaagactgtggacctctatgttcccaggaagtgctcggccacaaacaggatcatcactgccaaggaccatgcctctgtccagatcaacattggccacttggatgcgaatggcctgtatgatggtcacttcacaacatttgctctctctgggtttgtccgtgctcagggcgatgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtat

SEQ ID NO: 1422 - DNA, 91 bp, Zea mays
  Clone ID: LIB3227-022-P1-K1-D8
ccaggcaccgaatcccgcaattccacgccacgacccacgcgtctcgaataaaaaaacaaaacaacaaaaaacaacaccgcgttgcggctat

SEQ ID NO: 1423 - DNA, 163 bp, Zea mays
  Clone ID: LIB3227-022-P1-K1-D9
gtccagcagcaccaggccagacaggcacacctcgaagaacaagagctgggcctcctggtaataagcgagagagagagagaggccaatggcagccaagtggtggctcgtcgcctccctgctgctctgcctcgccgtcgcattggcggcggcaagaacaacgccc

SEQ ID NO: 1424 - DNA, 182 bp, Zea mays
  unsure (1)..(182): unsure at all n locations; Clone ID: LIB3227-022-P1-K1-E1
ccggccgcgccaacgtctncaaggcggagttgaaggagaggcttgccaaggcgtacgaagtgaaggaccccaacaccatctttgtcttcaagttccgcacccacttcggaggaggaaagtccactggtttcggcctcatctacgacaacctcgaggctgccaagaagttcgagccgaaatac

SEQ ID NO: 1425 - DNA, 388 bp, Zea mays
  Clone ID: LIB3227-022-P1-K1-E10
acttccacttccacacccctgacgccccgctcgtcttcagcgccgagctgcccctgctcacgttcgccgggcgcgtcctcgtcgggatcccgaccatcctggccgtgaaattctgcagcaaggcgctctccaagtggctgcttcccgtggtgtgcagcaccctgggcatccccaccgtgtcgtcctgctacgtaccggccctgagagccgacagcggcagcggcagcggcaagaacaggcagggccccgggcacctgcagcggctgctgttctcccacttcccccggaaggcgtacgacgtggacacgggcatcaggttcgtccagtacgccagcctcgcgtggtccgtggttgacttggtgccggccatgttcgcccatctgaatct

SEQ ID NO: 1426 - DNA, 266 bp, Zea mays
  Clone ID: LIB3227-022-P1-K1-E11
aaaaaaaaaaaaaaaaaaaaaaaaaactttacattaataaaaaaaacaaaacgaacggggaacaacataaaattttttttttcttgaaaataaagtcctcccttttccccttaacataccttcccttctcccctctttcccttttttattttttccccttaccccatttaattccctttctttttcctcctttttcttctctcttcccctttaatccctcccccttctccccttttttccacttctcccttttccccccttccctt

SEQ ID NO: 1427 - DNA, 397 bp, Zea mays
  Clone ID: LIB3227-022-P1-K1-E12
ggagcaaacgtctctactgaatcagcagtgaggaaggcagaagatgttgtgagcagcatgctggccaagggcttcgtcctcagcaaagacgctctcaacctggcgagatcatttgacgagcgtcacaacatcctatccaacgccactgccactgttgcatccctagaccgccagtatggcctgagcgaaaagatcagtctcggaagggccattgtcggcagcaaggtcaaggaggtggacgagcggtaccaggtctcagaactcaccaagtccgccttggctgccgccgagcagaaagccagcgtcgcgggctccgctatactgagcaaccagtatgtctcggctggtgcctcgtggctaacaagcgcgttcgatatggtaacgaaggcagcgggcg

SEQ ID NO: 1428 - DNA, 396 bp, Zea mays
  Clone ID: LIB3227-022-P1-K1-E3
cacactatctattgccagttatgaggcctgttctttcatgggatgtaccagctccatcctggggacattgacttctttcattgacctctccccttacagaccttgtgggacttatcatttcttgacaagcagtgagcaattgattgttctcgcaaattcagatgctgtactgcagttgttattctactgccttcagttggatccccagcaacaactgcttgatgctgctgctagaagcttaagtgctcactggcagtacgaaccaattaaatactgcatacaggatatagtttgtgtggattacctgggaacaatctcatcagctgttcctggtaggcaggcaggcagagtggcccttggaagcattgaactgagcagggaagctatactgcacct

SEQ ID NO: 1429 - DNA, 307 bp, Zea mays
  Clone ID: LIB3227-022-P1-K1-E4
gctgttaactacaaaatggtaacgcacagatgccgttaaggatggacccaacggtgataaatttcgattggcgcgtgctcgtctggatcccaaacatccttgacttgaaatactgcaagaaagcactatccaaatggattttttccttggtgtgctgaaccactgacatacccacagattgacatttgtaatggcccgacccgaatagcaaaagacaaaaggggaatttgttaaaacagataaaagctcaggtcactgcacaggctgctggtttcacactttcccctgaaggcgtacgacgtggaca

SEQ ID NO: 1430 - DNA, 375 bp, Zea mays
  Clone ID: LIB3227-022-P1-K1-E5
gcactttgtaataccattcagttttgcttgctctgggcatttgtgagcagcctttggttttggaacacttgagatctattcaatatgaaaatgaagctattcatttacaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaggcgaaaaagcaaaaaaaaaaagaaaaaaaggggaaaaagaaaaaaaaaatagggggcgcggttttatggaaagaaaatttatgaccccacctctgccataaattatttttttttggggcacacataaattataaaacagggccggcgtttaaaaaaagttgcgggggggaaaaa

SEQ ID NO: 1431 - DNA, 400 bp, Zea mays
  Clone ID: LIB3227-022-P1-K1-E6
acttcacaggcatcaatttttgggcactcaatgggagggcatggcgcgctgacaatttacttgaaaaacactgataaatacaagtcggtgtcagcatttgctccaattgccaatccgataaactgcccttggggtcagaaagcattctcaaattacctgggctcaactaaatcagattgggaggaatatgacgcaacctgcctgattaaaaagaacagcaaagttcccactactatcctaattgaccagggggaggccgacaagttcctggctgagcagcagttgctacctcacaagttcgaggaggcgtgcaaggccgcaggggctgctctgaccttgcgcatgcagcctggatatgaccactcgtactatttcatcgctacgttcgtggacgatcaca

SEQ ID NO: 1432 - DNA, 219 bp, Zea mays
  unsure (1)..(219): unsure at all n locations; Clone ID: LIB3227-022-P1-K1-E7
cccacgcgtccggggggggttcctttccatggttcatggctggcatgagcttttatagactgtagactctgtgctagaggttttccagaaaggctgaactgccgctgctgggatgtgttggttcccgggcataagcaaagatgaaggctgtctttgcttttgtaattgaaaaaaaaaaaccccgacttcggtagcaatacattttcttgaaatgcgnaa

SEQ ID NO: 1433 - DNA, 429 bp, Zea mays
  Clone ID: LIB3227-022-P1-K1-E8
ggaatcgtccgggcggcccacacctacgcgtccatggacgcggccctgcgcgcaattatgcccaacctacacggagcaccctgtgaaggtgatcaaccgtctgattgtgggctctgccatggctctggggtggaagtctggggaccacaacaagcgagatccagaacctgttggccgagaagagctctttacgagccaccaacccctgtatttcccccaccatatgggcctggcgggaggagctatatacccttgccagcgcgccctgctaccccatttacgcgttccggcttcgccacatttacagcgaagaggagaccgcgccgatggagcccacgcccgcgccgtcaggagcaaatgatgggaagggagaggaaccgatctgcatatatctgaactctttccacacttttttacaaaggagcgtgt

SEQ ID NO: 1434 - DNA, 396 bp, Zea mays
  Clone ID: LIB3227-022-P1-K1-E9
ctcaaggtcccagccactgttcctcccgtcgccgatgactgcgaccagctgcgcaaagcattccaagggtggggcacgaacgaggcgctcatcatctccatcctcggccaccgcgacgccgcgcagcgccgcgccatccgccgcgcttacgccgaggcctacggcgaggagctcctccgctccatcacggacgagatctccggcgacttcgagagggccgtgatcctgtggacgctggacccagcggagcgcgacgcggtgctggccaacgaggcggcgcggaagtggaagcccgggaaccgtgtgctcgtcgagatcgcctgcacgcgcacctgcgcgcagatcttcgcgaccaggcaggcttatcacgagcggttcaagcgctcgcttgaggaa

SEQ ID NO: 1435 - DNA, 398 bp, Zea mays
  Clone ID: LIB3227-022-P1-K1-F1
aaagtagctgagtgcagcccatatcagacttctgtgaaatatcatggcagcaaacatgacaaagaacttttaacccagatgagaacgtggcttgcatataatcctctaggtctgaaagattttgaattgcagttaagaagtttaaaatctgattctacttttgatctagtatgcaaggttgttcatgttcatgaagataacgacaaattgatattttatgtttgggatggaactgatacccctgctgttgagtttcacgcaactttggatccaaaggcagttgaatcaccccctctatttgaagggccacctctacccagggaggttttgtgcacaatgccaattatcggaactgttttgaggattttttcagatatgcctatcaaggaagtatccca

SEQ ID NO: 1436 - DNA, 347 bp, Zea mays
  unsure (1)..(347): unsure at all n locations; Clone ID: LIB3227-022-P1-K1-F10
aaggggggaaccacgcgnnncgggaaaaaaaaagnnaaaacatatataaatttgaggacgcctataaaacgggggagccgtgggggtacaccttttaatcatccccaagaccaaccccaagaacgcaaagaggacttttgaaaaatcattaaccaacatgtaaaccaacccctccaatgtcgtttagcgtgaccacactacatgtcctggcgacaagaaaactcttggagggtacaccctacaactcctagcaacgccgaataacatttgctctctgctataagatcataccaccgctctctgtgccacctcacagcataaacaaaaccctccatactttgttatac

SEQ ID NO: 1437 - DNA, 393 bp, Zea mays
  Clone ID: LIB3227-022-P1-K1-F11
acgaaaaccatgctacaattctttaaatatggtgtaacagactattctgttactggcagcaagtcaaaaggaatactggcggctcagacaagcaaatctacagatatgctccatcttcagaccccaaccatcactccaccaaagtcctcgttcaacttcaagcccagcacctccattcttgattcacagatcgatgtgctcaaggccagcccaaaaccactctccatagaaccccatttgagctccagctcgaaggacgacgactcatccagcctcgagaccattgtgaagtgcaaggaagccgaggcaaaactgttccagaaactggccaatgatgcccggaaggacgtagacagctaccggcagatcgtgcgcgccaagacccataaactg

SEQ ID NO: 1438 - DNA, 400 bp, Zea mays
  Clone ID: LIB3227-022-P1-K1-F12
gaccgaactaaattttattattttttttttttttaggaaacatatttgcgctaatcagatttcatgctgctcagcaacaacgttagtttaagaaagctcctgaaacataacctagctcagatggatacattcaaatccaggttacaatagcattgccgtgcaacaagcactacagttttagaattttgacgggcatacttgcagtggaacctatatgcacaccgagacacttcgtactccgtaggtcactaagaacattccgcttcgatggcgagtgttttggtgactccagggcataaatccttcccaaagctctcgtttgtcaaggagactgtacagctgttggtgttcagacaggccttctcaacaacagataaagagttcgggtggtggcagcgcc

SEQ ID NO: 1439 - DNA, 380 bp, Zea mays
  Clone ID: LIB3227-022-P1-K1-F2
cctgtagatatataacgtccaaccttgtgcactatttaccgcctaccttgatgggactaggaaggatttgaggccgaatcatcataacagattgaaagccaagacgagattacagtgcagtttgcaggtcactgagcaattaacaagctaacttggggcacatccgagctcaaaaaaagctaagatacataacaatgtttgccgaacgaaatatggagagcgaacaatcgataacaagaagttgattggagccttcggagaacataaaaaccaacgaagagtccatgacaggagttgtacattgacgctgaaagttccgttacattagctctaaccagtgaccaacagttcccttgtgtaccaaatactttgggagcact

SEQ ID NO: 1440 - DNA, 146 bp, Zea mays
  Clone ID: LIB3227-022-P1-K1-F3
cttataattccggtggccggcgattctagatatgctttgaactttgaaggacgatctatcactctgtcaagcgagcgcatataacccgaggtgagagtggggtaccccgcgctattctagcccgaaaaccctacgcgcttataaaa

SEQ ID NO: 1441 - DNA, 378 bp, Zea mays
  Clone ID: LIB3227-022-P1-K1-F4
catcgctttacgttggatagtgacaactacatcaaggcaatgcgtctatttgtgggtgagcctgtctggacaccatacaatcgtccgcatgaccatctcccggctaggaaggagtacgtcgagaaaatcatcaaccgaggtggaaaccaagccgtcgaagctcgttgagcgtgtccactctacatgtcctcctgccgtctcagcctcttgtgttttacaccctacaactcctagtaccgccgaataagatttgctatctgcaatgtgctcatgccaccgctgtgtgtgccagttaacagtttgcacgaaaccctagatattttgttatacgaatgaatgacatgtggtgtttgataaatgatgaaacgatgatggttc

SEQ ID NO: 1442 - DNA, 118 bp, Zea mays
  Clone ID: LIB3227-022-P1-K1-F5
acgcgtccgactggaactatacacatagttcagacatcagtgctatgaggatgctaatctgatgaagctggttgcggaaatcattggaacactgtatgaccatcattcgtcacattcg

SEQ ID NO: 1443 - DNA, 352 bp, Zea mays
  Clone ID: LIB3227-022-P1-K1-F6
acaataaccacgtgaaagcacagcaactgcctccagatgcacctaaagcgagcggcggtcttgcaccaggagttgctattcccaacgttgctgctgctggggagaagggtggcaaagcttatattgttgcttggcgctttcggtgaaggaactcgatagtagtgtgaggcgtggtgcgacatgctcaccacccttgtccggcgccgaacaacccgctctccatcagttcgtttgtgatcaagccgtccaggtcgaggtcctccagttgatggaaggagtcgtcgaccttcgagttcaccgcaatgccaccggtagcagcagctggactgctgctcaccgacttgaagctgaa

SEQ ID NO: 1444 - DNA, 295 bp, Zea mays
  Clone ID: LIB3227-022-P1-K1-F7
cttaaacacggatgatctgaataaaagcaagtgtaccaacagtgtttcccaagcccaaggtcttgttggcagccagcaaaaactgattcctgcggatgggaaaggtagccctgtaactgtggttgggaaaggcaagcctgtaactgctggagtggcagcaactgggaggaagactaaattccctgtctcacatttggcagcagggaccccacgtggcattgttgacacagtcaacgccaacgccccaaataaaacgctagtaaggagggcagccatccctgcccctgtccctgct

SEQ ID NO: 1445 - DNA, 379 bp, Zea mays
  unsure (1)..(379): unsure at all n locations; Clone ID: LIB3227-022-P1-K1-F8
accggaccggacgttcggcccagacctcacgcttatcactccatctgcggctgcgacgccggcgagcccgacaccgcgaatcggatccgccgacaaggcgagagggaagagatggggctcacgttcaccaagctgttcagccggctgttcgccaagaaggagatgcggatcctgatggtgggactcgacgccgccggaaagaccaccatcctctacaagctgaagctcggcgagatcgtcaccaccatccccaccatcggattcaatgttgaaactgtggagtacaagaacatcagcttcactgtctgggatgtcgggggccaggacaagatcaggccactgtggaggcattacttncagaacacccagggtctcatct

SEQ ID NO: 1446 - DNA, 281 bp, Zea mays
  Clone ID: LIB3227-022-P1-K1-F9
atacgcccagaatgacatagtagtgctactgacaagaaagtggattgctctcaaatggggtgacagtaataggaaactgatgctctcgaaccccctgtctgcttacgggaaaggtaaacgcgaccgaatattattcttcaattcatgcacaatgaactacttcatagccttgttttatttcattcttcgcataatcggagaggaaccaaaccaacagagaacactccctttttcttttcttaacaaatcatttattatgatactatggagcgagaacatct

SEQ ID NO: 1447 - DNA, 70 bp, Zea mays
  Clone ID: LIB3227-022-P1-K1-G1
cttgtgggagttatacgcagagaatgacataagtaggggtaatgcaaaatggaattgttattgctctaaa

SEQ ID NO: 1448 - DNA, 271 bp, Zea mays
  Clone ID: LIB3227-022-P1-K1-G10
ataagaatggtcatttctaactcgtggatttattgaatccctgcaactgtggcaatcaaatattacctttggagcacacaaaactgattgcaacctatgaacagaagtaaagggcttccttgcaacttactacacgcttaaaatggaacacaagttagaaatgaccatttgatgatgaataagaatgaatgtctgccttgtgctattggatatggataccaataacagacacattgtcatgtatgctggtttaatcccataacaatgaaac

SEQ ID NO: 1449 - DNA, 250 bp, Zea mays
  Clone ID: LIB3227-022-P1-K1-G11
accttcggaattctttaaacacaagactggctactgtctcgtggtccggtatcgagaaaggatggcgggccttggcaagggtataggggcttgcaccccgaagaaagctacatttaggagcttctcaggcgcactctacatacccttgggtaaaaattgcaggttactataaggggggcaaaaaacttaaggattcctatctcctccccccccaactcatgggccactccaccgtataccacggcttaat

SEQ ID NO: 1450 - DNA, 388 bp, Zea mays
  unsure (1)..(388): unsure at all n locations; Clone ID: LIB3227-022-P1-K1-G2
gagtagtaatcggagccgtccgtagtagctagcgtacgtacgtgtgaccgattcagcgaggtcgccgtttgtgtgtcgatatatatggcgaggtcgccgtttgttccgatggatcaggggaaagagcaaggcgccggacgaggagcggccggcaataataaggagcggcagcagcaggagcaggagcaggaggaggtgctgctggtgcacagccacgtgcggcggatcaagaaggaggacgaggaggccttcanggagcgcctcctgaagctgcgcctgctggagacccggcccagcgccggcggcgtggcctggcgagccccgcgctccctgtcgccgctccggcgtgccggcagcgccatcatcccggtcccggtgagcgagtgac

SEQ ID NO: 1451 - DNA, 225 bp, Zea mays
  unsure (1)..(225): unsure at all n locations; Clone ID: LIB3227-022-P1-K1-G3
gctgtatggacatatctttgtcttgacataaggacagggaggtgacagtgttcttggtggggtcctggcagcatgactgcgtcgtgttttctttcctattgaatcttcgttccaccctcttgtttgtcaccgcaactgttatcgctgtaaagaagttactgcttgtgctgtgtagacaatttctgatatgggtctctcaaatccgctgcgtaactatactgantt

SEQ ID NO: 1452 - DNA, 183 bp, Zea mays
  unsure (1)..(183): unsure at all n locations; Clone ID: LIB3227-022-P1-K1-G4
cccacgcgtccgnnaaaaaaaaaaaattttataataaaaaaaaaaaaaaaaaaacggtaatggggaaaatatgaatagtgagaaaaaaacaaaaaaattgggggggcgctttaaagaaaacatatttatttccgccggcttccaacgacataatttttttatattgcaccaaaaaaaaatata

SEQ ID NO: 1453 - DNA, 403 bp, Zea mays
  Clone ID: LIB3227-022-P1-K1-G5
cccacgcgtccggcaaaccaatctattgagaaagttgaggtgttgcaatctaggacttatccattatttgttccatggaaaggtggagtgattttgggcgtccttgatattggtaaggatgcgtggattcatagagaagattggattaaaaatggtgtccacatcgggagtggcagaaaatataaggattcctattttcttcaggcgcaagtaatgtgctactacaacgtataacagtatcttatttccgagctacacacgaagacttgcacttatacaggttgttcgaccgtccaaaccatcctagaatatgattggtggactgcgattaaattgcgtacatgatgcatcagttctatgcatgctcgctgctgtctgttcggaggtcatcaactcgggacct

SEQ ID NO: 1454 - DNA, 199 bp, Zea mays
  Clone ID: LIB3227-022-P1-K1-G6
aattcttaaacggcgctgtgctttgttctggacccgggccctaaaaaagatgggggggcctgggaaaggtatatgggctttcccccccaaaaaagggaactttaagggcttccaaggccgaattccaattccccgggggcaggattgccaggttcttaaaggggggcaagaacccgaagggcgtggggcccggggcccc

SEQ ID NO: 1455 - DNA, 121 bp, Zea mays
  Clone ID: LIB3227-022-P1-K1-G7
actgaatatcctttcacagactacttgtacagtctttttagaaccgttgtaaaacctcatgcgatacgtcagcgcctttgaatcagagatcaactgaacaacctgttcaatgtttcctttt

SEQ ID NO: 1456 - DNA, 358 bp, Zea mays
  unsure (1)..(358): unsure at all n locations; Clone ID: LIB3227-022-P1-K1-G8
aaaaaaaaaaaaaaaaaagggcataaggtacggtacataaaaccaattcaggggaggtcgcacgtttgtgtgtcgatatatataagaaaggtcaccgtttgttccgatggatcaagggaaagagcaaggcgccggacgaggagcggccggcaataataaagagcggcagcagcttttttttttctttatttttttcttatggtgcacagccaggcgcggcggatcaagaaggaggacgaggaggccttcagggagcgcctcctgaaactgcgcctgctggagaccnagaccaacgccggcggcgtggcctggcgagccccccactttctgtcgtctgttcgccgtgccggcagcgcca

SEQ ID NO: 1457 - DNA, 388 bp, Zea mays
  Clone ID: LIB3227-022-P1-K1-G9
gaaccacacggataaaccctaactgcgcgagccccccggcgatgtcggtggccatgtcgctccggcgagctacttgcgtgccccatcgcactacggcgggcgcccttggctgtgtatgtggtgtccgagcggatgaaggctaggggcgccgtggctgtgccggcggaggcaacggccgagggggtagggaaagaggggaagaacgcggcggggaagaaaaagacggcgagcgggatcaccaagccgaatcccatctgtacagaactgcagaagttacgaggcggcgcagaagatctgtcccggactgaggccatcaagcttgtatgggcgcacatcaagggcaacaacctgcaggatccaaacaacatgaagataataatctgcgatg

SEQ ID NO: 1458 - DNA, 183 bp, Zea mays
  Clone ID: LIB3227-022-P1-K1-H1
aaaaaaaaaaaaaaaaaaaaaaaaaagtttataatttaagggaaaaaaaaaaaaaagggggggggggaaaaatggggggggggttgggtggctaaaatttttttaggcgggggggggggggaatggggagtgggtttttagtttttttgggggtgactttgtctctctcggtggggggggggg

SEQ ID NO: 1459 - DNA, 401 bp, Zea mays
  Clone ID: LIB3227-022-P1-K1-H10
gtcaagaaacacattaagcaaggggaagggcacacaggtggtattttctcggtcgaagccccacttcatgtctcaaatgtccaggtggttgatccagtcactgggaaaccatgtaagattggatacaagtatctggaagatgggaccaaagtcaggtacgctagaggaatgtacgcatcgggcgctgtgataccccggccagaaattctgaaggagagaaggaaaccgaggcccacgtcacctggcccgaaggacacaccaatcgagctggcgcaggagaagacctacgatgaaaaggctgggatcggtatgcccgatctatagctgcggagagttcagtgtaatgtgaccaggacctgacgccctgtgctgtgctgtgctgtgcttcccgcgtaataacg

SEQ ID NO: 1460 - DNA, 101 bp, Zea mays
  unsure (1)..(101): unsure at all n locations; Clone ID: LIB3227-022-P1-K1-H12
attagtttaagttacaccctaatncacctcaatagatgtgggttgagataaatattcttaatagactcaacactaaaactgattccttaaaaagtacctga

SEQ ID NO: 1461 - DNA, 116 bp, Zea mays
  Clone ID: LIB3227-022-P1-K1-H2
gacctatgcgtttcttttttcccacaagaaccaaaaaaaattctagttttaaaggactaaattccataggcgggggataattttacaccataattcaacttcccactgaacattcc

SEQ ID NO: 1462 - DNA, 380 bp, Zea mays
  unsure (1)..(380): unsure at all n locations; Clone ID: LIB3227-022-P1-K1-H3
nagtaaccgngaggtcccagagtctttgctgcctacgaaggacgaaattccggagccggatcataattctccaccagagatcaacttccaactgtgcattcctgatactactcagaaatggcttgacctatccaagtcgctttccaatgcagttagacgacagagaaggcatgactatgatgtcataatgctgaaggaccccaagaagagactatggcctgtcgtttaccacgacagcctgttatttgtgggattcaccgcgggctggaaacatttcgtggcatcaaacgaccttcgggctggggatgtctgggaacttgttaaggagccagacgatggtgagccggtgtactccggccggatgtctgatcacaaaattt

SEQ ID NO: 1463 - DNA, 391 bp, Zea mays
  Clone ID: LIB3227-022-P1-K1-H4
acgcacccggcccggatcccgggtcgcccacgccccccgcgtgcactcacgaaacacattaagcaatgggaagggcacacatgtggaattttgtcggccgtcgccccacttcatgtgtcaaatgttcaatttgttgatgcagtcactggcaaaccacgtaagattggatacaagcttcttgaacatgggaccaaaattaggtgcgctagacgaatgctcgcatacggcgctgctgttccccggtcagaaattatgggggatttgaggaaaccggggcccacgtaagctggggcgaaggacacacctattttgctggcgcaggacaagaccttccatggaaaagctgggatctgtgtacccgaactataggtgccgagaggtcaatgttatg

SEQ ID NO: 1464 - DNA, 248 bp, Zea mays
  Clone ID: LIB3227-022-P1-K1-H5
acgcgcccgccgttaatgggcactgaatatgcaaaattgaaggcttgtttacctcgtagcgaagaagatgggattcgaaatatcttaagtgacattccgataaaactagggttaacttaggaacactgctgttaaagagactcctcatcaaaatgttaaatgttgaaattttgccagatatgcattttttatcaaacatacacaatgaggttttagaagggatcgatatataaaagatgtgtgatgtg

SEQ ID NO: 1465 - DNA, 306 bp, Zea mays
  Clone ID: LIB3227-022-P1-K1-H7
aagaaggctatggtcactcctgctgaggatactccagccacagcgaagcaaccagatggagaggagggcaaaatttgtttcaacaatgaagaacacatcaaaacacctcatcaagaacaaagtacaacagatcaaactgaacaggtccttgagggtgcaaatgccagtgctgcagaacaaactgtaccaatcaatgcaccggcgcttactgttcaagagattgtcaatcgaattagagaaaatcctggagaccctaggatacttgaaacacaggagcccctccaagatttagttcgaggagtattg

SEQ ID NO: 1466 - DNA, 388 bp, Zea mays
  Clone ID: LIB3227-022-P1-K1-H9
gcaggaagctgtgagcaacccgttcctggtgaaggatcaccgtggagaagtgtacaagaagcaccatccacctgcattagccgacgacgtgtggcgcctggagaagatcgggaaagacggcgtgttccacaagaagctggctgacttcggaatccacactgtccaagacttcctcaggaacctggtgatggatcagtacggactgcgcagcttgcttggcagcggcatgtcgaacaagatgtgggaatccacggtggagcacgcccgggagtgcgtgctggacgacaggctctactcctactgcagcgggcacgggatcgtgctcctgttcaactgcgtctacgaagtcgtcggcgtggtcgtcgggagccactgcttcaccttggcc

SEQ ID NO: 1467 - DNA, 401 bp, Zea mays
  Clone ID: LIB3227-023-P1-K1-A1
cccgtcggcacggccccctcatgttcctccgccttggcgaggtcccgacgctggtggtgtccagcgccgaggcagcggagctggtgatgaagacccacgacctcgccttctgctcccgcccgaccaccagcgtcaccatcgacatcgtcggctgcaagggcaaggggctcggcttcgccccctacggcgaccggtggcgtcagatgaagaagatcaccgtcgtggagcttctcagcgccacgcaggtcaagcgcatcgagtccatcagagcccacgaggtgggacgcctcctccagtccgtcgccgccgccgccgcccgtggagccgtcaacgtcagcgccgaggtgaaggcgctcgcgccggacctcgtggcgagggccatgttcggtggcaactgcgcc

SEQ ID NO: 1468 - DNA, 387 bp, Zea mays
  Clone ID: LIB3227-023-P1-K1-A10
ctttttgcttggtgcctgtgtatatcgtcgccccggccgcttgagctagcttcctctagtgctcgctctcgtcgtcgatcggttgtttgcatagcccacggcgagccgaagcaatgtcgtcggcgcccctgcagatcgcgccggtgccggagcatgtgtgctacgtgcactgcaacttctgcaacacaattctcgcggtcagtgtcccgagtcacagcatgctgaacatcgtcacagtccgttgtgggcactgcactagcctgctgtcggtgaacttgagaggactcattcaatcacttcctgtccagaaccactactactcccagcagcaggagaatttcacggtccaaaatatgggttttactgaaaattaccctgagtacgcac

SEQ ID NO: 1469 - DNA, 385 bp, Zea mays
  Clone ID: LIB3227-023-P1-K1-A11
cagatccaagaagagggaagagcaccaaggaccttcggcgcccgttcaggatccacatcttcccgagcgagttcttggttgacctcttcctcttcggaccacctacaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaagagttcagctacagcaagatccttaaagatctcaagaaagagttctgctgcaatggtacagtggtccaagaccc

SEQ ID NO: 1470 - DNA, 279 bp, Zea mays
  Clone ID: LIB3227-023-P1-K1-A12
cagatccaagaagagggaagagctaccattgtaccttcggctgcccgttcaggatccacatgtcaccgatcgagttcttggtctacctttttctcttctgaccatctacaaggctctcggagtagctcgacactttcaccaatcaagtttgcatcgctgatatgaacagttatatcccaactaactttcatcccttcagggatggcgatgcttttaattaatagcggcaacctgttcatgttctatattcacttgttccctacaagaatttttattttt

SEQ ID NO: 1471 - DNA, 402 bp, Zea mays
  Clone ID: LIB3227-023-P1-K1-A2
gtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacacgcatagtgccgcgccacgtgctgctggcgatccgcaacgacgaggagctcgggaagctgctgaccggcgtgaccatctcccacggcggcgtgttgtccaacatcaacccggtcctgctgcccaagaagacggcggagaaggcgtccagcggcgggagcaaggaggccaagtcgcccaagaaggccgccaagtcccccaagaaggcataaggtttggaggcgga

SEQ ID NO: 1472 - DNA, 407 bp, Zea mays
  Clone ID: LIB3227-023-P1-K1-A3
caactaagtgtcgatgctgccatcaaaatccaacgcgcgtagtatctctcacgtccggaggagcctgtgtagcgctcaggtgtgtcacgcggcgtgaagatggtcgtgctaggcctctacaccgagatcggtaagaagaccagtcgatctgctgtacatggactactagactgaccacaagttcaacctgactacctacacctccaatggtgttggtgaaactgctcttagcacagataaagctgacctgatccttggcgagatccaatcacagataaagaacaagaacatgaccatagatgtgaaagcaaactcggagtcaaatatcagtacaacaattactgtggatgagattgcaacaccagggctgaagaccatattaagctttgctgttcctgatcagagat

SEQ ID NO: 1473 - DNA, 377 bp, Zea mays
  Clone ID: LIB3227-023-P1-K1-A4
caatgaaagagcagcttaggctgtccgaaagtagggcattgtactatacttgtcggtgttaattgacaccagcaagcatgtatatattgtcaggcgtattatagatgaacatattagatatttctattgtagtattttctcaaattttaaaagaatcatttcatgcagttcattctcatgtatgtatctgatatgcttgctttttcagcagcgtttttttagacaaagctcttcggcagctttgatttttgaaaaaaaaaaaaaaaaaaaaaaaaaaaaaaaaaaaaaaaaaaaataaaaaaaaaaaatataaaaaaaaaaaaataattttataaaaaaaaaaaaattttatataaaaaaatatttataaagggggg

SEQ ID NO: 1474 - DNA, 392 bp, Zea mays
  Clone ID: LIB3227-023-P1-K1-A5
agaagggcttcccatcaaactcagagggtgttggctcctcgacaaaccgacccagtggtttggtatctactaaatctagactcaaggttttacccagagaaggttctgaggaagccccgtctcgtccttcaccacttgtgcggtccgctagtaatccgaaggagaggacttccggtattaattctaaggagagaactggggacttggattgtcaagttcataaaaggttctccttgcctggcattggttcagaagctggtagacacctgacaaagaaaggcacagttaaccgatccctgaaggccacaaaagattcccacatgctggggtcaagacatcatcttgccagttgcattgatccagttcccactagagttgagctggagacttag

SEQ ID NO: 1475 - DNA, 397 bp, Zea mays
  Clone ID: LIB3227-023-P1-K1-A6
atcatccccatccgcacctctctccatctgcctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttact

SEQ ID NO: 1476 - DNA, 94 bp, Zea mays
  Clone ID: LIB3227-023-P1-K1-A7
gaaatccggactcgaaattctcttcatctgcatgatgctctaccttaaggatggtcgatacaagccagcggttcgcatgtctggctccgtatac

SEQ ID NO: 1477 - DNA, 391 bp, Zea mays
  Clone ID: LIB3227-023-P1-K1-A8
ggcgctgccgtggtacaccccgtacgtgtacaacaacccggtcggccgggtggtgcacatcgtggtgcagctcaccctcgggtggccgctgtacctggcgaccaacgcgtcggggcggccgtacccgcgcttcgcctgccacttcgacccctacggccccatctacaacgaccgggagcgcgcccagatcttcgtctcggacgccggcgtcgtggccgtggcgttcgggctgtacaagctggcggcggcgttcggggtctggtgggtggtgcgcgtgtacgccgtgccgctgctgatcgtgaacgcgtggctggtgctcatcacctacctgcagcacacccacccgtcgctcccccactacgactcgagcgagtgggactggctgcgcggc

SEQ ID NO: 1478 - DNA, 251 bp, Zea mays
  unsure (1)..(251): unsure at all n locations; Clone ID: LIB3227-023-P1-K1-A9
aagctggacatcctagagcggaagctggaggtgcttgaagtccaagtgggcagcgcgacgaccaacccttccgtcttcaactaggaatcgcgggtttatatgtataaataaatagataaatgtaggtatgaatgttgcttgtaccaacgaattctggtcgctatcaatcatgtaatgtaatggattttgttattattattgtggtatgtgtaaagatgtgcagannaaaaaacaaattttgagacaacccc

SEQ ID NO: 1479 - DNA, 398 bp, Zea mays
  Clone ID: LIB3227-023-P1-K1-B1
cggacgcgtgggtgtgcatgtacttcccgcgcttcgccgccttcaacttcaccaagggcgggatggcgctcttcaaccacggcagggggcagccgctgcagtacgtcgtcgccaactccttcatcgccgcgctctacgccgactacatggaggccgtcaacgtccccggctggtactgcggcccaaacttcatgaccaccaacgacctccgggagttcgccaggtctcaggtcaactacattctcggtgacaaccccaagaagatgagctacgtggttgggttcggcagcaagtacccgcggcacgtgcaccaccgtggcgcgtccacgccgcacaacggcgtcaagtactcgtgcaccggcggctacaagtggcgcgacagcaagaaggcggacccc

SEQ ID NO: 1480 - DNA, 362 bp, Zea mays
  Clone ID: LIB3227-023-P1-K1-B10
agatattaggtggtagttttggtggtcctacatggtatgagaacccatactacatttcccccaatcagatccgtgcactagagaagaggcagaaggcaggcaaatatgccaagaaggtgaaggccaaggtgaggcggaagatgcacgagatggagaacacgctggagcctgatgagtttgctgagctctggaaaggggagtaactggtctttgatcgaccctgtcaaagtcgtgaagcaccagcaactccttccaccaagcgcggattttgtttaccagtgtggcagtgcccactgtcgaggttgtggaagttttgtatcacaaagcatacttttatttatataaaatcggattttagtgat

SEQ ID NO: 1481 - DNA, 395 bp, Zea mays
  Clone ID: LIB3227-023-P1-K1-B11
gtttgcctgtggtgacaactatgtcaagtggcacttcgtccggatcgagccggtgggtccaaagttctagatccgaggatgacctagatctccaggcccagatggagaggaggagaaagcggaggaaggagtcgaatcgggagtcagctcggaggtctaggcaacggaagcaagaacaccttgacgacctcacctcacaggtaaatcagctgaaggaccagaacaagcagctcagcatggcactgagtataaccagccaaaaccttgtggcagtgcaagcgcagaactctgttctgcagacccagaagatggagctggacagcaggctgggtgccctgacggagatcctctggtacatgaactcaagcaccagcaccagcactgctcctacaaat

SEQ ID NO: 1482 - DNA, 300 bp, Zea mays
  Clone ID: LIB3227-023-P1-K1-B12
cccacgcctcgccacacttactagaagcgacgctggtatcaccatggttatgaacctgctcgggggttgggatctgtttcgataccaccttatataaaccgctttattgcccaaatttttcacaaaaactttcgaattactttggagattcaatgcactctcaaatgtctcctgaaaaagtaccataccgtctgactcacttgttctctaaaactattgaaaaaaatgttatatgaaatccattcttaacaactctgtgaaaatattaggcaagatcttattccatacatagacacaatc

SEQ ID NO: 1483 - DNA, 264 bp, Zea mays
  Clone ID: LIB3227-023-P1-K1-B2
cccgcgtccgaaaaaaaaaaaaaaaaaaaaaaaaaaaaaaaaataaaaaaaaaaaaaaaaaaaaaaaaaaaaaaaaaaaaaatatggggagggggctttcctgcgaccaatcaaactttcccatcggctggtttgttgttgctttggtatactgacactattttcagattatgcaaggtctttttttggagaggctgcctaacttaacgaccccccaggctcttctgttgtttggctgtgcagactacatcggtatcatcgagt

SEQ ID NO: 1484 - DNA, 353 bp, Zea mays
  Clone ID: LIB3227-023-P1-K1-B3
cgaacaaaactacttttccacagcactgtatctatacagcaaatacaatgttacgaaagctctgagaaaagcacgtatccgggctacaaacggcagaaaatacgccgttgggcatgctgttgctgtcattgaaaataagtttggggcaatgccggcactcttctgtaagaacggctcagttcatgaactcaggctctgcttccacaacgattataattctcgtgtttgtacactagatgtcgggtctgcaccgaacggtagaagatactgccctcgctacgttacgttaccgtcggataaaaaaaacggggggggcgggcctacgttgggatcaacaaccaatccaatggcga

SEQ ID NO: 1485 - DNA, 397 bp, Zea mays
  Clone ID: LIB3227-023-P1-K1-B4
gcaggcagccatcacgatggcgcttgcccacctccccttcgtcctcctcttggtgtcgtccgtcgccgctttcgccgccgccgaccacggcctcacgcacatccacctgtacgtgcacgagacgtacaccggggcgaacgccacggccgccgccgtgctgcagtccccgctgggcgccaactcgtcgttcgggagcatgggcgtggtggacgacgagatacgcgtgggcccggaccggtcgtcgcagctcgtcggccggtaccagggcgtcttcttcggcacgagcgtgcagctgggcgccggctacctgtcgtccatcacgctggtgttcaccgccggcgagtacaacgggagcaccctgtccgtgcaggggcccctgctcgggttcacgggcacc

SEQ ID NO: 1486 - DNA, 177 bp, Zea mays
  Clone ID: LIB3227-023-P1-K1-B5
atataaaaagaaccaagcttacatacacatacatgcgggggcggccgctttaaagtatccaagcttacgtcccctttcttgcgacgtattagttcttctttagggccaccaaaacccaatccactgcccgctgtttaacacctgcgggactggaaaaaccctggggttacccaattt

SEQ ID NO: 1487 - DNA, 397 bp, Zea mays
  Clone ID: LIB3227-023-P1-K1-B6
cacaaactacgctagaagcctggctggtatgagcatggttgtgaacatgcttgggtaatgagatgggcatgcaaacaaccttatgttcgaccgctatagtggaaaatttttacacatagtcttacaagattgctttgaggcttgaatgaatggagaaaagatccctgaaaaagtaccattccgagtgactcgaatgcttgctaaaactattgaagatagcgttattgagggtacattccgaactacttgtgaaactgcgatgcaagttcttctcacagacagagacacagtcatggacatgatggaggcatttgtacatgacccgttacttgaccggcgtatgatcaatctcaatgaggatcctaaagagtcgaactatgggtacgtccatgctcac

SEQ ID NO: 1488 - DNA, 361 bp, Zea mays
  Clone ID: LIB3227-023-P1-K1-B7
cagatgggtaaggtcggaatagtcctggacttcaactggtactaggctcttacaaactcacctgatgaccaatctgcttcccagagagccagggtcttacacatcgtctggtttgttgatccattgataaacggacactatccacagattatgcaagatctagtgaaggagaggctgtccacgttcactcctgagcaggctatactggtgatgggctcggcagactacatcggtatcaacgagtacacatcctgctacatgaacgggcagaagctggtccagctggctgcccagtatctactctgccgattggcaggttcaatatgtttttgcacgcaatggcaaaccgtttggaccacat

SEQ ID NO: 1489 - DNA, 71 bp, Zea mays
  Clone ID: LIB3227-023-P1-K1-B8
aaaataataataaaaaaaaaaaaaaaatataaaaaaaaaaaaaaaaaaaaaaaaaatataaaaaaaaataa

SEQ ID NO: 1490 - DNA, 387 bp, Zea mays
  Clone ID: LIB3227-023-P1-K1-B9
tgactacttctccacagcactgtatctctacagcaaatacaatgttacgaaagctctgagaaaagcacgtatccggcctacaagcggcagaaaatacgccgttggccatattgttgctgtcattgaatatgcgtttggggcaatgccgtcactcgtctgtaagaacggctcagttcaagaactcaggctctgcttccacaaggattatcagcctcgtgattgcacgcttgaggccggctctgcaccgaacggcagaagctactgccctcgctacgtcacgttcccgtcgtataaaccgtccgtggtggccaatactacggaggggatcaacaaccaatccaatggcgaggtttcgagctacacgcgtacgtctgactctgagtagcg

SEQ ID NO: 1491 - DNA, 203 bp, Zea mays
  Clone ID: LIB3227-023-P1-K1-C1
tgtaaatctgtatatgcctattgatgagtcatgttgtaagctgtaacgacactatgatccgtgaacaactgtagaagccaagtatgttctttctatgctgcccatttcccgggagtttccatgcattttgaagaaaaatttagaggctaactcattgatatttgtatttggtcatcattaataaatcgcctctccatctgtgc

SEQ ID NO: 1492 - DNA, 392 bp, Zea mays
  Clone ID: LIB3227-023-P1-K1-C10
ctcactctgaccctgcctggcactccattgcggcagtattcatagcgggggagacactacctagggcaggggatcattgtggatggatctaagatgatctacgatgctcgtcagatgaatgactacaaagcaccacacttcagcatgatcaatgaagctgatgcacgcagcacacagcagcatgacagtataatgggcatgagatagagaagtcccaaggacagacgcctaatcaccgacccaggtaggcggaatcagcaccaatgagaggataaaggcgatagctgaaacagagcaggctgatattctggatccatgtctgaatagatgatggcggataaaactgaacactatgtgctctcatgcatcagaagaagcgagagctaaagtcc

SEQ ID NO: 1493 - DNA, 392 bp, Zea mays
  Clone ID: LIB3227-023-P1-K1-C11
ggtagccagccgtgtcatcgcgtcgtcgtgtgccacgacgccgggccatagtggaagaaagctgattgccgctgtaacgttctcatcccaaattcatgaagcatacaagtgaatactataaattgagtgccctccctgctccgctatctcgttacgaacccaatgcaccactcctcgctcccgatcgtccaccatagctcgcaaattcccgttttcccccaaatcagccaacaacaccgccgtgaggcatctcactgtggccagccgatctcagaacacgaggaagaaaccatggtagaaaaagaagttgtctcccaagctgaaaattctccagccgagaacaacttttacttcgacatctacagagtggaccctgaacctcctgcaacaca

SEQ ID NO: 1494 - DNA, 215 bp, Zea mays
  Clone ID: LIB3227-023-P1-K1-C12
aaaaaaaaaaaaaaaaaaaaaaaaaaaaaaaaaaaaaaaaaaaaaaaaaaggaatgggaaaaaaaataaaaattttaaaaaaaaaaaaaaaaaaaaaaggttgtttttttttttggggggggtgtttttggtggggggtttttttgttcgtggtttttttttggtaaattttttttttagttagcggtttttttttttttgggggcgggtttttt

SEQ ID NO: 1495 - DNA, 391 bp, Zea mays
  Clone ID: LIB3227-023-P1-K1-C2
gtggactatgcgaagtttggatttgattttatacaacagagcaaccaaattggcccactcttccataacattgccctgcaacaatacatcctactttgttctcaggtactagagggaggcttgagggataagcctggaaagaacagagatcactatcattcatgctactgcctcagtggcctcgcagttagccagtacagtgccatgactgatactggttcgtgcccattacctcagcatgtgcttggaccgtactctaatttgctggagccaatccatccactctacaatgttgtcctagataagtaccatacagcctatgagttcttctcagaagagtgatctaatgttagaacctaagaacaattggctaaggttgtgtacgattgtg

SEQ ID NO: 1496 - DNA, 388 bp, Zea mays
  Clone ID: LIB3227-023-P1-K1-C3
tggggctcgggatcctggcggcgctcgaggccgagggcccgccgcagcccgcgccgagggtgtccatcccgcggcgcgcggcgcggctggaggtgtcggagctcgggtgcagcgggcgctgcgccaccagcctgtgcggcggcgtcggcccggcccccgcccggcccggcggcggcgcggcgttccgcgtcgcggagttcctgtcgtgctgcgacatgtgccggcgggcgctggacgggagggacatcttcatgtaccgcggggagaaagccttctgcagcatggagtgccggtaccacgccatggtgagcgacgagttccagcatgagaaggagcgcaagcgccgcgccgtcgtgtcccggacttcggccgcggagatggccgggtc

SEQ ID NO: 1497 - DNA, 396 bp, Zea mays
  Clone ID: LIB3227-023-P1-K1-C4
tccttccctacatggtccgcaacctggcagcacagatgaaataagttaaaagcaagctagcttattggtgcggtgggaataaattaaaaaggtactcagtgccccacgtatttgacgtgtgtctctgtaaataagtggcacattcgagcgctcttcgctatgccattgaggtggatcgaagctgccacatattttctccgcaggacatggcacgaattttgtcttagcaaaccagttattttgtactctttagattctttggttccattccatgctctctttggtacttttcatgtcagtttgctttgcaaacattatcagcgtgcccttgtagatttcgtaatggttatatgtatatgccctattgaaattgccattttgctttgcaaaaaataa

SEQ ID NO: 1498 - DNA, 394 bp, Zea mays
  Clone ID: LIB3227-023-P1-K1-C5
attttgttgtggtgtttgttgatggtttatgtgatgtggatctatcattgtgcaatactaattaaatttgtatatctatgtgattatgtgtataaaaattggtgatttgtgatgcttttgtatatataacagttgttgaatactaattaatggtatattatcattattaacgactataattaggggcaactttctgttggttgctagatgtatagtatagcgactcacgattggttgctaaatctatagtacaacaacccacggttggtcgctaaatatacaatattagcgacggacggtcggtcgctaaaaagatgtcggtcgctaaagcctttagcgacggcacttacagcgaccatccttatgggtcgctaaaagtttttagcaaccaacc

SEQ ID NO: 1499 - DNA, 288 bp, Zea mays
  Clone ID: LIB3227-023-P1-K1-C6
aaaaaaaaaaaaaaaaaaaaaaaaaaggaaaaacaatataaaaaaaaaaaaaattaaatacacataaaatcaaaaataataaactatactatagagtaaactaaatgtcaattcactgaacggggggggcgctttttggggtctgagattttccctggcgtttctcaacttaataattttttttttttatgcccctttataaaattttcgggggcccttttataaccgcgcggatgggaataaccttcggttgcccaaccttattggcttttgggacactcccttttt

SEQ ID NO: 1500 - DNA, 367 bp, Zea mays
  Clone ID: LIB3227-023-P1-K1-C7
taaaaaaagattggatttgattttatacaacagagcaaccaaattggcccactctttcataacattgccctgcaacaatacatcctactttgttctcaggtactaaagggaggcttgagggataagcctggaaagaacagagatcactatcattcatgctactgcctcagtggcctcgcagttagccagtacagtgccatgactgatactggttcgtgcccattacctaataatgggcttggaccgaactctaatttgctggagccaatccatccactctacaatgttgtcctagttaagtaccatacagcctatgagttcttctcagaagagtgatctaatgttagaacctaagaacaattggcta

SEQ ID NO: 1501 - DNA, 389 bp, Zea mays
  Clone ID: LIB3227-023-P1-K1-C8
gatccccaacaacgtcaagtccagtgtttgtgatatccctccgcgtggcctctccatggcctccaccttcattggcaactccacgtccatccaggagatgttccgccgtgtgagcgagcagttcactgctatgttcaggaggaaggctttcttgcattggtacactggtgagggcatggatgagatggagttcaccgaagctgagagcaacatgaacgatctggtgtccgagtaccagcagtaccaggatgccactgctgatgaggaggcggaatacgaggacgaggaggccatccaagacgagtaagggtggtttgggccctgccacatttgtacccttgtttcctttcattccggggcttgcctatggtttgcttgttgtatttgct

SEQ ID NO: 1502 - DNA, 389 bp, Zea mays
  Clone ID: LIB3227-023-P1-K1-C9
tgagcactgttcttctagatccaattcaggaactactgggattcccaattcaacaagcaagtacagagaggtacgctaagcaagccaagtcaataaattccttggattgcttgaacagttgtgtgatgtacctatccttggatggattgttgcaggacaaaagggtgaactggcactcgactccctttactatcaggctggatagagctttgaagaaaacttcggcatgaatgaattgtttctgtttattcagtcttgaatcgattgtatcttcattcagcatggccttgcaatacgcgacagtggatagtgcctatttctatctctttagtctagtagtttacatgtgctaattcgactgcattacacgggggttgatatgtatgtta

SEQ ID NO: 1503 - DNA, 377 bp, Zea mays
  Clone ID: LIB3227-023-P1-K1-D1
gggggtgtttttaatttatatggaactagaaatgcttacaatgcaaatggaaaccagtcagcaagatattcatcctcccctcaaaacaattttcaaacgtcgccatgcaatattacaggtcttcagtgtcgcctgaaagccagtttaatggttgattccttcagagtcaagcttcaagagggtccaatacgctagcattgggccctccacagcaacatcaaagttttgcattcccagcactcggccagtccatgcagtcaacaggcctgaattcttttgtagaattgccgcagctacagggaaaccttgtgcggtgtttttgactacctctgtgttttcaagatgaggagccatgagattctcgaaaacgaagaaat

SEQ ID NO: 1504 - DNA, 395 bp, Zea mays
  Clone ID: LIB3227-023-P1-K1-D10
caccgaccaatttcaggccggcgtcggtatctcgctgctggagatcctgtgcagccactcctacgacgaggtgcacctaggacagcgcgacaccaatgagtggacgtgtgacgcaaaggcacaggaggcgttaaagcggttcggcgcgcgtgtgaccgatatcgataaacgcgtgcaggccattaacaaggacccgcgctttaagaaccgatacagcgcggaccagttaccctacaccctgctcttgcgcaacacctccgacaagggcgattacaccagcgttaccgacaagggcattgccaacagcatttcaatatgattcgatcgagtcctggccagcgtttcacccaaaaaagcagagctcgcggtgattcccgtatgtcatccgtttcatt

SEQ ID NO: 1505 - DNA, 393 bp, Zea mays
  Clone ID: LIB3227-023-P1-K1-D11
gctggaagtgttgcgaccctggcgaactggctgacagcatgggccattacaatgacggcaagcctgatgttgaactggagcagtggaggaacctttgctatctacgccgtcgtgtctaccatggccctcattttcgtgtgcttgtgggtgcctgagaccaagggaagaacgctagaggaaatcgccttctcattccgctgacacgtcgtcatgatctaggtatgggaagccacaccacaccatgtgtcattgagtcatgccgcggtgcgttcagttcatgaatcccgcagggatcttgcggccattctgttgcttggatgtaccaccatcttcagtgttcataccaatgtacattgtacaatatgacgacgacgccatagcagaaaggcaagt

SEQ ID NO: 1506 - DNA, 364 bp, Zea mays
  Clone ID: LIB3227-023-P1-K1-D12
gctggaattcatgagacccacgcggactggctcacgacatagcccaatgcgatgacgccaagcgtgatgtttaactagagcagtcaaagaaccttatgtatttacaccaacgtgtataccatggccctcatttacgcgtgcatgcgtttactggaaacgaacataagaccgctctaagaaaacgagacacgcattagctgacacgtgacattaatctatgtatgaaaagccacaccacacgatcattcatggagtgatgccgaagtgagcacaggttatgaatgacgctgggatcttccgggcatttggttgatgaatgtacaaagaacaacagtggttcttcctctgtacattgtacaatatg

SEQ ID NO: 1507 - DNA, 394 bp, Zea mays
  Clone ID: LIB3227-023-P1-K1-D2
cttggaaaacaattctctggtggtgaattatactttcgaggtattcggtgtgagaatcatgtgaattcagagacacaacatgaggaaatgtatgactacacacatattcctggttgggctgtactccaccatggtcgacacaggcatggtgctcgagctacttcatctggactcagaataaatctgcttttgtggtgccggagctctgtgttcagagagatgaagaaataccagaaggattttccgagctggtgtggtgaatgccagcgcgaaaagagggaaaggcagagtcagtgtgttaaagcaacgaagatggcctttctcaggggttctggaggtgcagcgatttaatttgtacgtaggtcatttatgttatatactgttttgcgtcata

SEQ ID NO: 1508 - DNA, 396 bp, Zea mays
  Clone ID: LIB3227-023-P1-K1-D3
ccacgctttgcctgaggtgacaactatgtcaagtggcacttcgtccggatcgagccggtgggtccaaagttctagatccgaggatgacctagatctccaggcccagatggagaggaggagaatgtgcaggaaggagtcgaatcgggagtcagatcggaggtctaggcaacggaagcaagaacaccttgacgacctcacctcacaggtaaatcagctgaaggaccagaacaagcagctcagcatggcactgagtataaccagccaaaaccttgtggcagtgcaagcgcagaactctgttctgcagacccagaagatggagctggacagcaggctgggtgccctgacggagatcctctggtacatgaactcaagcaccagcaccagcactgctcctac

SEQ ID NO: 1509 - DNA, 399 bp, Zea mays
  Clone ID: LIB3227-023-P1-K1-D4
gcaggcagccatcacgatggcgcttgcccacctccccttcgtcctcctcttggtgtcgtccgtcgccgctttcgccgccgccgaccacggcctcacgcacatccacctgtacgtgcacgagacgtacaccggggcgaacgccacggccgccgccgtgctgcagtccccgctgggcgccaactcgtcgttcgggagcatgggcgtggtggacgacgagatacgcgtgggcccggaccggtcgtcgcagctcgtcggccggtaccagggcgtcttcttcggcacgagcgtgcagctgggcgccggctacctgtcgtccatcacgctggtgttcaccgccggcgagtacaacgggagcaccctgtccgtgcaggggcccctgctcgggttcacgggcaccat

SEQ ID NO: 1510 - DNA, 398 bp, Zea mays
  Clone ID: LIB3227-023-P1-K1-D5
atgaggtagtgacattatggtacagagctccagaaattctgcttggagcgaggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacag

SEQ ID NO: 1511 - DNA, 387 bp, Zea mays
  Clone ID: LIB3227-023-P1-K1-D6
atgaggtagtgacattatggtacagagctccagaaattctgcttggagcgaggcggtattccacaccagttgatgtgtggtctgtgggctgtatctttgcagaaatggtgaaccaaaagccactattccctggcgattctgagatcgacgaactttttaagatattcaggatactaggtacaccgaatgagcagagttggccaggagtcagttgtttgcctgacttcaagacagctttacccaggtggcaagctcatgacctggcaacagtagtcccaaatattgaccctgctgggttggaccttctctctaaaatgcttcgatacgagccaagcaaaagaatcacagcgaggcaagcacttgagcatgagtacttcaaggaccttg

SEQ ID NO: 1512 - DNA, 389 bp, Zea mays
  Clone ID: LIB3227-023-P1-K1-D7
caaacttcctccgcgggtattatgaatgaagatggaactagaaatgcttacaatgcaaatggaaaccagtcagcaagatatgcagccaccactcagaacattcctgcaaacgtcgccatgcaatatgacaggagtgcagtgtcgcctgaaagccagtttagtggttcatcccttcagagtcaagcttcaagagggtccaatacgctagcattgggccctccacagcaacatcaaagttttgcattcccagcactcggccagtccatgcagccaacaggcctgaatccttttgaagaatggccgcagcaacaggaaaactgtggcggtgttgatgactacctgatggagatcaggatgaggagccatgagattctcgaaaacgaagaaat

SEQ ID NO: 1513 - DNA, 379 bp, Zea mays
  Clone ID: LIB3227-023-P1-K1-D8
gctcattgtgttatttttctttcattttttaatcctattgcaggaaggacggatgcgtggtcaagcctttgtcacatttcccacggttgaacttgctcagcgtgccctgaatctagcgcatggctatgtgttcaaaggaaaaccaatgatcatacaattcggaagaaatcctgctgctaacaaagcttcctaaagcaggatacaattttctttccagattttgatagatttcagaagttggtaggaactggaaagtgacaaaccagaggttgtgggtatctgttggctgttgttactgcaacctgtttggcatacacactaggctgattggttcctcccatggtgtaatgtttgtcgaaaaataacattgtacattcca

SEQ ID NO: 1514 - DNA, 318 bp, Zea mays
  Clone ID: LIB3227-023-P1-K1-D9
agaacctagaactccaaaagcattacatgattcattagtgcaggaagggggggggctttttcaagcctttgtcacatttcccacggttgaactaactaaaattgccctgaatctagcacatgtctttttgtccaaaggaaatcctattgcgatacgcttttgaagaaatacttcttctaacaaagcttcctaaagcattatacaattttatttccagaccttgatatatttcagacgtcgtttttgaactgaatagtaacaaaacaaacgctgtgagtatatatttatatgttgttactgaaaactatttctcataca

SEQ ID NO: 1515 - DNA, 395 bp, Zea mays
  Clone ID: LIB3227-023-P1-K1-E1
gttgctcttgcggtagttcccccaactgtcaccatgcagaacgaggagggtaagactgtggacctctatgttcccaggaagtgctcggccacaaacaggatcatcactgccaaggaccatgcctctgtccagatcaacattggccacttggatgcgaatggcctgtatgatggtcacttcacaacatttgctctctctgggtttgtccgtgctcagggcgatgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtatct

SEQ ID NO: 1516 - DNA, 296 bp, Zea mays
  Clone ID: LIB3227-023-P1-K1-E10
gtgattatgcatcaaaaaaacgatgttctgtctcagagagagcgccgtgtgagcggccagattgcttgttgcggagaaaacacctccactcattcattagtatacaacgaacattcatggcgtactctccttaaacacgatcataccttcactaagactgcacatatcgtcatgctgattggacgagacacgccttacttgatctatgacatgactgactgttgtaataagcaaaccgatagagcatgttggctatgtttatgaagtaaccaaacgatctgattgaacctgtagtg

SEQ ID NO: 1517 - DNA, 336 bp, Zea mays
  Clone ID: LIB3227-023-P1-K1-E11
catcacctcccgcgagatccagacctttgtgcgcctcgtgctccccggcgagctcgccaagcacgccgtctctgagggcaccaaggccgtcaccaagttcacctcctcctaggcttgcacgctcgccctttgtaggcttctcttgtgttgatgttcgccttgtgttgtagttagatgttgctggtttctctgtcggcgctgctctgcttctgtaggaactgcgtcatgtaacccagcaaggacttgtttatttgtgaatcatcaacactttgttgttgatcacttatgttccaaattctgagtttgacgctggagcatgcctcatttgttgctgga

SEQ ID NO: 1518 - DNA, 284 bp, Zea mays
  Clone ID: LIB3227-023-P1-K1-E12
gtgcgcgtccgggcgaggaatgcatgcttggcggagagtaataaagtaatgctactggtattttaagctagatcgaggtgtgcctgtctctagtcatttatggtgtttagcaatcgtctacacagttcgtaaacggtgtatcgtggatgcatgttgccgcgagcagagtacgtaggcatgaaccgatgtgtgcgcttctgtctgtgtactctctctatgtagtaatgtgtggccagtgggtgctttgatccaaaaaaaaaataataaaaaaaaaatttaaatat

SEQ ID NO: 1519 - DNA, 397 bp, Zea mays
  Clone ID: LIB3227-023-P1-K1-E2
gtcgccttcgggagcgagtacccgatgaccgtcaagcagctgcacgagatcgcgcgcgggctggagctcgccgggacgcgcttcctctgggccctcaagaggcctagcgtcgcccaccccgacgaggacctcctgccgccaggtttcgaggagcgcacgcgcggccgtggctccgtcgtcacgggctgggttcctcagaccagcatactggggcatggcgccgtcgccgcgttcatgatgcactgcggctggggctccaccatcgaggcgcttcagtacggccatcctctggtcatgatgccagttctcgtcgaccacctgtccaccgcgcgggtgatggagcagcggaaggtcggagtcaaggtgcggaaggagaagagtgacgaagcgttccttg

SEQ ID NO: 1520 - DNA, 257 bp, Zea mays
  Clone ID: LIB3227-023-P1-K1-E3
tcgacgacgcgtacgcgctcctttggagggtgtacccgattactctctagcacctgcgcttgacacgcgcggggtgaatcttgtctgtacccgctgactatggcacgctaaaatatatagaacgcaccacccccgcgaggggcctatttgactatggtacataagagcgagaggaaggtcgtggtcacgacagaaatttttttttccctcgaagaggataaagaactcatggtaacactccctgttatattttcggt

SEQ ID NO: 1521 - DNA, 353 bp, Zea mays
  Clone ID: LIB3227-023-P1-K1-E4
gctcttctgattatgcatcaaagagacgaggtggagtacaagagagagcgccatgtgatcgtccggaaggcttgatgtggagagtccagtcagactcattcatggcatacaacgaacgttcatggcgtcctctcctcagacgcgtccataccttcactgagactgcacatctgtccgtcctgaggggacgagacacgccttagttggtctctgacatgactgactgttgtaatcagcaaacggcttgagcatgtaggctctgtttttgaagtgaccaaaggttctgattgaacctgtagtgtaccgtgtaactggtcaatcaattctgaaatgcaaaatttgtgttcttcgtc

SEQ ID NO: 1522 - DNA, 302 bp, Zea mays
  Clone ID: LIB3227-023-P1-K1-E5
aatggatttgtttgcgtccacattctgttctctaatctctactgtatacgttatgtatcatgtattcatgtaatcagaataatatacatatgcaagtttacgaatgacaggaatagtttcgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcggccgttttaaaggatccaagcttacttccccgtgcttgcaacgtaatagtttttttatagggtcacctaaattaaatta

SEQ ID NO: 1523 - DNA, 142 bp, Zea mays
  Clone ID: LIB3227-023-P1-K1-E6
aattaaattcttttacatcaaaaaaagctgtcctatttctttccgacacaacaaggaaggggtgatctttggtttcggaaagaacgcaactgccatatataaaaccgcatcgacttcccacctgacgattctactcttcaac

SEQ ID NO: 1524 - DNA, 135 bp, Zea mays
  Clone ID: LIB3227-023-P1-K1-E7
gcgccgacgcgataaagcaggatctgttcaagaacgctggctatggcggaggctgcttgtagaggggcatgtcatcatggcatgggaggaagaagaagaagaggcagcaataaattaatctttgccctgcctgcc

SEQ ID NO: 1525 - DNA, 366 bp, Zea mays
  Clone ID: LIB3227-023-P1-K1-E8
cagtcgctcgccaggaagctgtccctgccgtccccgaagcggggcggcggcggcatcgtcgaggacgggaagaagaagaagaagcgctcgctgtcgcgcggcgaggcgccgtcgttcgcgtgctcttcttcatcctcctcctcctcctccgccaccacgacgccgcggtccgtgctggcggcggcgccggcgctggagatcccgcggcggtagctggaggccgtgctgcgtcgcctggtccacgcggagccgtacgacgccgagctcgacgccgtggccgctctcgccgcgcatgccacgtctggcgacgcacacgcggacgccgacgccgacctaatggaggcgtgtcgcgtgttcgacgcggac

SEQ ID NO: 1526 - DNA, 392 bp, Zea mays
  Clone ID: LIB3227-023-P1-K1-E9
gggtgaaggctatagccgaaatatttgctgacgctgggttttcagatgttacaaagaatttcttggctgtcctggcggacaatggcaggctgaaatatattgaacgcattgcggagagatttgttgatttgactatggaacataagggggagatgaaggttgtggtcaggacagttatttcactcaccaaggaggaggagaaagaactcaaggaaaccttgcaggatatccttggggaaaacaaaactattttggttgaacagaagattgactacagcatcatgggaggattagtgattgaattcgggcagaaggtgcttgatatctcaatcaggaacagggcgaagcaaatggaggcgttcttgaggcaaccacttgacttctaacagcct

SEQ ID NO: 1527 - DNA, 395 bp, Zea mays
  Clone ID: LIB3227-023-P1-K1-F10
ccagtaactcgcatcttcctccgtgatccaagttctagcagcgcagcgctcggtttcgacaatatgtcggggcgcggcaagggcggcaagggtctgggcaagggcggcgccaagcgccaccgcaaggtcctgcgcgacaatatccagggcatcaccaagccggcgatccggaggctggctaggaggggcggcgtcaagcgcatctccgggctcatctacgaggagacccgcggtgtgctcaagatctttctggagaacgtcattcgtgacgccgtcacctacaccgagcacgcccggcgcaagaccgtcaccgccatggatgtcgtctacgcgctcaagcgacagggccgcaccctctacggcttcggcggctaggtcgcttcgtcatctggtgg

SEQ ID NO: 1528 - DNA, 370 bp, Zea mays
  Clone ID: LIB3227-023-P1-K1-F11
acgtcagaactgtatcagggttgcccaatggatgcttcaaactcctggtgcagcacgttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagctgaaaaggcaaaatacatctacatagatggatctttccttacagtgtagcctgattctatccagctagtaaataagcatgctgcagcaaataac

SEQ ID NO: 1529 - DNA, 360 bp, Zea mays
  Clone ID: LIB3227-023-P1-K1-F12
cgacctacgcgtagctttagaatgtgttcatgatggctggggtgttgctgtactgctgggtgggggacataaggacgctttggttaagacccaccctatgaacttcctgaacgaaaggaccctgaaggggaccttttttgggaactataaaccacgcactgatctgccaaatgtggtggagctgtacatgaaaaaagagcttgggggggggaaatttattacgcacagcgttccgttcgccgagatcaaaaaagcgtttgaacttattgccaatggggagggcatccgctgcatcatccgcatggagaactagatttcgctttcttactcgtgatccgggccgggcctgtggttaataaa

SEQ ID NO: 1530 - DNA, 392 bp, Zea mays
  Clone ID: LIB3227-023-P1-K1-F2
ggaagaccgtaccatatcagtgcgctttatgttgttgatttggccaaatttcggcaaactgcttctggggatactcttcgtgtcttctatgaacaactcagcaaggaccccaatagtctctccaatcttgatcaggatctcccgaattatgcccaacacacggtgcctatattctctcttcctcaagaatggctgtggtgtgaatcttggtgtggaaatgccacaaaagcaagagcaaagaccattgatctatgcaacaatccaatgacaaaggagccaaagcttcagggtgctagaagaatagttccggagtggactggtcttgacagtgaagcacggcagttcactgcacgaatcttgggtgatgatgtcgagcctgcagatgccacacc

SEQ ID NO: 1531 - DNA, 300 bp, Zea mays
  Clone ID: LIB3227-023-P1-K1-F3
atgcggccgacggggaactggaggcaaagtcgcccaagaaggccgccaagtccgctaacaaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctcctggatcccgacactggactcgtacgcgcgggtcgtctcggg

SEQ ID NO: 1532 - DNA, 388 bp, Zea mays
  Clone ID: LIB3227-023-P1-K1-F4
ctggatatgctggtggtcgtggtggccgcacagtagccgctggtgcacctgcaaaatgagggacaacatacctgttgcacgtctactgtgtcgttcgattgccctcatatagctttgaagcatggcataaatatccatcaattggtccattgcggcgttaccagaaaaggctggatacaaatttttggagttcctgtgcatcactatttttgcaagctacaaaagctaaaaaagtgattactaattgagtcattgtagaatagacacctattcaaatgtaggtttagttttactcgtcggttggtgagcctgtcattcatgcaatgctatactactgctagtattcatttattgtgtcgattagaggttaatagccgtctcggggctg

SEQ ID NO: 1533 - DNA, 98 bp, Zea mays
  Clone ID: LIB3227-023-P1-K1-F5
tccgcttccgctccgtaccaaccgccccggttggaagtctggagaccggacctgctgccgttcctgctttcacacttgcgagtcgtactattttaacc

SEQ ID NO: 1534 - DNA, 402 bp, Zea mays
  Clone ID: LIB3227-023-P1-K1-F6
ccaagctttcgaatgtgttcatgatggctggggtgttgctgtgctggtgggtgtgccacataaggacgctgagttcaagacccacccgatgaacttcctgaacgaaaggaccctgaaggggaccttctttggcaactataagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcg

SEQ ID NO: 1535 - DNA, 369 bp, Zea mays
  unsure (1)..(369): unsure at all n locations; Clone ID: LIB3227-023-P1-K1-F7
agaaaactagaaaaggctcctcccgaccgcaacgcccctcatctccctcgaccccgacatccccgacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaactccttcatcaacgacatctntgagaaagctgccggcga

SEQ ID NO: 1536 - DNA, 386 bp, Zea mays
  Clone ID: LIB3227-023-P1-K1-F8
acccaatctcccctacaccagaaaaattcccagttctttggtccgcgtcagagaggcggcggcgatgtctgggcgcggcaagggcggcaagggtctgggcaagggcggcgcgaagcgccaccggaaggtgctccgcgacaacattcagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggacgcaccctctacggcttcggaggctaggctaggcgcc

SEQ ID NO: 1537 - DNA, 388 bp, Zea mays
  Clone ID: LIB3227-023-P1-K1-F9
ggtcaagagcgtcatcatggagcggaacgtacccagagcagttgagcagcactgccgcttccaggtcacctgatggacagatgacgcagtcaccatcgatgcctggaagaagacctccgcacagccgttccaacagcgcgtcttcttccgcccagctcaatggtttgggtgaggatcttcacgaggtggagctctgacacctggccgcagattttgaccataatgtgatttatattaatagctgcatgtgtctagagagcaaagcaaaggaaattaaagtgcggtgtccctttttcaatttttttacatgtgaaagactgtggatgccgctgcattgtacagatagttgactcgttcgccagatgaaaaatgtataacaagagtcgta

SEQ ID NO: 1538 - DNA, 399 bp, Zea mays
  Clone ID: LIB3227-023-P1-K1-G10
gaacggcgctgtagagcagatgtacaatgagatggcttctcgccaccgcgtgaggtccccctgcatccagatcatcaagaccgccacagtacacttcaagctgtgcaagagggacaacaccaagcagtttcacaacagtgagatcaagttcccactcgtgtaccgcaaggtcaggccgtcgaccaggaagctgatgaccacgttcaaggcttcgaggcccaacctgttcatgtgatttagctgtggtcagtgtatgtgatcgtaagaatctgtgttttaagttttgacgctaagacttgggtggtttgaagattcaactcgttttgaaacgtgcatggtgaaccatttgccgactgccggcttgttcgtactcggcacacttaatgttgatctatatgg

SEQ ID NO: 1539 - DNA, 372 bp, Zea mays
  Clone ID: LIB3227-023-P1-K1-G11
cagagcttttgttgaactcctcagaatatactgctgccatcgatgtgtggtctgtgggctgtatatttatggaactgatggaccgcaaacccttgtttcctggaagagaccatgtccatcagctacgtcttataatggagctcattggcacgccaaatgagggtgatcttgattctgtaaatgaaaatgcaagaagatatatccgccaacttcctcgtaaccctatacagtccttacctgaaaaatttccacatgtacaacccttatcaattgacctggtggaaaagatgctgacttttgatcctagacagagaataactgctgaatgcgcacttgcacacccttacttggcatcacttcatgacataagtg

SEQ ID NO: 1540 - DNA, 403 bp, Zea mays
  Clone ID: LIB3227-023-P1-K1-G12
acggtttacatgaagcaagagaagaggcccgaacaaacaaatgctcatctgacagaagggctgttgagtatgatgctctgcggtcatctgctttgaggatacatggtttattcgaaaggctaaataattgtgtcactgcaccaggcatgactggttttgcagagtcactgcgttctctggctctttccttggcaagctctgtaaagaaggacgaagctgataccactgtacagtttcaacaatgcatcaagatcctggcagacaaagtttatttactgacacgacagagtgctgagctgctagaacgctattcagctatgcaggcggtacatggagatatcacaaaagagttggatttgaagaaagtgctgattaagaatctctacaataaacttcaacaaga

SEQ ID NO: 1541 - DNA, 388 bp, Zea mays
  Clone ID: LIB3227-023-P1-K1-G2
agaaggagcccaaatttctcaagaacggtgatgctggtatggtgaagatggttcccactaagcccatggtggtggagaccttttctcagtatcctcctcttggtcgatttgctgtccgtgacatgaggcaaacggtggctgtcggagtcatcaagagtgtggagaagaaggacccaactggagccaaggtgacgaaggctgctgccaagaagaaatgatctatctggctggtgacgaaggctgctgccaagaagaaatgatctatctggctggtgctgtgcttgcttgttggttacctcgtggaagcttaaaatatctcgtcttgttgacatccttgcagttgtcgcgtgaacaagtaatctatgatggcaatgtttggctggtcatg

SEQ ID NO: 1542 - DNA, 382 bp, Zea mays
  Clone ID: LIB3227-023-P1-K1-G3
gaaggacatcactcccatgggtggcttcccccactatggtatcgtgaagggtgactacctgatgatcaagggatgctgtgtgggtccaaagaagagggtggtgaccctccgccagtccctcctgaagcagacttcccggctggcgctggaggagatcaagctcaagttcatcgacacatcgtccaaatttgggcatggtcgcttccagactaccgatgagaagcagaggttctttggtaagctcaaggcgtaaggtgctgctgtgcagcgacaagtcccatttgtcaaaatcatcaaactgtgaaactttcgtttgttaccttgctgtaccatgttttgtagcatgatgatctgggcgcaatcgacttgcatcacattcccc

SEQ ID NO: 1543 - DNA, 400 bp, Zea mays
  Clone ID: LIB3227-023-P1-K1-G5
ggcagaacctgtgaatgtgacaaaaccttcaccacacaagctgctggttctaggaggaagtggtttcgttggatcacacgtttgcaaagaggctttggacaaaggtttagttgtctctagtcttaatagatcgggaaagccatccttaaatgaaccttgggctgacaaagttatatggaaccaaggcaacctccttgaaccagcttcattgaaggatgctatggataatgtttctgcagtggtatcttgtgtcggaggttttggatcaaattcattcatgtataagattaatgggactgcaaacatcaatgccatcagggctgcagctgagaaaggtgtaaagagatttgtatatgtgtcagctgcagactttggattagtgaattatttattgcaaggc

SEQ ID NO: 1544 - DNA, 405 bp, Zea mays
  Clone ID: LIB3227-023-P1-K1-G6
gtacaatgggatatgcttaatggtgcaaaagctcgttaacatcataaagcagatggacccaagagaccctttcagaatccagatgacagacttgattctcgataagctgtataatatgggtgtaatttcaacaaaagagagcttgttaaagtgtgagaaactttcagtgagcgccttctgcaggcggagacttgcaacagttatggtgaagctcaagtttgcagagcaccttaaggaggctgtgacgtacatcgaacaggggcatgtgcgtgtcggtccagatgcagtcacggacccagcctttcttgtgaccagaaacatggaggacttcatcacctgggtggattcctcaaagatcaagaggaaggtcatggagtacaatgatgcattagatgattatgatgc

SEQ ID NO: 1545 - DNA, 326 bp, Zea mays
  Clone ID: LIB3227-023-P1-K1-G7
gtaccagggcgcgggtgaagacatgggcggcgctggcggcatggacgaggacgcccccgctggcagcggcggccctggccccaagatcgaggaggtggactaagcggtttgttgtcagtcttgagcgtgctgcagttgctggctggcccagtcgctgccgcgagttatcgtcgtcggtcggtgcggtgtgtccgcttaaactttatttgtggtgggctggtacttttgtggtggttattttttttggacctagtgatagtcggtcggttccatgttatcgcggctactggcaaaccttaagtgatacggtaattcttcttttcagt

SEQ ID NO: 1546 - DNA, 200 bp, Zea mays
  Clone ID: LIB3227-023-P1-K1-G9
ggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactatcgtcaacatcataatataaattcaaagagccatc

SEQ ID NO: 1547 - DNA, 395 bp, Zea mays
  Clone ID: LIB3227-023-P1-K1-H1
ctacgagcagccacccgtcacgctacgtcaagctcaccaaggaccaggacgcccccgccgaggacatccgccccggcgagctcaaccagccagttcacgtcccgcagctcgaaggccggaggtgtagcgagtgcggtcaggtcctgcccgagagctacgagccgcccgccgacgagccctggaccaccgggatcttcggatgcaccgatgacccagagacctgccgaactggattgttttgcccctgcgtgctgtttgggcgcaacgttgaggctgttagggaggacatcccttggacaactccttgcgtgtgccatgctgtattcgttgaaggagggatcacgctggcgattctgacggcgatatttcacggtgttgatccgaggacgtcattc

SEQ ID NO: 1548 - DNA, 94 bp, Zea mays
  Clone ID: LIB3227-023-P1-K1-H10
tgagacttttagaaaatccgtcatatcccaaaggttacaatttattcattaagccttgatttccaataaaggtaatggggaggattgaaggggc

SEQ ID NO: 1549 - DNA, 262 bp, Zea mays
  Clone ID: LIB3227-023-P1-K1-H11
aaattggttttatctatgttggcgagacaatgatgcattcttttatcacatgccctgcatgagctttgcataaatgatgttccaatcatcaactagagctgaaacaggtctacaaggtactgaaaaagagtacatattggtcacattgcacatctatgttttcaataggaatgggatcaagatctacgcagttcatcgatggcaatacccctttcctcctttaagatacgaagatagaaactcccactccgacggacataaa

SEQ ID NO: 1550 - DNA, 180 bp, Zea mays
  Clone ID: LIB3227-023-P1-K1-H12
ctgtaacagactggcctacaggcaattttgtatgcatctcatcaagatacatcatgcatacacgaatgagttgttattgaatcatgcgtggaagtggaatattgcaagaaattgtttttggcttcttaataaaaacaaaataaaggagtagttttgaaaaaaaaaatttgttttgtaagc

SEQ ID NO: 1551 - DNA, 311 bp, Zea mays
  Clone ID: LIB3227-023-P1-K1-H2
aatgggtttcacctgctactaactacgacctgataatggtcgttagtttatacagtgtttacgaaatggaaagtagattattgctgctatgatgtattgccactatatttaggtgtattttcccagtggcagttcaatgaacactacattgtggtgtttgtaacttttaataccccgtttgggtgtagatattggagcacagaattgaaaattagaatcagctttccaaaaaaaaaaaaaaaaaaaaaaaaaaaaaaaaaaaaaaaaaaaaaaaaaaaataaaaaaagggaaaaatttatgtaaaatcctt

SEQ ID NO: 1552 - DNA, 296 bp, Zea mays
  Clone ID: LIB3227-023-P1-K1-H3
aaaaaaaaaaaaaaaaaaaaaaaaaaaaaaaaaaaaaaaaaaaaaaaaaaaataaaaaaaaaaaaaaataaaaaaaaaaaaataaaattaatataaaaaaaataaaaaataaataaaaaaataaaaaatgggggggccttttttgggttccaaattttacaacccgttgtttgcgagttttttttttttttttttggtcccctaatttaatttttttgcccgttttttaaaaacgtgttatttggaaaacccttggttttcccaaattttttgtttttggataattttcctttttt

SEQ ID NO: 1553 - DNA, 372 bp, Zea mays
  Clone ID: LIB3227-023-P1-K1-H4
ggccctgcctgatggcattgagcatcttagaacacttgagaaattatatctgcgaggagcatccaaagagctcacaaagctatttcagtgcaatgaagaaacacatgagtccaatgggaatcttgagaagatcggtcatatccgaagggttactgtttatccataagggtttgattggaagtaagggtaatggggaggattgaaggggctagaatctctcactattctattttaaatagtgaggaattctagccctctcgatctccttcgttccattcactcccaaactagccctaaaaaggatgctaatacttgataatattaacccatacacttgcggactagtgttggtctttttaccgattgcatact

SEQ ID NO: 1554 - DNA, 395 bp, Zea mays
  Clone ID: LIB3227-023-P1-K1-H6
gacccccgtctacgatgagagggctgcggccaacaaaatcggcatcatctaagttaataggcaactggattcgacatctatgtcctactacttctgagcataccaacagatttttctatgttactagcaattgctgaaacaatattacatggttcttttacaaataacattttgttcacattcgcaaactacatatgcctgtattgagttcctggttgccaaactaaccatcttgaactggccttattccacttttaaaatacgaaaataaaaactcccactccgacggacaataaatttttttagcggaaagccattttacctaaaaaaacttgccaacattatgaccttttaaaacttcttttgggggggggatcttaaaaatataaaatttt

SEQ ID NO: 1555 - DNA, 394 bp, Zea mays
  Clone ID: LIB3227-023-P1-K1-H7
agcaccttcccaaaaaaatcccccattttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacagcttcggaggctaggctggatg

SEQ ID NO: 1556 - DNA, 246 bp, Zea mays
  Clone ID: LIB3227-023-P1-K1-H8
gtttcaagtagtaagggatacaaacttcgagttaaaaatattggccaagtgcgatggtcttgtaccgaagatgctactggtgtacaactgtcaggaaatcgtggtttacttgtttcctcttttgtttttgttttacttcttcccttttctggatctggaaaattcgtagtcgttggcgagctttgcaagctaaaggctaacggagcatatgtgtttttaattccgtcttcatgtttgtgtccaaaa

SEQ ID NO: 1557 - DNA, 329 bp, Zea mays
  Clone ID: LIB3227-023-P1-K1-H9
gaatataccatgctgcggatcacgtgacacaagctcaccaaaaggaaccgtgtggaagactgtacctcacaggttgcttttcggtagatcgtctaccccttgttggggaactggtggtgtggcttttctcaaccctgagataaactacaatgagaagtcgcatgtctgcatgttcaaaataacgttggagcagttcaatgacatcttgtttcatgagaatcatttagtgctggaggatggctttgtcggaaacactgtgtatcctgactctcctttgattggttcatctgtaatcaagtttatttctacaaacagagctgttcatcttg

SEQ ID NO: 1558 - DNA, 283 bp, Zea mays
  Clone ID: LIB3227-024-P1-K1-A1
gtgaccggcaacctgagacggagatgtcaggcatgggcaagggctttaaggagctggctgcgggtgctgctaatgatgcgagccatctgattggaactgatgagaggcaacccctgttgcctacatgaactagtttcttgaggtagggatagatgactctttttttgcggtgtgagcagcaggtttggtgtagcattgtgagttgaataaactatgtgacactgtaaaggcaaaggaaagaaagaactaccaacatcttctccattttctttcatttttggga

SEQ ID NO: 1559 - DNA, 400 bp, Zea mays
  Clone ID: LIB3227-024-P1-K1-A10
gaaggcgcagggcggcgcccacttcgttccctactcgcagttccctcctggcgccgtcgtccgcgccgactgcgtctaccacagcaccccggcgctggtggtgccggacgccttcgaggacctccacgcatgcgagaactggctgccgcggagggtgatgagcgcgtggcgcgcggcgggcatcgtgcacgcgctcgaaggctgggacgcgcacgagtgcggcgccagggtcaccggcgtcgacaaggcctggcgcgccgcgctcgcccacggcttccgcccctacgaccgctatggcgccaactaatacgtgaagtgaccattacgaacgacgacgactacgaagcgtacctgtgcatggaatgatgagtagcatctatatctatgaaaagacgagggg

SEQ ID NO: 1560 - DNA, 364 bp, Zea mays
  Clone ID: LIB3227-024-P1-K1-A11
ggcccgtattccctgctcgttcagtcgtcctcttcctccaaacctttccggtgccggtgaacttcctccacctgaagcccctaccacgataagccctaatcccagcgccacctcgatggcgaccacctctttctttcatccgctcgccgccccgatggaccgcggtagcgtttgttttcgtcgctgcccgttcagcctaaccatccccgcccgtacagcgccccggcgaccggcgccgcttctcgtcgtccgcgctaagcgcgccggcagccaggcccctgctgtcgccgcctcgcgtcagcccgcgaatcccagcgcggtcccgaagcgggacgtggaagaagaggaggaggaagtctaggag

SEQ ID NO: 1561 - DNA, 389 bp, Zea mays
  Clone ID: LIB3227-024-P1-K1-A12
ttcgtgattttgatcttatccttgcaatggacaggcagaactatgaagatatattgaactcgtttgagagatggagacgcaaagagcccctccctgatagtgcacccaataaggttaagctgatgtgctcctactgcaaacatcatactgagtctgaagttccagatccttattatggaggccctcagggatttgaaaaggtgctggacttattggaagatgcttgcgagtcgctgcttgatagtatcgtcgcaaacaatgcaagcatttctgggtgacatcgatgtaaatctccacatacagacatctattttcagacgcaccgaaggctgtagcatccatgcacaacccgagtaatttgtttctaatgcaacattgatcatgtcgtc

SEQ ID NO: 1562 - DNA, 420 bp, Zea mays
  unsure (1)..(420): unsure at all n locations; Clone ID: LIB3227-024-P1-K1-A2
ccgcacctcgtttcctctcccgtctccgagatgacgaagcgaaccaagaaggccggaattgttggcaaatatggaaccaggtatggtgctagcttgcgtaagcaaatcaagaagatggaggtatctcagcactccaagtatttctgtgagttctgtgggaagtttgctgtgaagaggaaagcggttgggatttggggatgcaaggactgtgggaaggtcaaggccggtggtgcttacaccatgaacactgctagtgcggtcactgtcaggagcacgatccgtcgcttgagggagcagactgaagcatgatcggtcgcttgtcaggcatactggngtccactatattggctgtgtacccgagacagtactccagcatttttgggtatgctctaggatctttaaaggttgggtgctaaaatt

SEQ ID NO: 1563 - DNA, 358 bp, Zea mays
  Clone ID: LIB3227-024-P1-K1-A4
cgctcatcaagaagctgcgcaaggcgaaaaaggatgctcctgctggtgagaagcccgagccagtcaagacacatctccgtaacatgatcattgtccctgagatgattggaagcattgttggggtctacaacggcaagaccttcaaccaggttgagatcaagcctgagatgatcggccactaccttgctgagttttccatctactacaagccggtcaagcacggtaggcccggtatcggtgccacccactcctctcgttatattcctctgaaatgagctgttacccggctttgtagtcatccaagagttcggtggcgatgttcattcagctcatctacttgttttgaacaagttaaatg

SEQ ID NO: 1564 - DNA, 365 bp, Zea mays
  Clone ID: LIB3227-024-P1-K1-A5
aaatacccgggcggaccaacccttccggcttgcccttcaattggccttccactagtaacaggaatactctgcaacttcactcgggacgagttctgccttgatcctgttcctggcatggttctagaggagctgaattctgagagcttgctggatcgatccacagacagagacatggtgagcacgttcccagtgcccgctgctccagtggtgtactggccccctacgctggaggacgttagggagaaagtggctgacacggcatgtggcaacccagagctggaccggaagggttcaatggtgcagaggaggggctacaccagcgatgacgatctggatgcccttgaagtcccgcttgcgtccctgta

SEQ ID NO: 1565 - DNA, 346 bp, Zea mays
  Clone ID: LIB3227-024-P1-K1-A6
ctcgtacagagaaggaaaaatatccccaaaccctagctcccgatctcgatggcgggcgctggcgtcttctttgacatgaccgccggcggcgccctggcggaccggatcgtgatggagctgtacgccaactaggtgcccaagaccgcggagaactcccgcgcgctgtgcacgtgcgagaagggcgtgtgcaagtcctggaagccgctccactacaagggctgcacctgtcaccgcgtcatcccccagttcatgtgccagggcggctactttacccgcggcaacggcacccgccgcgagttcatctacggcgagaagtgactcgacgagaagttcgtgcgcaagcaca

SEQ ID NO: 1566 - DNA, 249 bp, Zea mays
  Clone ID: LIB3227-024-P1-K1-A7
gcgcggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatcccgcaacgctgtgacctacacggagca

SEQ ID NO: 1567 - DNA, 332 bp, Zea mays
  Clone ID: LIB3227-024-P1-K1-A8
gtaccggtctcggccgggtcgcccacgcgtccggcaaagccaacttcttcagactcatgacagttttctcaggcttgtttgcagttagcaaggggttcaacggtgtctgttcatggaggaaccccattaccactgtgctagtgcacattctctttataatgctggtgtgctttcctgagctcatacttccaacagtgttcctgtacatgttccttatagggatttggaactttcgctatcgacctcgttatccttcacacatgaataccaagatctctcatgcggaggctgttcattctgatgaacttgacgaggagttcgatacattccct

SEQ ID NO: 1568 - DNA, 235 bp, Zea mays
  unsure (1)..(235): unsure at all n locations; Clone ID: LIB3227-024-P1-K1-A9
acaaaccattcanacccatccttacatattaagccacagacaaccaagggggagtgggcacccatctttattcnagccaaccacggcctgaccagcattgtgcagaacaacaaaatggagaggggccagcactctaaggagctcagacacacctcagggaaccttgacgtgaacaggaaagcggatgggaacacccgatacacagacgcatgtgctgagccatgaatcaggcccg

SEQ ID NO: 1569 - DNA, 220 bp, Zea mays
  Clone ID: LIB3227-024-P1-K1-B1
aacgaggagtcaggcctgtcctcacatatttagctacagacgtggaatcgtgatgtcgcacccatctttattcttgaaaatcatgagctggcgagcattgtgctggattacaaaagggagtgtggccgggatagtgtgctgcaatcacacacctctgtgcacacggattgcaacagtgagtctggagaaacaaccttgcactgtgagcatgtgctgagcc

SEQ ID NO: 1570 - DNA, 400 bp, Zea mays
  Clone ID: LIB3227-024-P1-K1-B10
gatgaaatgctcaagactggcaggctttctgaaccgtacaagggtattgggggctgctttggccggacaatcagagatgagggttttgtctcactgtggagaggaaacacagctaatgtcatccgttacttccccacacaggcattgaactttgcgttcaaggatcacttcaagcgcatgttcaactttaagaaggacaaggatgggtactggaagtggtttgctggaaatctggcttctggtggagctgctggtgcttgctctctattctttgtctattctctggactacgcccgtacgcgtttggccaatgatgccaaggctgcaaagaagggtggtgagaggcagttcaatggactcgttgatgtttaccgcaagacccttgccagtgatggtattc

SEQ ID NO: 1571 - DNA, 283 bp, Zea mays
  Clone ID: LIB3227-024-P1-K1-B11
cgcaacgaccaggagctcgggaagctgctgaccggcgtgaccatcgcccgggtgttggtgttgcccaatatcaacccggtcctgctgcccaagaagacggcggagaaggcgtccagcggcgggagcaaggaggccaagtcgcccaagaaggccgtcaagtcccccaagaaggcatagggtttggaggcggatccaatgttgtcatgtgtacgctgtaagcgggcaatgtgattggctatgtattctgtttgctcaagatgctttatggcattcctaaaggaat

SEQ ID NO: 1572 - DNA, 176 bp, Zea mays
  Clone ID: LIB3227-024-P1-K1-B12
gacccacgcgtccgaaaaaaaaaaaaaaaaaaaaaaaaaaaaaaaaaccccaaaaaaaaacaacaacaacgtaaaaaaaaaaaaatatcaacccccaaccacaaaaccaaaaccacccacacacaaccaaacccacaccccccccccactaaacccaccccgaaaaccaccccccc

SEQ ID NO: 1573 - DNA, 326 bp, Zea mays
  unsure (1)..(326): unsure at all n locations; Clone ID: LIB3227-024-P1-K1-B2
gaacaagactccagagcagactatacgggggatggagcgcaaatatatgaagaccgnanagccacaccagggggcaagagaggagaggtacagggagacgctggagaagaaggcggaggagcagggcgcacagtttgtgtccttcgacgctagaaagggagagtggaagctcagggagaagcacttcagcgcctacgggcttaggagaaaacctggggagataagtagcttgaaaggactgatggaacaacactttacgctcgtggcaattaccatgcttggatcaagagcgatgctaatggacaaagttgctgctggtaaaaagc

SEQ ID NO: 1574 - DNA, 231 bp, Zea mays
  Clone ID: LIB3227-024-P1-K1-B4
attgatttaaggacaaaagcacgtggggtgttgcaaagggaggacgatctaagtgagggcgtgcaacttgttggtaaagatgccctggcagaatctgacaagatcacattgtggacagcaaacctactgagagatgattattaggcacagaatgcatttactgcatatgataagtatctgaccgatctacatatacgttgggatgatgcgcaagattattcacttcatcac

SEQ ID NO: 1575 - DNA, 412 bp, Zea mays
  unsure (1)..(412): unsure at all n locations; Clone ID: LIB3227-024-P1-K1-B5
gggatttgcatggagatgaacagcaaagttgtgttgcccaactgcacccatgctgtgtgtatcagatgttaccaggactggagttcaagatcgcagtcctgcccattctgccgtgacaacctgaagaagacctgtcctagtgacctgtggatatatgttgaggaccaagatgtggtcgacatggagacggtgtcgagcgagaacctcagacggctgttcatgtacataagcaagctgcctctgattgtcccagacgtcatcttcagcgtgtatgattcccacatcaaatgatttccgacgcgaccttctcgacgaccttcagccagtgcccagctccagttaatcttatgcccncatgtcctncattttcatgctttgctcaagcttttggaagtgcctgaactgatttgga

SEQ ID NO: 1576 - DNA, 238 bp, Zea mays
  Clone ID: LIB3227-024-P1-K1-B6
ggacgacaaggggcagttgataggaaaagcactcttcgatagaagatttgcaagctcctcaaagacattcctgcagtcaagattggcatacatctccaccataattttttttcctggcgacaaaagtctacaagagcttccattgcaacctcctgctgatgatatgttgctccaaaacgaggttgtgcaagccttataattatacaagaaaaaaggcctcaaactgcagcttcagctc

SEQ ID NO: 1577 - DNA, 391 bp, Zea mays
  Clone ID: LIB3227-024-P1-K1-B7
aacgaggagtcaggcctgtcctcacatatttagctacagacgtggattcttgagagcgcacccatctctattcttgagaatcatgagctggcgagcattgtgctggattacaaaagggagtgtggccgggatagtgtgctgcaatcacacacctctgtgcacacggattgcaacagtgagtctggagaaacaaccttgcactgtgagcatgtgctgagccttgaatcaggcccgaccatggtgaaggcccggaccatgtggaggcctaagggaaccaaggcccaagaaacagtggttccatcttcaatttgaattgtgtgagacgttcgggatggtgattttggcaagcaactactactattttggcaaaagatcagaatggttactagcg

SEQ ID NO: 1578 - DNA, 247 bp, Zea mays
  Clone ID: LIB3227-024-P1-K1-B9
ctttcatattattgggcatgccgtttgattcaccagaggctcaacagttgaatgaggatatattcgaaactatctactatcatgctctgaaagcttctgctgaactcgctgctaaagaaggtccctatgaaacttatgaagggagccctgtcagcaagggcattctccaacctgacatgtgggatgtagtgccatctaacagatggaactggccatctctaagggagaccatttcaaaagttgggat

SEQ ID NO: 1579 - DNA, 139 bp, Zea mays
  Clone ID: LIB3227-024-P1-K1-C1
ggaggcctttccgtgctctcttggatgttggccttatcaggactacaacagggaaccgtgtctttggtgccctcaaaggagcattggatggaagcctggatttttcttacaacgaggagaaggttgcttgaatcaaaaa

SEQ ID NO: 1580 - DNA, 413 bp, Zea mays
  Clone ID: LIB3227-024-P1-K1-C10
tgaagcaacataaatgtcctttttaacaggaggttgtgtgacgtgatggagctgttgtcctggaagcttcccaagtgcccccaattgtacatatacagctccgccgacagggtgatcccagcgaaatcagtggaggcattcatcgacggccagcggaaagccgggcatgaggtgagggcctgcgacttcgtgtcatcgccccatgtggaccattaccggagcaatcctgggctgtatagctctcagctggccaacttcttggaggattgtgtgcttgccaagcgctgtgagggtgcttgcacatcatgattgtctcttttattttgtcctgggcttgaattggaatgcaccagggacactgacatacgtgggttaaacatgattttgttctctccttggttaacgggctttgt

SEQ ID NO: 1581 - DNA, 310 bp, Zea mays
  Clone ID: LIB3227-024-P1-K1-C11
ggtgacctgatgcgccctttgcccacggcttgttctggaatacatcttttgaaggggcatggcagactagttttactcgacaacgtgacatacgtactgaccctagattgttatgctttgggcgttcttcatttgaagtgtctaatctgcaagtctctatctagctagggaacagaattttacagcgtgccgtacagagtaccgagtttaggcaccaaagtctttccacgttgttcagtgaaagcccttcacttggatttgcatacaatcctttcttgggtaaagatatccagtgtgtatttgtgtgctt

SEQ ID NO: 1582 - DNA, 417 bp, Zea mays
  Clone ID: LIB3227-024-P1-K1-C12
aagatgaggtttgtctacgcccatttttccatcaacgcgtccatcaccaactcgggcaccgccatcgagataaggaacttcctcggcgagaagaaggtcagaaaggtggacatgcttgacggcgtgaccatcctccgctccgagaaggtcaaggacgagcttattctcgatggcaacgacgtcgagttagtctctcgctccgccgccctcatcaaccagaaatgccatgtcaagaagaaggatatcaggaagtttttggatggtatctatgtgagcgacaagggtgtgatcgaagaggagcagtgagggacaattagttgttatcgtttgagttggaattattgtttggtttgcaattttctcaaggtgaactttgtaatcggttaggatgtgttgtggaccattatcttatcctac

SEQ ID NO: 1583 - DNA, 324 bp, Zea mays
  unsure (1)..(324): unsure at all n locations; Clone ID: LIB3227-024-P1-K1-C2
tacggccccgaccaagatccaatccatgaggaagtttgtcgccgagcacaaacaccgggccgtaggaagcctttgatgatgcggcaccaccaacncgaccgcctacaactggacacggcccaatatgaagcctagcgtcaagatcatccacgcaaggttgcatgctcaagctctaaccctggctgcattagttggttctgcatgcgcggacgactatgaccagaagtatggnccttctgagccaaacgtggacaaaaacacaagccaatacctggcccatacgcataaagataaaaggacgccatgaagataaccgcacacccg

SEQ ID NO: 1584 - DNA, 421 bp, Zea mays
  Clone ID: LIB3227-024-P1-K1-C3
ggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttc

SEQ ID NO: 1585 - DNA, 394 bp, Zea mays
  Clone ID: LIB3227-024-P1-K1-C4
cccaagaattaactggcttttccaatctgggcacaagcgttgtgaggttccttgttttaacttttgcagccaaaaggttccggggcctgcttggcaggggcacaattcacaacaggaccaggccgtcaaggagggccacttgaaagcgcaacaagaccttgtccttccgccgttacggttgagcacacacatttggaattctggatgttctgttaccgtggaacccgccccatgcaggctctgatagtattgggtatttttgttgcattgttaaattttgctacccgtgttcctttcgagcccctttgaactgtgttgtcagtgtaccgtggagcaagtgtcgccgacttatatttgtggggtctcagtcaatgaaaatgattgtttgtagttt

SEQ ID NO: 1586 - DNA, 378 bp, Zea mays
  Clone ID: LIB3227-024-P1-K1-C5
gcaagagaaggaggatgcgacggagggcggcgccaccgctgacaccgccgcgccggcggtggacgtcgaggcttccctggccgacgacgtcgaggagccagcagagcctgcggcgacgttcgaggtgctgcaggaggtgaagtccgaggacaggctgagcaccggcagcggcgggagcgcggtggtggacgcggacgcgctgctgtacggcaggttcgccgcggcagttgatagcagcgtggagtcgtacttccccggcggcgaggaccactaccacgactgcgggacgatgggccccgtgaatcatggcgccggaggaggcatccagtcggacgacgacggcgccggcagcgacgaggggtgcagctactacgccga

SEQ ID NO: 1587 - DNA, 306 bp, Zea mays
  unsure (1)..(306): unsure at all n locations; Clone ID: LIB3227-024-P1-K1-C6
caaaagccggttcgggcccaaccaaaaccccttaatccccgcccgggccttcgacctccgcaggtacaaggagctccggaaagcctgcggcgtggcggcggccccgccgccgtttcaggcccggaccccttgcccggcccccggcgcgcctcgggagacccggcatngccactcctactgtcatngccattgatcttggcctcgctcggttcattcctttctttatttttttttttgatggtcatgccccattcggtgggggatgatgattcctgtatccatctgatgcgcgcgcggatgcaaaaa

SEQ ID NO: 1588 - DNA, 319 bp, Zea mays
  Clone ID: LIB3227-024-P1-K1-C7
atcctggggctggaggccatgatccgcgtgcagtgccacaagcgcaaccacccgtcggcgcggctgatgacagcgctccgcgagctcgacctggacgtgtaccacgccagcgtgtccgtcgtcaaggacctcatgatccagcaggtcgccgtcaagatggccagccgcgtgtacacgcaggaccagctcagcgccgcgctctacagccgcctcgcggagcccgggtctgccatgggcaggtaatgaaggaggagagctgctcagctcggctcgcctgtggctgccggattaggggacgacactgatactactgctactc

SEQ ID NO: 1589 - DNA, 422 bp, Zea mays
  Clone ID: LIB3227-024-P1-K1-C9
cccagttttcgcagccaccacctccaaacatgccccaactgcaggcaccagctgggatgctttcacattcacaaggatctcggcctactcttccccagcttccaccaatgggtggaccatcagtgccatcacaagtgaacccaccgcttccgcctatgcctcacccaacggcaatgcatggttcacagagtcagatgatgccccaaatgccacagcacatgatgggcctaaatcagatgcatgctggttctgtgcctcctggtactgtacccccaatgggtgggttcccaagtgggatgggaaacatccaaggagcatcaggttcgtctggcgtacaaaattttcctatgggtggcatgtataatcggcctcagggacaaatggctccacaagggcaaatgacatccattcctggtctaagc

SEQ ID NO: 1590 - DNA, 421 bp, Zea mays
  Clone ID: LIB3227-024-P1-K1-D1
catggagactgacgattttattgaggaaagcagaaacaaaaatgaaaatatattccaggaagggcttctgttttcttcacagaatgatgcagagtttcatggcattacatctgacgtgctgactgtttcaaagaattccctcttactggatcatgaaacttgcaagatggtagagactaacactaccattttctcggatcatctggaactgctgaatgaaaagcacagcgaaggcgtggaatctacaagaaacatgatgagtgattgtcttgaaaaggattacatggctaatagtccggttcgaaaccatccacgggaactactgaccagtgcaaacagcttggaatcaattgacaaactaagagcttctctgccagatctggtggcaaagttcaggctcgagaacaagttgaatgaaatg

SEQ ID NO: 1591 - DNA, 417 bp, Zea mays
  Clone ID: LIB3227-024-P1-K1-D10
agcgaactcgggactcgccaaccgagaaggaagaactagtcgcgaggtgaagaggagaacctgaggtggtcccgaatcagagacggaagaaggtgggttcaggagcaagccagcctgccgccgccatgaggcgcacctcgaagaaatcgtcgtcgtctacggcgaccgccagcgctggccctactaaagcagtttccaaggaagtagaacggattgatcaatttttctatacttacgctgataactcatctggcatgattgacccagaaggcattgaaacactctgttctcaccttgaagttccccacactgatgttaggattctaatgttagcatggaaaatgggctgtgataagcaaggttattttaccttggatgaatggagaactggcttgaaagctcttcgagctgacagta

SEQ ID NO: 1592 - DNA, 410 bp, Zea mays
  unsure (1)..(410): unsure at all n locations; Clone ID: LIB3227-024-P1-K1-D11
cgacaacancgaacacggnnccaacgtcgctcttcctttccagagtccaccagccctcggtgccgttggctccggaccgtttcactagcacaaaccacannatttgattttnngacccgtcgcctgccctggcccgcnnctcctagtcgtaaagcccgcnncccgccgccttccccctcgctcggcccttctccgcttccgcgcggaccgccatggtgagtgagctcttcccttcccgtcccaaccctcgctcgatctacaacatcctaccctatcccccccctccccaccggatctgacggtgggctgcgtggcagtcggtgacgctgcacactaacctaggcgacattaagtgcgaggtgttctgcgaccaggtgccgcgcacggcggagaactttctggcgctctgt

SEQ ID NO: 1593 - DNA, 408 bp, Zea mays
  Clone ID: LIB3227-024-P1-K1-D12
gaacgtggagaggtccttcgcgcagcagcactacgctgacctttccgacaagccgttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcagaaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctc

SEQ ID NO: 1594 - DNA, 273 bp, Zea mays
  Clone ID: LIB3227-024-P1-K1-D3
cagcaagcaggagtatagacatgtagcgttgcacttgcactgccctcccagctggtttggtttggtttcgttttggttttggttgggttttcacaggcaccgcgcgcgcgccggcgatcgagatggccgactggggccccgtggtggtggcggtggtgctgttcgtgctgctgtcgccgggcctgctgctgcagctgccggccaagggcgggcgcttcgtggagttcggcaacttccagaccagcggcgcctccatcttcgtccacgccatca

SEQ ID NO: 1595 - DNA, 356 bp, Zea mays
  Clone ID: LIB3227-024-P1-K1-D4
ccttccgttcgatttggtgagggccacttttgcccctggaccaaccaacctgggaggtggttcaggtgaaaaatttattaaggtcctgcccaacaaaagaagaaatggaccttttaaggaattacaccggaaacaaacaaaatcttgggaaatgtgaccagttcttcttagaattgatgaaagtgcctagaatggagtcaaaactgcgagtattctccttcaagatccagtttggttcacaagttgctgatcttagaagaagcttgaatatcatcgactcttcatgtaatgagatccgaacttctctcaagttgaaagaaataatgaagaaaatccttctccttgggaataccctg

SEQ ID NO: 1596 - DNA, 325 bp, Zea mays
  Clone ID: LIB3227-024-P1-K1-D6
cccacgcgtccgaaaaaaaaaaaaaaataaaaaaaaaaaaaaaaaaaaaaaaaagtttaggaaaaaaaaaaaattaaaaaaaaaaaaaaaaaaaaaaaaaaaaaaaaaaaaaaaaaaaaaaaaaaaaaaaaaaaaggggggctccttttaaaaaaatcaaattttacaaaatctttcttgaaaagaaaaaattttaaaaaaggtaaaaaaaaaaaaaatacacggcccaggattaaaaaactcatgaattgaaaaaacccgggcaaaccaaaaaaaaataccttttaaaaaaacccccttttccaaagttgggataaaacaaaaa

SEQ ID NO: 1597 - DNA, 134 bp, Zea mays
  Clone ID: LIB3227-024-P1-K1-D7
gagcaacaaagcctgccagcatggctttcaaaatctggccacacacatatgtggggcgacaaaatgtttttttatcacaaccacaacaaccaacggagtgcaagcaccagtaaaatgctctcgcaatgacagat

SEQ ID NO: 1598 - DNA, 382 bp, Zea mays
  Clone ID: LIB3227-024-P1-K1-D8
gaggaagaaagcaagccagcaaggaagtcaggatctggtcgcaccataaggcggacagaagtgtttatggaaatgcgaacaaccagcggagtgcaagcagcagtagaatggcctgttgatgttggttgatgcagtattttccattgagctgcctagaggttatgtgtgcgcaggccagatgttggtgttgatatctcaagtgtggtttttattagtaggcggtgagggtgttgtctggagcactttggtgctgcgttggtggatggatattggtttgcaacttgtctgctagtgtcttggggattcaactacgtgcaatcggatgatattatatggttgtaattatctttgcactcggcctataacggctctttatttgcac

SEQ ID NO: 1599 - DNA, 359 bp, Zea mays
  Clone ID: LIB3227-024-P1-K1-D9
gtgctctgacagtgagatggcgagcgtgaaggttttcgggtcacccaccgggggggaggtcgcccgtgtgctcatgtgcctcttcgagaaggaggtggagttccagctgatccgcgtcgacgcctaccgcggcaccaagcgcatgccccagtacctcaagctgcagccgcaaggcgaggcgctcaccttcgaggacgagagcctcaccctctccgactccagggggatcctccgccacatctcccacaagtacgcgaagcagggcaacccgtacctgattggcacgggcgcgctggagcgggcgtccatcgagcagtggctgcagacggaggcgcagagctttgacgcgcccagcgccg

SEQ ID NO: 1600 - DNA, 413 bp, Zea mays
  Clone ID: LIB3227-024-P1-K1-E1
gaaggtctgaagcaacaatataatggagaggaagaccaaaatggtgggagcaatgcaactactggaggtgctcggaaaaaaaagggtgggcatgtaagacaatcaagtgctactcatgatgccattgataaaaattatagtggcagttcagctgaaggtttaaggaacaagagacagaagtctgctgttcaaagcgcttcggtaggcagaagggaagggttgaggcaacgatctgatgccaagcaacatccagatgcagccgagggcagtacagaaccactcgctgatgtacctggaagcgatggtgcagctcaaggttcaatgcaacatggaacttcggctcctcataccgaaataaaagcgatggtcaggaacatactgttcaaggacatcgttgacaaggagcacgatgc

SEQ ID NO: 1601 - DNA, 389 bp, Zea mays
  Clone ID: LIB3227-024-P1-K1-E10
attccatgtgatctttagaacggccatcagtctctgcaattgtggctgagctaaacagaattccatgaatcacaagacaagactagcgaatggaacgatcagactactgcattgcattgcgcgagcgcgacaaggagacacagaatacagcgccggagcaacaccactccggccaccaccacccccaaacgtaaggtagagaaatactacgaaccactgacacaccgccggccaccgccgccgaaactgcctccactcggactcctgcccctacacgctccccaggattagacagcaacacacgaactgagacgaaacccacaccaaacagacaagagctggaacacaagggcaaaatgttagcttgcgccagctcgccggcgccccct

SEQ ID NO: 1602 - DNA, 250 bp, Zea mays
  Clone ID: LIB3227-024-P1-K1-E12
tgaaaactctagaaggatggatggatgatgacacctagcttccggctgctgttggtcatcctcttgtgtttttgctagtagcctggtaattagcaggattaagcagccgtcaagcgtcacccccgttgttgttaattaagtacctattgttgtgagctgtgacgacgatggatcgaccgatgttttagcgttggttgaatccaaagctgtatataggatgtatgtattattacagcaggaattcgcttgc

SEQ ID NO: 1603 - DNA, 294 bp, Zea mays
  Clone ID: LIB3227-024-P1-K1-E2
caaagaagctgacatccaagtcaaagttaccggttagcagtgacagcagcaagctgagcgctgcgaactcactgtctgaatgactatgaacaaaaactgcagagtgctaacgtccctctaattttgttatttccatcatttgattatgggggtgaatgctcacggttgctccgtgggctgaagttgtggttggcattcaactgccttgagttttggaggcttttggactgccttgccagcatgagccttctggaagaggcaccctggcatctgcgtgccattttccatttgttc

SEQ ID NO: 1604 - DNA, 373 bp, Zea mays
  unsure (1)..(373): unsure at all n locations; Clone ID: LIB3227-024-P1-K1-E6
ctcgagtccaagatcatcctcgatcgttagacacagaggtcccgcggctncggggttggcaccttctctacttaggaggccatgccgaacgccatcgagggcatgaacagcaaggagctggacggccgcaacatcaccgtcaacgaggcccagtcccgcggctatcgtggaggcgaccgctgcggccgatacggtggtcgacgtggaggcggccgctacggcgatggctggcgccatgatagcggcgacggctacagcggtggcggcggctaccgtgatggctgcggcggctacggtggtggtggccgcgtctacatgagcaacaaccgtggcggcgggtaccgcaactccaactggaactggaggaactgag

SEQ ID NO: 1605 - DNA, 386 bp, Zea mays
  Clone ID: LIB3227-024-P1-K1-E8
ctagcccgtcacctcgacgcctagcccgccaccttgccgctcgtcgctgcaggtgtatggcgcctgtgtgatcggatcagcagtccgctccgtctccctcggcccacgcatctgatgttcctctcccgcatcgtactccgcgacctggattccatcgactctccggcctccatggcgtcctcgaagaaggttgtgacccgtgacgagtgggagctgaagctccgcgacgtcaagatccgcaaggaggacatgaaccgcctcgtcatgaacttcctcgtcaccgagggcttcgtcgacgccgccgacaagtttcgcatcgagtccggcacccagccggagattgacctagcgaccatcactgatcgaatggaggttaagagagcagt

SEQ ID NO: 1606 - DNA, 419 bp, Zea mays
  Clone ID: LIB3227-024-P1-K1-E9
cccacgcgtccggttgaaggcgcacttgcacacccttacttggcatcacttgatgacataagtgatgatccaggctgctcaatgcccttcagctttgacttcgagcagcatgcattgtctgaagaacaaatgaaggatcttatctaccaagaggctcttgcattcaaccctgattatcagtagccaaagttcaatttcagccggtgattggcttcattgacatggagattttttccccacctgatgtcagtgcaaaaagtcaccaactccgattgctagctgtaaataactgccttacctgaagatactccattcctctgattaaaagctggtgacggtgtcattaagggtagaaaagaacgagcttgtgaaggtcaaatttctgcgaagccatggatttctgtgcttacaatatgttg

SEQ ID NO: 1607 - DNA, 390 bp, Zea mays
  Clone ID: LIB3227-024-P1-K1-F10
agaacatcctcgggagatctgtgctccgatactggccaccatctaggatgagcaggtacaatatatcatcatgacatggtgcagcacacagctgttgcatcctgataatacattgtggcaataccacgtggtgcacgccaatttctcctttccctgcatagctttattgacaattgatatgcttagccgtggggttctttatttatttgttgtagccttgcctcaaatgtcgattgggcagcttggctgacagattagtttttttttccctccctacgggcagatgcttgtttaaagacagcaattcttgtactccgtagctaagaatgaatgccatataaatgttgcagtagataagcatcaaggagtgtaggatgaggatggcaaaaa

SEQ ID NO: 1608 - DNA, 376 bp, Zea mays
  Clone ID: LIB3227-024-P1-K1-F11
ggcatacgcaaccttgtctcagggactaaaggtcattgcatgtgttggtgagggacttgagcagaggtaggctgggtctaccatggaggttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaacgtcagccctgaggttgctgaatctactaggatcatttacggaggctctgtaactgccgcgaactgcaaagagctagcagcacagcctgatgtcgatgggtttcttgtcggtggagcttctttgaag

SEQ ID NO: 1609 - DNA, 401 bp, Zea mays
  Clone ID: LIB3227-024-P1-K1-F12
gaattgcccggcaccgtcaaggagattctcggtacctgcgtcagcgtcgggtgcgccgtctactgcattgaccccaaggacctgcagcaggagattgacgacggcgaggtggagatcccgtacgcttaagaaggattggtgtccaggactgtgttatctttgctgctgaagccattttctctgcctagattttctcatatttatttgaggtgggggtggacgtggacgtggaactatggaagttatcacagcggagttttgcttagaaactttgacatgctttaagtctgagacaattttatgaacattcctaggtacaatcgaagttaccagtgcctgagttttgttggaatttttcatgcgatgtctaaaatatgactatattgcatggccaattggtt

SEQ ID NO: 1610 - DNA, 403 bp, Zea mays
  unsure (1)..(403): unsure at all n locations; Clone ID: LIB3227-024-P1-K1-F3
gccccaatctcgccgtcaccacctcaatccagcaaacgcaaaccccatctcgccgccggcgcgatgtctcgccgctatgacagccgcacgacgatcttctcgccggaggggcgtctctaccaggtggagtacgcgatggaggcgatcggcaacgccgggtcagccctcgggatcctagcggccgacggcgtggtcctcgtcggcgagaagaaggtgacctccaagctcctccagacctcgcgctccgccgagaagatgtacaagatcgactcccacctggcgtgcgccgtggccgggatcatgtccgacgccaacatnctcatcaacaccgnccgcctncacgcccaacgctacgcgctcttctaccaggaacccatccccgtcgagcagctcgtccagtccc

SEQ ID NO: 1611 - DNA, 404 bp, Zea mays
  Clone ID: LIB3227-024-P1-K1-F4
caaggggcttgacgtgattcagcaagctcagtctggaactggaaaaacagctaccttgtgttctggaatcttgcagcaacttgattatggattggttgaatgccaggcattggttcttgctccaacccgtgagcttgctcagcaaattgagaaggttatgcgtgctcttggggactatttgggtgtcaaagtgcatgcctgtgttggtggaacatctgttcgtgaggaccaaaggattcttgccagtggtgtgcatgttgttgtgggcacaccaggacgtgtgtttgatatgttgcgcaggcagtctctccgtcccgacaacatcaagatgtttgtgttggatgaggctgatgagatgctctcccgtggattcaaggatcagatctatgatatcttccagcttc

SEQ ID NO: 1612 - DNA, 422 bp, Zea mays
  Clone ID: LIB3227-024-P1-K1-F6
gtgaattggttacaaattctagtccagttactgttgaccccagccacttccatggcacccttcatagagcgaaaactcaaaatgatcaaaattcttggagtgcacctggtggggagaagtttatgatcagagggaagacttacttaacagattatcacaaggaagctgacaagatgtggtcttttgagatgggttaagaaattagtgaacgaattgcctagctggaaggcttctctcaatcttgctggaaggactgctatggttgttggcggtgatccacttctagagctacttgcggtcgattggttcaaagttaatgaacgctttgattcagttgccttacatcccaaaagccttgtgcaatcagaagctgcaaagaaacttcctttcatattggttataaatttgcaggtgccagcgaa

SEQ ID NO: 1613 - DNA, 175 bp, Zea mays
  Clone ID: LIB3227-024-P1-K1-F7
ggggagcggagcggacagacgagacaaatcccctacatttctttgctggtgagtgcataattctagatttacagaaaagacaaagtttactcttttctggatcatatgttttgtgctacttattgctgttctggccgcattgggccagcatgcagttattcacgggttcaacctg

SEQ ID NO: 1614 - DNA, 395 bp, Zea mays
  Clone ID: LIB3227-024-P1-K1-F8
cttatcttggcgttggcggagagtggattggcacacgctttcctttcctttcctgcagacaagctgttatatctcgcctagctcgtcgtcggagaccaaggagaagagcaagggggggcgcagaggcagaggcttgccagcctacctagctcgtcggggccctatggagatccagcaccaccgggggctgggcaactccaaggttgtcaaggtgcagagcgaggaggcgtgggatctgttcaccgatcaagcgagcaacgagggccggcccgttgttgcccatttcggggcgtcatggtgcgtgacgtccctgtccatgaactacaagtttgaggagctggcgcagacccaccccgaggtcttgttcctctacgtggacgtcgacgatgtccaga

SEQ ID NO: 1615 - DNA, 381 bp, Zea mays
  Clone ID: LIB3227-024-P1-K1-F9
cgacgattctgatgaggacgagactgatgattctgatgaggatgagacgggcggttctgatgagggtttgtctcctgaagaaggcgatgatgattcaagtgatgaagatgataccagtgacgatgaggaggaagacactccaactcctaagaagcctgaggtaggcaagaagagagctgctgaaagttccgtgctgaaaactcctctatctgataagaaagcaaaggttgccacaccgtcatctcagaagacaggtggcaagaagggcgccgccgtccatgtggcaactccacacccagcaaaaggcaagaccattgtaaacaatgacaaatcggtcaagtctccaaaatctgcgccaaaatctggtgtcccttgcaaatc

SEQ ID NO: 1616 - DNA, 425 bp, Zea mays
  unsure (1)..(425): unsure at all n locations; Clone ID: LIB3227-024-P1-K1-G1
caaaagggacagtcaagtgcagtgttgtattcacaggagggaaatggttttgagcacatcatgacagagacaaagcttgctgcaggtgatgcttcagacaatatacgtggtggtgatttgccttcacaagtgaatgggggcaacaccaagctgaaaatagaagagcacacttctggtaacaagaggcagaagctagaggatgacacagatatttctcagcctcaatcacagtcaccgccaccgccacccccattccctcatcctgacgcattcgaaccaccaccaccaccaccaccacctgaggttcctccatcaccagagcctagcccaccaccaccgtcaacttcaccgncacccaatatgatccccccgccgccgccggcaatgccaccccaaatgatctcacatgtaccaccttcagctgg

SEQ ID NO: 1617 - DNA, 420 bp, Zea mays
  Clone ID: LIB3227-024-P1-K1-G10
ataaaacggtcccaaaacacaaaagaatccgccacctcgccggcgacaggggcgagctcgcgcgccccgtccggtgctgaccccgacttctccatgcacccattctgctgcgcgcctctcgtgcccgtatcgcccgcggcctctgccgcccccgctgcgtcctccgctgtggcgggcacccaggccgtgatgccgccaccgcagcccccgccgttgccgactccgtcgtctcgaaacaactccgccactggcggtgagaggcgcgcgcgcgcagcggaggtcagcggtggtggaggaggcgattcctcgccgctcgagggggtgaagctgaacgagatcgtcggcggcggcatctcgggaatcatgtacaggtggctgaactacgggcgcgggtggaggccgcgctggttcgctctccac

SEQ ID NO: 1618 - DNA, 395 bp, Zea mays
  Clone ID: LIB3227-024-P1-K1-G11
tggagatttggtattctcaaaacttgctgagcagaggttccctagcgagtgtggagttgcgggaccttgttggcagcagattgcctgggtctccatttgggaggaatccggggaaaaccctgacttgatgatgaccccggaaatcagagctcagaatgccacaatttaatatgttgcttttaaggtattagtagatagtaactatttggtattgatctatcgaggctgcagcttgtctgtaaacacaactttccagcttgtataatggatcaacggatcacctgacatgtgacggtggccgaagtactacgaactctaatgacgttggaacggtaaggatattgtgatggcctgttaggttatgggaggtgtactggttggcattgatctcgatg

SEQ ID NO: 1619 - DNA, 436 bp, Zea mays
  Clone ID: LIB3227-024-P1-K1-G12
gacggtagaccaggacatcaccgacacgtgcaaggacctcggcgaggtcagagaaggtgttccagctggcgctcctttgcagcaagaggcagccgtcggatcgaccgaccatgcacgaggtcgcgcgcgtcctggacagcctcgtctgcccagcaggcccgcccccgaagcaggcgcaggcgcaggcacaggcacaggcgtcggagaagccgtccaccacggcgccgagctatgtcagcgagtacgtcggcctacgaggcggcggcggcggcagcgccctctcctgcaccaactcgtcgagcgcgtccgacgccgagctcttcatgaagtttggcgaggtgatctcgcggagcacggaatagtccaatagatggatcattttgtgttacagtttacaataggtgtctgccgccctgtgatgtgatgtgactcgctg

SEQ ID NO: 1620 - DNA, 206 bp, Zea mays
  Clone ID: LIB3227-024-P1-K1-G2
aaaaaaaaaaaaaaaaaaaaaaaaaaaaaaaataaaaaaacaaaaaaacaaaaaagtttggttttaaaaatattttttatctacccaacaaacaacataactccttatttttcctccccttcattcccttcccccccctccatcttcaccacccctcaattcaactttatcctttcttcaacccaacctaactagccccattcccc

SEQ ID NO: 1621 - DNA, 265 bp, Zea mays
  unsure (1)..(265): unsure at all n locations; Clone ID: LIB3227-024-P1-K1-G3
aaattttgcagcgggagctactactagctagagctagcatgggaggtacaagcgccgaagtccagagccacggcttcgcctgcgcgcccccggcagccgtcattatgaatcggcgcggcggcggcgcgcttcctctagcagcggcggccacaggagcagcccccagcagacactgaggagcgacctgctacccccggctaccgtcgcctgccgagctcgctctcagtctgcttcctcgtctaataactntgggagaggggatgac

SEQ ID NO: 1622 - DNA, 121 bp, Zea mays
  unsure (1)..(121): unsure at all n locations; Clone ID: LIB3227-024-P1-K1-G4
attttagaacacgttaacaaaatattcctttccttatatatcttcaaggnngctggatgatcatcacaaaatactggagacacacactatctaaagccaataccaaaaaaaccaagtttat

SEQ ID NO: 1623 - DNA, 396 bp, Zea mays
  Clone ID: LIB3227-024-P1-K1-G5
ctcgcatccgcagcctctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcgg

SEQ ID NO: 1624 - DNA, 425 bp, Zea mays
  unsure (1)..(425): unsure at all n locations; Clone ID: LIB3227-024-P1-K1-G6
atcacatcgtatttcttcccatccgatcccgccttcgcaaccaaaaccacaacgggcgggttatcgattgctttcaaggcccaaaacaaacccttgctgacaaaaccggctgaggatgagcccgcggtctagaaggcgcccgcacgcaagaagccgatagccgagaatcgggtccccgctggcaagtccgctgccaaggaaggccctgagggcaagaggcgcaagaagaatggcaagaagagcgcggaaacctacaagatctacatcttcaacgtgctgaagcaagtgcacccggacattgccatntcctcccaggccatgtccatcatgaactccttcattaacgatatcttcgagaagctcgcttctgatgccggcaagctcgcgcgctataacaagaagcctaccatcaccttccggagatc

SEQ ID NO: 1625 - DNA, 396 bp, Zea mays
  unsure (1)..(396): unsure at all n locations; Clone ID: LIB3227-024-P1-K1-G7
atctcctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgncaagctcgcgcgctataac

SEQ ID NO: 1626 - DNA, 310 bp, Zea mays
  unsure (1)..(310): unsure at all n locations; Clone ID: LIB3227-024-P1-K1-G8
gcctcagcggaagcgctgggtgcagcataagtacatgatttacaactactgcgctgaccctaagcgctatcaggagggccatcccgccgagtgctacatgcaatatcgcctggttaagcttcgcccgtccaacaatggcgcgcgcgcgcgtgtgtgagcatgtggtccgctctactgataccgatactgacgatcggtgacgatcaccgcatcaaggtaagacgaaaggccttgaaacatggtagataaataaaggacttgacgatctataacgcagtanctggtgcgtgcgtggtgtggtggtaagaaa

SEQ ID NO: 1627 - DNA, 221 bp, Zea mays
  Clone ID: LIB3227-024-P1-K1-G9
acggctcgcaggtgtgcctggccatggcgagtctgtcgtacgaggacgagggcgggtatcattggtaattaccagcagaagaacaagagggtggtgtatgacacgctggggtccaggctaggcttcgctgacgaggactgcaactatgtatagagacttgacagggaagaggatgtggaatatcggatttctagttatatgttgcatgaactatgcccgcc

SEQ ID NO: 1628 - DNA, 415 bp, Zea mays
  Clone ID: LIB3227-024-P1-K1-H1
gttcagaaagcatatctctaaatgaactgaagaggaaggagcccgaccttgatatggaaacaccggcatcttacaaggaaccaaaaaccaatgttggcggtaggtcatcttcacaaagcaatggtcgcggatcacacaagtccaacaagcgtgaaaagctcgacttcaatcatctaagaccgaagaaatgaaaaatggtgttcgagttagctcttgtactctgtttgtagctgtacccaattggccatctgctgtgttttgtcgattatatctagagagctggtaaccatgtccatgtgaccatgtggcatgcattcttagtgagattatgtggtgttaatcatttttctttctattgatgtgttctactcaactactctgctgtaagatgtgaggctctactgtacagcagtga

SEQ ID NO: 1629 - DNA, 276 bp, Zea mays
  Clone ID: LIB3227-024-P1-K1-H11
gaagacactgctgatgagctgcagagtcaaatggagcatgattatgacagggggggcaccataagggataatattatccctcatgcagtttcctggtttactggtgaggctgtgcaaggtgaggattttggtgagttgggctatgatgatgaatatgatgatgatgaagacgatgaccaaccttataaggataaagaagagactgatgactactaacatgatgatgatgaagaaatgcaagcacagcaaggtagtcaggatctggtcgtaaacata

SEQ ID NO: 1630 - DNA, 411 bp, Zea mays
  unsure (1)..(411): unsure at all n locations; Clone ID: LIB3227-024-P1-K1-H2
aagacaatcacccttgaggtggagtcttcggataccattgacaatgtcaaggccaagatccaggacaaggagggcatcccaccggaccagcagcgcctcatcttcgccggcaagcagctggaggatggccgcaccctggcggactacaacatccagaaggagagcaccctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgctggcaagcagctggaggatggtcgcaccctcgcggactacaacatncagaaggagagtacccttcaccttgttctc

SEQ ID NO: 1631 - DNA, 377 bp, Zea mays
  Clone ID: LIB3227-024-P1-K1-H3
aaggtccaggacggtctccactttggctggggcgacaagacgctcgtcttctcttcggcgtggcaatagaagcttgcttgtactattgcctatctgagcactttccagcgtttttaggagcatctggggcaagggctgtaaagagatttctgtcgccgtattgttgacctaccatataagtacactcgtagctaaccttagcgtgctgcctgcctgtaggcttgtgacttgtgaggtctacggtttacctagtttcttagatgaaagtatgttgtgcattgtacacctactgaactacatgtagactgtagagtcgcgggtgtatttaattttgcccttcttttggaggggcagaatcacaatacgcgtgattggat

SEQ ID NO: 1632 - DNA, 359 bp, Zea mays
  Clone ID: LIB3227-024-P1-K1-H4
aaaaaaaaaaaaaaaaaaaaaaaaaaaaaaaaaaaaaaaaaaaaaaaaaaaaaaagagagggaaaaaaaaaaattataaaaaaaaaaaaaaacaaaaaaaaaaaaaaaaaaaaaaaaagaaaaaccaagggggggcttttttaaaagtccaaatttaacccacctttttttgaaagtttataatttttttatagggcacccaaaataaaatcaaggggccctgttttaaaaacgttgtactggaaaaacccctgcctaacccaaattaaatcgtttgggaaaaaatccttttttgcccagtggttgaaaaagaaaaaaggccagaaccattggcttttcaaaaattatgcaaatcttaa

SEQ ID NO: 1633 - DNA, 435 bp, Zea mays
  Clone ID: LIB3227-024-P1-K1-H5
ctctagggcaccattgtacaggacacaagagaatgcatgcagtgagcttggagcccgtatgtctgccatggacagctctagcagaaatgctggcgatatgcttgatcgtctcactctcacttacaacaggacacgccaagcatccatcaccacagagcttactgagattatatctggtgcatcggcccttgaggggtagtgaagagactgcggacttcttccttttgccgtttgtgttcctctcccatgaaggctttttccctcgggagtctcagtttcagctcctttcatttcacttttccttgagaaacttgctctcatgctttgttgcaataatcaggccaacgacaatgatagtgccgtgcacccttggcacattgcagaaagagtgtaaacagctatggttaatgggtggttttcatgaatggtgatgat

SEQ ID NO: 1634 - DNA, 436 bp, Zea mays
  Clone ID: LIB3227-024-P1-K1-H6
cccacgcgtccgaaacagcagccccctgctaagaaaagaaaagagaatccaccagaaagtgccatgccatcagatgaccaaggatcaaatgtgcaaagtgggcacagtggtgctgttactgatgtagaagtcggaggggccagcagggagaaggtcatggcatctatcgagatgaaagtggacagtgacagccgaacagggaaatcaagttcaaatgaaccaaagccatccttttataatgacaactgtacagtttttgtgtcaaatattgacttgaaagcaaatgaggatgatctcaagcgattcttctctgatattggtggtgccacagcaataagattgctgagggacagattcaccaaaaaaatcaaggtggttggcctatgtggactttttagacaacaagcatcttgaggcagctattaagaaaaacaag

SEQ ID NO: 1635 - DNA, 410 bp, Zea mays
  Clone ID: LIB3227-024-P1-K1-H7
gctatgttgtcacttcctttggaggctggaactcctgctaatgtatcaagtacgtcttccctgcaaagtaacggtgtatcttcaaggcacacacctgctgtttcagaatcatcaggtattttgggcactcagccagaacaggatttgcatcatgacctggggccatccatgtcattgttgggtgttccacttcaaagaatgctcccagatgacaggagccaaacagtctgtcagccagatagaggaactgatttgtcagggaacggcgaaactgaatatctagcttgtaccaccagcgatctgtccacccttccactttctggtgaagctgaaactgagaatggtcaagcaagtatgcctgcacaggaaatcacaagtcctcatgcccaacatagtttagctttagcaac

SEQ ID NO: 1636 - DNA, 405 bp, Zea mays
  Clone ID: LIB3227-024-P1-K1-H8
agaaaaggctcctcccgaccgcaacgcccctcatctccctcgaccccgacgtcggggacccgatggcgcccaaggcggagaagaagccagcggagaagaagccggcggccgaggagaaggcggagaagacgaccgcagggaagaagcccaaggccgagaagcggctgcccgcgtccaagtcctccggcaaggagggcggcgagaagaaggggaagaagaaggccaagaagagcgtggagacctacaagatctacatcttcaaggtgctgaagcaggtgcaccccgacatcggcatatcctccaaggccatgtccatcatgaacttcttcatcaacgacatctttgagaagctggccggcgaggccgccaagctggcgcggtacaacaaggaagcccaccattacg

SEQ ID NO: 1637 - DNA, 416 bp, Zea mays
  Clone ID: LIB3227-024-P1-K1-H9
gtcaggaatgtatttaggtgaaattgtaaggagggtgctccttaaaatatcattgcagtccgccatttttggtgatattgaccacactaagcttcaaacccatttccttctgcggactccacatatttcagcaatgcaccatgacgaaacatctgatctgaagattgtggccgaaaattttgaagaaaacctagagattacaggcacatccttggaggctcgtaagctggtcgttgaaatctgtgacattgtggcgacaagagcagcccggctggctgctgcggggcttgcagggatcctcatgaagatcgggagaaatcacagcgtcgaggaccaacggtcagtcatcgccatcgacggaggactgttcgagcactacaccaaaattcgcccgtgcttggagaccacactgggtg

SEQ ID NO: 1638 - DNA, 410 bp, Zea mays
  Clone ID: LIB3227-025-P1-K1-A10
gtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggcccgtgtgtgctatgaagttcg

SEQ ID NO: 1639 - DNA, 408 bp, Zea mays
  Clone ID: LIB3227-025-P1-K1-A11
ctgttgcatttagccctgacggcgagtacttagcgagtgggtccctggatcagtgcctacacatctggtctgtgaaagaaggcagggtcctgaagacctacagaggtactgggggcatattcgaagtgtgctggaacatagaaggcaccaagattgctgcctgtttctccaacaacaccgtctgcgtcatggatttccggatgtagcccaaccagtaggggtagcgacgtagtgcagatcaagcctaaaacaagtctggatcacaagcccttcccatggaaacgtgtgaagagagcggaattgttagcagaatgcagatcttaggtggtggtttttttttttgcccatgtacagttcttttttcctaggttatactgtagcgatgcattagtagcatggaaatgtttt

SEQ ID NO: 1640 - DNA, 411 bp, Zea mays
  Clone ID: LIB3227-025-P1-K1-A12
tgaatctagagcagctactcaaggaaataagatggggaaatcactattaatcgatgacggagcgcttccctggattgtaaaaaatgctaacaacgaagctgccccaattaggcggcacatcgagcttgcactgtgtcatttggcacaacatgaagtaaattcaaaagacattatcaatgaaggtgccctatgggagcttgttcggatctcaagggactgttctcgagaagatataaggaatttggcataccggacattgacatccagccccactcttgaagcagagatgaggagattaggaataaaaatgtgataacagaacagagtgcagctggggctcacactatgaagttccatttctcgtgcacatacagaggtgtccgttgctatgggcgctggtaatcaagcaca

SEQ ID NO: 1641 - DNA, 117 bp, Zea mays
  Clone ID: LIB3227-025-P1-K1-A2
ctagctgttccaggcacgagattcttccggatttgtttccttgtaataattccccttgatgagcgtgtgtttggtatgtttctactacggagcactgtatgcatgcagttcaatcta

SEQ ID NO: 1642 - DNA, 438 bp, Zea mays
  Clone ID: LIB3227-025-P1-K1-A3
gcgagaagccgacattttctatgtgccattcttcacgacaatcagttatttcttgctggagaaacaagaatgcaaggcactttatagggtctgggagcatctcttaaggaagctttgaaatgggtcacagatcagcctgcttggcaacgttcagaaggcagggatcatgtcattcctgttcatcatccatggtcatttaagtcagtccggagatctgtcaagaaagcaatatggcttctacctgatatggactccaccgggaactggtataaacctggacaagtatatctagaaaaggatgtcatccttccatatgttccaaacgttgatctttgtgatcacaagtgtgtattagaaactcaatccaaaaggagtatattgctgttctttcgaggaagactgaagagaaatgctggaggaaagatccgcagtaaactt

SEQ ID NO: 1643 - DNA, 414 bp, Zea mays
  Clone ID: LIB3227-025-P1-K1-A5
ctattttctatgtgaaacaggaagcattgctacaggtgatttaaacttcacatcagctgaaccagcaccccaaccaactgaacatgttagcactattgatattgatgctcatgattctcaccttaaccctttccttgcaaatgtggatgatcacatgacatctagtggacccatagacatagatgagatagaaacaccatcttcatcttgctctaaaaattttgaaaataggattgggaagaaaagaaagctcagtattgctggagttttacaaaactatgtggacattagggcaaatgaaacaaaaatatttatgaatgaactcaatgagacaactaaggaagcagatgactattctatcaagcggtgtctagatcttttagaatcaattgaagaactttcagatgaggaaaa

SEQ ID NO: 1644 - DNA, 418 bp, Zea mays
  Clone ID: LIB3227-025-P1-K1-A6
agccaatgaatcagagacctaggtatcagatcttgggtatttttctgttgattcagttgtgtattcttggagctgaaagactccgaagaagtaatatatcgtcaatagctagttccattaatcaaatatcatctggaggctatccatcgactacaggtcggggcatccctgttctaaatgaagatggaaatatcatcagtgacatccgcagtggtaaagctgcagatatagcttctcattcagagacctccaatggcaagagcaaatgcaccctttgtctcagcatccggcaaaatcctactgccacaacctgtggacatgttttctgctggaattgcataatggagtggtgcaatgagaagcctgagtgccccctatgcagaactccgattacccattcgagtttgatttgtatata

SEQ ID NO: 1645 - DNA, 432 bp, Zea mays
  Clone ID: LIB3227-025-P1-K1-A7
gggattcaccaaagaggaggagggactccccaaggaggagggataggtcaaaatcaaggtcaccttcaagaaaacatgacacttctagacataaaaaagaacatgacagatctcggtccaggtctccccactcaagggatcatcacagacgatctccaagaaggcattcaccaagacgcagatcacccccagccagtcatcgccatcattcaccaagaagacattggtcaccacctgccaacaggaagactggattgggtaagcctggaaagaatctctttattgcaggatttagctatgccaccactgagcgagatttggagaagaaattttgcaagtttggacgtgtaacaagtgcacgtgttgttcgtgataaacgaactggagattcccgtggctttggattcttatccttggataaggatgaggatg

SEQ ID NO: 1646 - DNA, 424 bp, Zea mays
  Clone ID: LIB3227-025-P1-K1-A8
cctagtttttttcttctttggtctacatgtataattatgccgcctgataccttttgggtttcagtgtatcatatataccagtgtacaggttcggacctgaacattaatttgattgatagtggtctactgatctttatgttttaaaaaaaaaaaaaaaaaaaggtggtggtcatcaactctaggagtatttcactatcgctgtcttctcattccccggttatcaacaagaaatacaccctgccatgcatgcctatgcgatgataactatgtgcaacttgcaactccactgcaggttgagattttgctaaatttgaaatgctgcaaaatggatgggtgcaagaaatgagatatggggtcaaaagaatactttgtttcttgtatgttagcatgtttgaaccatagcaattggtggacgtgtgtagag

SEQ ID NO: 1647 - DNA, 299 bp, Zea mays
  Clone ID: LIB3227-025-P1-K1-A9
gatggacccaagtatggaaatcagggataagctgcttgaaatggggatgacggctttccatcctaaataatagctgtccgcccacccgaccctccaatatgcttgtgttgtgattgtgtagaataaagtgaactgcgaccggcatgggtgaaaggtgttaaattgtagaatcaacttgtaactatggatggtactgctgatgtttgcctgtccatttcagacttccaggtatcgtctactactcgggaaatatgttatattatgcattgcagtctgttagtgatggcaatcgctggaac

SEQ ID NO: 1648 - DNA, 113 bp, Zea mays
  Clone ID: LIB3227-025-P1-K1-B1
gcgcagggccccgccatcccactctgtctaagcacactgaatgggaggccgcgtgcaatcggccacttgaatctgccaccgtccccgacatctcgtgagtaggagctaaagga

SEQ ID NO: 1649 - DNA, 400 bp, Zea mays
  Clone ID: LIB3227-025-P1-K1-B10
ctctggttgaccttggatgtagatgtcgtggtgatcttgcaaaagcacatcgcacatgcattgatgtttggtttcgtactagaggttcaaacaagtgtgagatatgccagcaggttgctgctaatatcccccctccagagacgcaagcaagtacaagttattgggtttggagggttgattcgacttatggaaggggacgaggaggacgtgaaaggggatggtttagcccactttgggttgcatttgcaattctgattggtggtctcttattggatgtgctgatatctgtttctcttggtgtttccgcacttcctgtcaatataataattggcgttcttatagttctcggattgggcaccgcccttcgtctagctctcgagtgctgccaggaatggggctc

SEQ ID NO: 1650 - DNA, 392 bp, Zea mays
  Clone ID: LIB3227-025-P1-K1-B11
gggtacggtacatcggggcagccaccgagtacgctcgagggcgccaagttcacggcaaagaaccagctcatgtactacccggctgaccagggggaagcgcccctcacggaggaggagcgcgcagagcggctcagggggatgaccaaggagataaacaagccgaacaccaggctacatggcagagccacggctgatgacgcgaggcccaaggaggagggggctgccatactttacgcgctagttgcaggctctactccgggagggatggcctaccacgaccctgacaagttgaagaagtacgatctggaggacctgaggaagaccccgaaccctttctacctcgagtcggacaagaaggccggcaacgggtacagttttgtgaggacgccgtc

SEQ ID NO: 1651 - DNA, 357 bp, Zea mays
  Clone ID: LIB3227-025-P1-K1-B12
cacgtactgctgctactactgcgtgctaactttaatctgatggcagtccacagctagctagcacatcacctcctgtaagtaatgtgcttatctatatgtgcaccgaccggaaccggaggcgtgcgtacgctgatctgccacgaagcctactagtagttaaatgtaacgtaacctgcaggcaattaagcagggcgctgctatatatagcgtaattaattgtgcgtatgggtatggtggttcgattatcggatgtgtaatccctgtacgtggccgggcccgtgccaaacgtacggtgacctgtgcaggctctgtgtgtcgatgatgttgtactctgataatgatataatccattgtggt

SEQ ID NO: 1652 - DNA, 430 bp, Zea mays
  Clone ID: LIB3227-025-P1-K1-B2
acagtgtcctgtccacccactctctcctcgagcacactgatgttgctgtcctgctcgacaatgaggccatctatgacatctgccgccgatcccttgacattgagcgcccaacctacaccaacctcaacaggcttgtgtcccaggtcatctcatccctgactgcttccctgaggttcgatggtgctctgaacgttgatgtgaacgagttccagaccaacctggtgccctaccctaggatccacttcatgctttcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaa

SEQ ID NO: 1653 - DNA, 173 bp, Zea mays
  Clone ID: LIB3227-025-P1-K1-B3
ttctttttgcctcgaaagagcttctgctcagctcacgcgcctactgttgtagaaattgtgggctcgatattcagaaaggtctgtcacagaccttcacaccctagtctccaataatgggggggggggagagctctttgtgggcacactttttgaggaaggaaaaaatgtccaca

SEQ ID NO: 1654 - DNA, 401 bp, Zea mays
  Clone ID: LIB3227-025-P1-K1-B4
atctatcttcggcctttcacatttcctcttgcctgaccttcttcctagcttgaatagagtagttgttctggatgatgatttgattgtccagaaggacttgtcacctctatggaacctcgatatgggtggtaaagtgattggagcagtccagttctgtggagtgagattagggcagctgaaaccttatatagcagaccataacgtcgatgatgattcatgtgtgtggttgtcgggcctgaatgtcattgaattggataaatggagggacaccggcattaccagtttgcatgatcaatcagtccagaagttgcgaaaggacagcctgaaatcacagcgactgcaagcactccctgcaggtctacttgcctttcaagacctgatatatcctttggaagattcat

SEQ ID NO: 1655 - DNA, 403 bp, Zea mays
  Clone ID: LIB3227-025-P1-K1-B6
gcgtcaaggacgaggaagggtacccggccttcgcgctcgtcaacagggtcaccggcgaggccatcaagcactcccagggcgagggccacccggtcaagctggtgccctacaaccccggctaccaggacgagtcggtgctgtggacggagagccgcgacgtcggccacggcttccgctgcgtccgcatggtcaacaacatctacctcaacttcgacgccttccacggcgacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatgatctggagctttgaaggcatagccacctgtggtcagcagctgct

SEQ ID NO: 1656 - DNA, 426 bp, Zea mays
  Clone ID: LIB3227-025-P1-K1-B7
agcccaccgaattccctgcgattcctctgccctcgcctcctcgtctccccctaggggatcgtcggagaggaatcgcaaagagggccgtctcatccgagttaaggaagccatggagcacaaggaggctgtgcgccaggcccccaagggacccatcctctgcatcaataactgtggcttcttcggcagcgcggcgaccatgaacatgtgctctaagtgccacaaggagatgataacgaagcatgatcaggccaagctggctgcctcctctatcgacagcatcgtgaacggcagcgacgccgtcatggagccggttgttgctggcagcaacacggtagtagctgttgcccaagtcgagttgcaaacaatgaacgtgcagcagcccgctgatgttgccggacccagcgagggggtggcggcgatctccaa

SEQ ID NO: 1657 - DNA, 409 bp, Zea mays
  Clone ID: LIB3227-025-P1-K1-B8
ctccaacgaggagcatctgctccagctcaggcgcctactgtcctcgagattattggcacttggcattggcgcattgccagccaccgcccttctggccggccttctctttcgtacgtatccagcggcgtcccaggtcatctcatccctgactgcttccctgacgttcgatggtgctctgaacgttgatgagaactagttccagaccaacctggtgccctaccctaggatccacttcatgctttcgtcctacgctccagtcatttctgctgagaaggcctaccacgagcagctgtccgtggccgaaatcaccaacagcgccttagagccatcctccatgatggccaagtgcgacccccgccatggcaagtacatggcatgctgcctcatgtaccgtggtgatgtggttccc

SEQ ID NO: 1658 - DNA, 423 bp, Zea mays
  Clone ID: LIB3227-025-P1-K1-B9
tcggccgcccgtgtggtaccaggcggcaccatgtggtcctcccggaggaagtagggggacttgttcaccagcgcggggtccctcccgaggtgctcgaaccccgcgccggaaccgtggaagccgtccaacaagtgcatgtgcgcctccaggttgtggtagcacgtgaggtccacatggtgccgcccgtgtggtaccaggcggtgaacaagggcatggggaggactgtggacggccgtagggtgctgccgacgtggctgagggtgctctactaccacccggaggacactgaccatcacctacagcgtattggtctaaccgcgtgaagctcagcaatactctgatagtagcgttaattagggcgtgtggcgttcgcatacgtgcgcggcgcagtcggttactctgttgccgagcgcggtaactaag

SEQ ID NO: 1659 - DNA, 432 bp, Zea mays
  Clone ID: LIB3227-025-P1-K1-C1
aaaaccgcatcctctcatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctggtctttcgaatagtattgttaatgaaatttttcgttcggttgtgtttctgatgtaatcgttgtactgagtagaccttctggataccgg

SEQ ID NO: 1660 - DNA, 225 bp, Zea mays
  Clone ID: LIB3227-025-P1-K1-C10
tacgcgtgcgcgaacagcacgatatgctagtgtaaacaaccatggttcttgctatgaatcgtcatgacagaaagggagccctaaagttcttttggtgacctacaattcaatgcatcacaatttataatagtcaacaaaatcataatgtttgtcaaattgctttgtcatcgtcagaacaatttttacagttttattgccaaaattttcttagcctatgacaaaata

SEQ ID NO: 1661 - DNA, 411 bp, Zea mays
  Clone ID: LIB3227-025-P1-K1-C11
tgtccctccatttattagagaatttaattatccgatggccagaaattgtgccggtggggattctggtgtttttgtcaatggcagagaactgcatcaaagagatttagatctacttgtaggaagaggactaccacggacatctggaaaatcatattctcttgagatgtcaggaaatgtaattgatgaagacactgggaaaaaactacgcagtcttggaaaacttgctcctacgattgagaagttgaagcgtggttttggcatgcacgtccctgaagagtttagatagctggttctagtacaggatcttggttttgctaataatacactcttcaaagctgacaatggggtggcaaacgtgtggcttctgcgggacggtggtatcaaatctcagatttcttggactggagctct

SEQ ID NO: 1662 - DNA, 309 bp, Zea mays
  Clone ID: LIB3227-025-P1-K1-C3
caggaatgaccatggttcttgctatgaattggcatgacagaaaaatagccctaaagtacataggtgacctacaatttgatgcatcagtatttataatagtcatcaaaattataatgttggctaaattgctctgtctcgacagtacaattatacagtttaattgccagtatttcttagcctatgacagatatgaactcatgcagtgtaatgtttaagcctatccctgtttctagttacatgtgaaggactcatgcagtttgaaatgttattgggaaatgatccctgaactttgtttttattgggtggatt

SEQ ID NO: 1663 - DNA, 345 bp, Zea mays
  Clone ID: LIB3227-025-P1-K1-C4
ggaacagcacgatatgctagtgtaaacacccatcttggagtaggtgagtatcgttatttaacggtggtgctaagaggtttaaataatgtttaattatacagaacagcaagttttaggtttttatgggtacacaatctagtacaaaaacagggccttttagtcccaattaagttggggtaggctagagatgagaccctacggaaaggaaaactcatataaaatataaaaaggcattaacactcccccatcacataatataaggcgtatgtttcattgtgacgagcctttgaccaacaattattatatatattttttcgcgaaaacgcatgagagctgcgcgtcatt

SEQ ID NO: 1664 - DNA, 374 bp, Zea mays
  Clone ID: LIB3227-025-P1-K1-C5
gacctacgcgtgcgggaacagcacgatatgctagtgtaaacacccatcttgtagtacgtgagtatcggtgatttaacggtggtgcttagaggtttaaataatgctcaattatacagaacattttgatttaggtttttatggttacacaatctattacataaacagggccttttagtcccaattaatttggggtaggctatagatgtgaccctacggaaaggaaaactcttataaaatataaaaaggcattatacactcccccatcacataatataaggcgtatgtttcattgtgtcgagcctttttccaacaattattttatatatttttttgcgaaaactcatgatagctgcgcgttatttaaaaaataaaaa

SEQ ID NO: 1665 - DNA, 408 bp, Zea mays
  Clone ID: LIB3227-025-P1-K1-C6
aaaaaacgaacttgaaacgaccgcgaagccacaagtcaaaggcggcggcggcgatggggagcgacacggagacggagaagaaggcctcggtggcgctgatgtccattgcgaaacccctcgctggaaagaagctctgcaagcggaccctcaagctcgtgcgacgagcctccgaggcgaagtgcctcaagcgcggagtcaaagaggtagtcaagagcattcgccgcgggaacaaaggattgtgtgtgatcgctggaaacatttctcctattgatgtgattacacatgttccgatactatgtgaggaagctaatgttccttacgtatatgttccatcaaaagaggatcttgcgaccgcaggaaccactaagaggccgacttgttgcgtcttggttctgaccaaaccaaaca

SEQ ID NO: 1666 - DNA, 397 bp, Zea mays
  Clone ID: LIB3227-025-P1-K1-C7
gcaagctatgccaagtcttggaacaacgcaatgttcttgcaatgccagcaagttcaaaaagtgtcaggttcgtcatccattaccagatttcagacagtgatgttcaatatgcattgacatgtgtcgagtcgctatttcgcaagatcgtcgtggccctattgggaaccgagatgctcttaatgaagtaggaggaccgaccaatccaacttgcaacagcaggcggggagtggatgcgcctgctagaagagtgctagctccgcgcatacgctcgctcgacaaatgtgtgttggtaactattgggtatagtggtataattactgtgctttattcccgatgtttgttttgtgtaaaaaaaaagaaaaaattagttaggctgaatttctgattaaataacttt

SEQ ID NO: 1667 - DNA, 420 bp, Zea mays
  Clone ID: LIB3227-025-P1-K1-C8
ggcagtccatcagtgtcaattctgaccatgcagaaacttatgaagaagtttccccaggatttggagactgccgacgcaagcctttctgcttctcagaacactgcagcatcggtcgttccttccacaccgacttccaggacttcaccatgcaagcttgcggggaggaagtctcgccaaatgatcgcgagcgggattctgctggttggaagcatcgtttgtctatctcgaggccgatccaacctcggggcgcagctcgcgatggccttcttcctgaaaaaggccttcaagcaagagaggcaatcaggctcctcatcgacatgaatggtgaaaacagacgtgactagatgcaggcggtagccgtactagtttgactctttgagccgtgcagacgccagacaacgtattattagtatttttaac

SEQ ID NO: 1668 - DNA, 402 bp, Zea mays
  Clone ID: LIB3227-025-P1-K1-C9
caggaatgaccatggttcttgctatgaattggcatgacagaaaaatagccctaaagtacataggtgacctacaatttgatgcatcagtatttataatagtcaacaaaattataatgtttgttaaattgctttgtctcgacagtacaattatacagtttaattgtcagtatttcttagcctatgacagatatgaactcatgcagtttaatgtttaagcctatccctgtttctagatacatgtgaaggactcatgcagtttcaaatgttattggaaatgatcctgaactttgttttattggtgattgttctagggatcattcagtagttaattagctgacgatttacttgtgattgttgggggagtacttgagcgtgtgatctagatgggtgttctgaattatt

SEQ ID NO: 1669 - DNA, 415 bp, Zea mays
  Clone ID: LIB3227-025-P1-K1-D1
ccagggtatactccatagagacctgaaatcagagaacatacttctgggagaagatatgtcagtcaaagtcgcagatttcgggatttcatgcttggaatcacagtgtggaagtggcaaggggtttacaggaacctacaggtggatggctccagagatgatcaaagaggaacatcatactaggaaagtggacgtgtacagctttggaatcgtcatgtgggagattttgactgctttggtcccgttcagcgacatgactccagagcaggctgctgttgctgttgccctgaagaatgcaaggccgccactgcctgcttcatgccctgtggcaataagccacctgatcatgcagtgctgggcgaccaaccctgacaaaagacctcagtttgatgacatcggggcgatcctcgagagctac

SEQ ID NO: 1670 - DNA, 211 bp, Zea mays
  Clone ID: LIB3227-025-P1-K1-D10
cgttcgccagctttcgcgctcttctgtccatcttatcatcgaatggggagattcaggtttatcactgcagatggtccccaaattttctgaagtgccgtctatcaaccacccccgtgcttatatacccaattgcacacttgcgcgcactcagcatgtcttgcctgcgcgacatactgtacatcgttgccgagaaccccaacttgacaatcca

SEQ ID NO: 1671 - DNA, 384 bp, Zea mays
  Clone ID: LIB3227-025-P1-K1-D11
cgacggcttcgagatcggtccccaggtgctcaggaactcgacggtcggcgtgctgctgccccccaagcagaaggacgcgacgtcgccgctgcccggctggatcatcgagtcgctcaaggcggtgcgattcatcgacgcggcccacttctctgtccccgcggggcagtacgcggtggagctggtggccgggcgggagagcgccatcgcgcaggtcatccgcaccgtgcccaaccgcgcctacaacctgtcgttcgccgtcggcgacgcccggaacggctgccacggctctatgcttgtggaggcgttcgcgggcaacgtcacgcagaaggtgccgttcgattccgccgggaaaggtgggttcaagacggcggcgttcatgttcgt

SEQ ID NO: 1672 - DNA, 415 bp, Zea mays
  Clone ID: LIB3227-025-P1-K1-D12
gtggttgcaagattataggggctatatataccttataggtatcgtctgcggtgacgatcgatggcggatatggtgaatcggtctctagaaatggtaggcaaacgaaatttattcagttcttcatgccccgttcttagcttgtttctgctgggcggggtggggcactggggcggggtgcatctctatattgttgtccattatatttcaggtgtatgatgatatgtaaacttataacacatgcatgttgcatggatttccttgctatctttggcatgcaacgtgttcatgtgcatggtgcaagaggcgatatagtgtgtgtgtatacacacacatatgggagtacttgataaaaaaagatcgaggaactactgaacaatcattcacctattaattcgagacagtttgcaacaataaa

SEQ ID NO: 1673 - DNA, 422 bp, Zea mays
  Clone ID: LIB3227-025-P1-K1-D2
ccccaagagcgtagcaacttctcgcaagggcagggaggaggttttaggcctggtggtccttcagcacctgggtcttatggccaaccatcagcacctggatcttatggtcaacctaatacacttggtaactatgggcaggtacctccatcagtgaatcctggtggtaacagagttcctggtgtgaatcctagttatggtggggatggcagacagggggctggaccagcatatggtggagataactggcaaagaggttctggtcagtatcctagcccaggtgaaggacaaggaaactggcagggaaggcagtaagagctgacgtgttccactgaagacaagaatggcacttgagatttagaaatctccatctgtaaaataaacgactgtgatgcattactcttttttttttttcttgcatttga

SEQ ID NO: 1674 - DNA, 426 bp, Zea mays
  Clone ID: LIB3227-025-P1-K1-D3
taacaaaattgctccaaggttccaggagggaatcaaggccttctcaggaagcccaattgttggggagatacgcggtctgggactgatacttggaactgaatttgtcgacaacaaatctccaaatgatccatttccagctgaatggggtgttggttcgatatttggcgcggagtgcgagaagcgtgggatgctcatcagggtggctggggacagcatcatgctgtcacccccgctgatcatgactcccaatgaagtcgaagaaatcataagcaaattcggcgatgctctgaaggccacggaggaacggattggagaactgaaatccaggaagaattagccgatgctgctggttgtaacgacggtgaggatggtgatggcagcagtatattttcaaactttatttcagtaaagtgctgggctggaacc

SEQ ID NO: 1675 - DNA, 419 bp, Zea mays
  Clone ID: LIB3227-025-P1-K1-D4
atcgctgagggatcgtcgatccggagaggcaaacaagtcgagagatcaggcagggcaccatggggcgcgggaaggtggtgctgcagcggatcgagaacaagatcagccggcaggtgaccttcgccaagcgccggaacggcctgctcaagaaggcgtacgagctctccgtcctctgcgacgccgaggtcgcgctcgtcctcttctcccacgccggccgcctctaccagttctcatcctcctccaatctgcttaagactctagagcggtaccagaggtacatctatgcttcagccgatgctgcagtgccatctagcgatcagatgcagaataactatcaagaatatgtgaagctgaaggcacgagttgaggttttacagcactcacaaaggaatcttcttggtgaagatctggccctactt

SEQ ID NO: 1676 - DNA, 409 bp, Zea mays
  Clone ID: LIB3227-025-P1-K1-D5
caaggatggacggtgggtcatgtatgatgaccagacagtcaaggttattggtagttggggtgatgtgctcgtgatgtgtgaaaagggccatttgcaaccccaagtgcttttctttgaggctgcaaattaattattcttcagagtcgcaaaacgcgctacagcggttaacatgccctcaaatataggttttttccctgcggccatgaagattagaaatagggtagcagattcgttttgagcggggatatatagtactagcattcaacggtgcttttcgttgtgagtccgtaataagcagtcatctgagcattctagagcaaaaaagggagctgtttatcccccccttttttgctttaacctttggtgtaggcgctgaacttctgatctcatctgccaataaatcttcact

SEQ ID NO: 1677 - DNA, 357 bp, Zea mays
  Clone ID: LIB3227-025-P1-K1-D6
tttagcctaataaagcccattagcacgagatgagcatatttgttttcacagatgaaccgtgtgctataattgtgagcagtaacattttacttgctcaaattagtcagtacatgcgtatcaactactatacatcgatgtggttcctacaagctgggctctccattgctttgtgattgctcgctctgacacaaaacaccgaaaagcatacgcaccgcaagccttgtgacatctcaagcgacaaacagctcggcctggccgtcaatgaacaagctcatgaattcctccccgtccacggtctccttctcgatcaagagctgggcgagcttgtggaggatgtcgatgtgcgtggtgattatc

SEQ ID NO: 1678 - DNA, 343 bp, Zea mays
  Clone ID: LIB3227-025-P1-K1-D7
cccacgcgtccgcgctcgggctgtccatcttatcatcgaatggggagattcaggtttatcagttgcagatggtctttcaaatctgctgaagtgccgggtatcaaccaccatccggtgcctttctcacccaagtgcacacgtgcgcgcactcagcatgtctgtgctccgcgacatcctgagcaacggatccgtgaaccccaacatgacattccaaagggatcagctgcccgacgtgatccagagcccgtcctaccggtgcctggccgcaggcatcatcaactggcatgcggacgtcgagaggtgcatacagcgggaagcccacagccagtcgcgccactgggct

SEQ ID NO: 1679 - DNA, 415 bp, Zea mays
  Clone ID: LIB3227-025-P1-K1-D8
ctttggtaattgcgctcttcaaatcggggttgctgcagggtctccagaagatggtaatgcacttaatgtggatgtacaaaagtttatccaaggctctctatacaaaagtgccatggaattcaagaaacaatcttatctggcaaatcttgctttgtatcctgggaggtctgaattgccgttcttgcctgctaacacacaggcactgatattgcagccaattggtgataaagggattgcaattgttggtggcgacactataagaggtttcactaatattgatcaggcttggatcgcaatgatcgcagacaagctggatgccacattgtctaagtcttcaaacgctggactgcttatttgatgctggttcaccatctcccgtctcctgagcacatcgtcgccctacaaatccacccct

SEQ ID NO: 1680 - DNA, 419 bp, Zea mays
  Clone ID: LIB3227-025-P1-K1-D9
cccacgcgtccgcgctcgggctgtccatcttatcatcgaatggggagattcaggtttatcagttgcagatggtctttcaaatctgctgaagtgccgtctatcaaccaccatccgctgcctttctcacccaagtgcacacgtgcgcgcactcagcatgtctgtcctccgcgacatcctgagcaacggatccgtgaaccccaacaagacaatccaaggggaacagcagcggaacggcatccagagcccgtcctaccggtgcctggccgcaggcatcatcaactggcaagcggacgtcgagaggtgcatagagtgggaagcccacagccgccgcgccactgggctgacgctcgccttcctcagtgccgcagcgaaggagctcggctgccctctcccgtcatgacaaggccattcctggatct

SEQ ID NO: 1681 - DNA, 424 bp, Zea mays
  Clone ID: LIB3227-025-P1-K1-E1
gcacacttggcactccaatcttgccctaccaacgtgggccacacgtgcatctttcgctgatttgtttgttcctttctttgtccgctacgccaatggaatggatggataggtaggtactgttggtaggttcatgctgctatgctggctactggagacatggccaattgagattaacggagtttaatccgtgtgattcaattcaattcaatccaattagatacaaatgcgattagatgaccgagcgaccccgttcagcttcagcggagcgaagcaaattctacatctcgcagccaaagaacggaaaccaagaacagagcagccaaggagaggagggatcagcacgtaccattcggatctgccggcgccaggatccacccgagacgtacggccaaagatacccgcagttcgccacgccacgccgatc

SEQ ID NO: 1682 - DNA, 414 bp, Zea mays
  Clone ID: LIB3227-025-P1-K1-E10
gttttctctactcatgatggctattctcttgatgttttcgttgttgatggctggcccattaaggatactgatggtttgcacaaagcactggaagcatccattttaagaaatgagggttcatggtctggttcatctcattcgtcagcagctgaaagaacactgcccttccaagttaaaggtggtgaatgggaaatcgataaacgacttctgaagatgggagggatgattgcttctggttcttgtggggatttgtatcacgggacttacctcggtgaggatgtagctgttaaagttctaagagctgagcatttgaataagaatgtttggaacgaatttactcaagaagtatatatactaagagaagttcaacatacaaatgttgtgcgattcattggtgcttgcacaaaaccacca

SEQ ID NO: 1683 - DNA, 417 bp, Zea mays
  Clone ID: LIB3227-025-P1-K1-E11
cccacgcgtccgcccacgcgtccggaatctcactcctgttgattcaactgaaagctccttcgatacatatcgttcgcccccaagacctctgccctatgatgatccacgattttcccctcctgctcgtgactggttaaggagtgagaacccaagccattccccagaggaatcggaaccacttagagcaaatgaggatgatgaagaaatggaaacaccaagtataatacagaaggcaagtaaaacaaactacaacacaaaaatgaaaatctgcagctctacttatggtgataaggtgccaccaagggaacatggaaattacttcagctatttttccccatctgctgaagatgaagatgtttgtccaacttgtcttgaagattatgattctgagaatcctaggatagtaatgcagtgctc

SEQ ID NO: 1684 - DNA, 417 bp, Zea mays
  Clone ID: LIB3227-025-P1-K1-E12
cgcctgcttcgagacaaatcagaattgatggggctctcaaggttggacagaaacgtggaagattggttgcagatctagaagaagatgaacaacctaaaaagaaggttagattagggagcccagcggctcaatggatttcagtttataatgctaggcggcccatgaagcagaggtaccattacaatgtggctgactcgaggctaagccaacatatagaaaagggcaacgatgatgggctttacattagcagcgtggcttcctcggcaaacctttgggcactcatcatggacgcaggaactggtttctgttctcaggtttatgagctctcaccagttttcctccacaaggactggataatggagcagtgggagaaaagctactacataacagcaattgctggatcatccaacgggagct

SEQ ID NO: 1685 - DNA, 310 bp, Zea mays
  unsure (1)..(310): unsure at all n locations; Clone ID: LIB3227-025-P1-K1-E2
aatggacctggtattgtcttgctggttcagtggtaggaagtgttcttcactaaaacatgtggttatctgattgagcccctatttgatcctcacggcgcagaaggtaatcaccaagcagtgcattgctgatcgttacaacggacttcactgtatgtcgtcttggtggccgaagcttgactagcagtaacagctctaattgtaaatcgtgtcttctgtagccctaggactgagtgatatacatcgttattctcacgtgtaaattaaaccccatatggccatatggcttcaatatatgaaacattgtcattna

SEQ ID NO: 1686 - DNA, 419 bp, Zea mays
  Clone ID: LIB3227-025-P1-K1-E3
caagcttacaggaaaatcaggctccgtgctgaagatgtgcagggcaggaatgtgctcacaaacttttggggtatgaattttaccactgataaattgagatccctagtgaagaagtggcagacattaatcgaagcccatgttgatgtcaagacaaccgacaactacatgttgcgtttgttctgcatcggcttcaccaagaggcgcccaaaccaggtcaagaggacctgctatgctcaggcatcccagattcgtcagatccgccgtaagatggttgagattatgatcaaccaggcttctacatgtgacctgaaagaacttgtttcgaagttcattccagaagttattggtaaggagatggagaagtctacctccagcatcttcccacttcaaaacgtcttcatccgcaaggtgaagatact

SEQ ID NO: 1687 - DNA, 424 bp, Zea mays
  Clone ID: LIB3227-025-P1-K1-E4
caagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgtttcccttctgaagaagaactggcagaatgtgagatgcctctacgtcaagagcaccatggggaagccatacagggtgttctaagtatgctcttttgtgaagtctgctaggttctggcaccgaggttttattgaattaaac

SEQ ID NO: 1688 - DNA, 176 bp, Zea mays
  Clone ID: LIB3227-025-P1-K1-E5
gacgacccacgcgtgcgcaagaagctagataagatgctcgccaagaagtacctctctattttggcatcaaaggccatcagggggcatttttccccgggcttctgcccccaaacctcaacaaggcaatcaataatcctaccctgagcactcaccacgaacccctcgaatccaaagag

SEQ ID NO: 1689 - DNA, 357 bp, Zea mays
  Clone ID: LIB3227-025-P1-K1-E6
agaagagaaggtggaggagaaggaagaaagtgatgacgacatgggcttcagcctcttcgactaagcttgtgcaatagtcaagaatattgtttttgagtcgcggaagcagaggggataaaaatcttagtcatgtttggactttaactttgttttatgttggaaagtacttgaaagacttttcctgtggtaattctaggcgtaggttgctgtgctggttggggtttactggtgaaccagagtttttctatcccactatgaatttgttacctcaagttacctggatgttcactgttttgttggtgaacaaaacaccaaccctacttttggcttcaaggcccggtctcaccgggccaatcc

SEQ ID NO: 1690 - DNA, 388 bp, Zea mays
  unsure (1)..(388): unsure at all n locations; Clone ID: LIB3227-025-P1-K1-E7
ctcgaccaggccgacagcgccccagccgcgtcgcccctaccgagccacccgcccaaggcctcgacacgcccgtgccaggaacctgcgcgccgagcccgacccgaccgaccgcctcgcgcccacgccccgacccgcgctgcgcagtagccgcgacctcgcccgaagccccgcgacagaaacgcccgtgcccagccgttcgtcttcctctgcgttattggtgattcaatgcgtccgtttttccctccccattactatcctccatgagccgacgccgttgatgggcgtttgaagacgccgaccgcccgtttgctctctcccaagcgctctacctcctcctcgctggcctataaaacccacagcccgcgacgttgtgctcacctncgcgctc

SEQ ID NO: 1691 - DNA, 376 bp, Zea mays
  Clone ID: LIB3227-025-P1-K1-E8
cacatgtgttagatgattatgggacttttaggactaaggttagtcgattatttaattttttattccaataatggaataagaaactatgagtgggtattgtaacaagtttctacaacaggcgtattagaaatggataaatagcgctttttaccctatttcaactgggctattctattatatttctggacctgcaattggatgttgatgttatgttcttgccataaagtccaatgtatcgtgctagctgtacactgatctgtaacaggtgatcgactgactcgagagtttgccgatgcttgaagaaagacctaatgtgagcttttacatacttgatgaacagcttgagatcttgagcaagattcgatgtcgcgggcac

SEQ ID NO: 1692 - DNA, 416 bp, Zea mays
  Clone ID: LIB3227-025-P1-K1-F1
tgaatggctattttcttgaatggctatttgttatggcacacagtaaaagcttatgttgcaaagtcagtttgttttgaattgcaggcatatctctttcgtatttgagaattctgtattttcttggcccacaaatcaagctcctctttttagctttattagtaagccattgtttgttacttttcttatttgaggttcggaatagttgtcagacctttgaaaacgtttctagatgtggatgaaatggagcttcccaaatggcaaacaagtttcggctgcgtgagatactgaagtcgtggctccctacctttatcagtaatcaaaggatggcgcttgccgcatgcctgcagactgcagcctagttgttgtttcagtttgatcctcagttgaggttccattttgtaaagtttcatcatgct

SEQ ID NO: 1693 - DNA, 407 bp, Zea mays
  Clone ID: LIB3227-025-P1-K1-F10
gaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgatcacgcccatcgatccatctgcaggttaaataatttgtccaagctagtatatatacgtacgtacgttgatatatatgatgtagtattatatatatgtccatgcatgcaatgcatctcgtcgtccatcgcatgttgttgtcgttgttgtgtgtgttttcgatgatcctgtctctgttataaatatcattattattac

SEQ ID NO: 1694 - DNA, 381 bp, Zea mays
  Clone ID: LIB3227-025-P1-K1-F11
gcactagactggtcggagatatgtagcgaccccagcctcacgcggtcacgcctcaccatcttcaccggcggcggcggcgcgccaggacaaggagcagcgggactacagactcatcgcaaaagccgtggacgaagcgtaccgggcggtggagtgcgacggcggcgggtaccccttcggcgcggtcgtcgtccacggcggcggcgacgacgaggtggtcagcagcagccacaactcggtccggaaggacgccgacccgtcggcgcacgccgaagtgaccgccatcagacaggcgtgcaagaagctggggaaaaccagcctcgccggctgcgagatctacacgtcctgcgagccgtgcccgatgtgcctggggctcattcgcct

SEQ ID NO: 1695 - DNA, 390 bp, Zea mays
  Clone ID: LIB3227-025-P1-K1-F12
aatctttagagcgctccatccacgagaccaacatatacagcataccagcaaatggttatttatgtcacttattagcaatatgtcacttgccacaatctagattactgcagacatagatactgaaaaggcattcctggcaacacatgtcctagaagcctgaattcagctaccattagggatggtaatgtgccataaattttacactataaaatttaaggatcaaatctgattaggatcgagctatatttctattcatttttaaattaaaattatttacggtctctaacatattgtgaagaaacatttaaatcgtgatccattaccaccgctagctacgatcaacacatcacttccacttcttgaacttgccgccgaacatgccgtgtccat

SEQ ID NO: 1696 - DNA, 410 bp, Zea mays
  Clone ID: LIB3227-025-P1-K1-F2
agaatgatgaccttctgttagtgtatgagtatttgcaacgaggcagcctggaagagatactgcatggtaaaaaagaatgcaagagcatatttggttggactgagaggttcagcgtggctatgggagttgctcgtgctctggattatctccatagtgataacaacagtcgtccagtgatccatagggatgtcaagtcatcaaatatcctcatttcaaaatgctttgaaccaaagttatcggactttggtctcgcagtctgggctgctgatgtgacatctcagatgacatgcaatgatgttgcaggaactttcggatacttggctcctgaatacttcatgcatggcaaggtgggcaacaaaatcgatgtgtatgctttcggtgttgtacttctggagctcatctctggcagg

SEQ ID NO: 1697 - DNA, 242 bp, Zea mays
  Clone ID: LIB3227-025-P1-K1-F3
ctgaaaaggatggacatggagagctggtttatatctcacacaagtgttcatacacaatctagagtaaagtttttttgttgttgttattattatcatgtcaggtatgagcacaaggttgaattaatggttaatgcgattgatatactataagtggcacttgcattggtaggccaagaccgagatgtattccttttccttgttgattttgttcggtctcggagcaatatttgtttcagtgttaa

SEQ ID NO: 1698 - DNA, 176 bp, Zea mays
  Clone ID: LIB3227-025-P1-K1-F4
ctgtatagaaaacctaacaccattataacactatagggctgccaggttttaaataaagcgggcgcgtatatcgtcccgcgttattcgtcctatatcaacctgacgtacctgcattccatacacacgggtgagtttagtcataaacacaattttctcctaaaaaaaaaaaaaacaaa

SEQ ID NO: 1699 - DNA, 422 bp, Zea mays
  Clone ID: LIB3227-025-P1-K1-F6
cctgggttgatatttttgaggagataccaataaaagtttccaactcagcgcttgtcagtgcctttatgaaggagctggaacctgagtcacctgttacccagtgtgacctggaccgacttaaattgtcaaccgccccctttatggaaaggaacttggaatttctgattgggtgcatggatgatctttcatcagagcagaacaagttccaatattataaccgcaatctctcaagacaacagtcacagcagcaggcatggcttcaaaagagaaggcaggagaacatggcgaggaaagcagctggtgaggagccactaccagaagaagatccatccaatcctatatttaagcctattcctgagccctcacgattggagggctatctagtaactaatcagatctgcagttactgcaaccatatcaac

SEQ ID NO: 1700 - DNA, 241 bp, Zea mays
  Clone ID: LIB3227-025-P1-K1-F7
aggaggagctgtacaggcgtgtcccttcggacgtgtgagccgtcggcgtcctgacatctgcgttcccggttttgaaacctgctgctgctgttgcgagtttgtgtaccattaactcttctctggtgaatggtgatgtacgtgtcgtagtcgtgtacgagcattttgtgtactgcagaaaaaaaaaaaaaaaaaaaaaaaaaaaaaaaaaaaaaaaagaataaaaaaaaaaaaaatataaaaa

SEQ ID NO: 1701 - DNA, 412 bp, Zea mays
  Clone ID: LIB3227-025-P1-K1-F8
cccacgcgtccgggaacatcctccggtggccgccgccatggccggctgctgcgtgttcctccggtggccgtcggcctcgccgtcgcgcatcggctaccgctccctcgtcgacgcggcggccgacgacgccgccccgccgtcgacggtgacggtcgtggtcgggaaggagcggcgggcgttcgcggtggaccgcctcgtgctcgactcctacccgctccggctgctcctggagacggcggcgcgcatggaggagcgcagggccgggggcggcgccggcgccatcttcgtggacgtcgacgccatcctcttcgagcacatcctctggctcgcctgcgacgcccgctccgtctcccagatcctgcacctcgacctcaaggagatcatcgacttctacgcccaggacgcgtgactg

SEQ ID NO: 1702 - DNA, 267 bp, Zea mays
  Clone ID: LIB3227-025-P1-K1-F9
aaaaaaaataaaaaaacataaaaaaaaaaaacaaaaaaataaaaaaggggataagtgttaattaataaaaaaataaaaaaaagggggttcgctttaggttgggggggcttttttgtggctccaagcttacttccccggccttgcatcgtcttagtttttttttggtgacgccttattgtttttcattggccggggttttacaactgttgacctgggaaaaccttgggttttcccatttttttccctttgcatcttttcccctttttg

SEQ ID NO: 1703 - DNA, 267 bp, Zea mays
  Clone ID: LIB3227-025-P1-K1-G1
attcaacagagcacagaagtgggatgaggagataatgaaggacctctaccgcatcatcatgctcagcgcacgtgcgactatggtccccgctatcgataagcgcatgagcaaggagatcactgctcgtagcaccaggcagcatcaagatcaaggtcaccacgccaactgagaggaagctcagtgtgtgcacaggaagccctaccctaacataagctcagcactgtgcaacagatgtggatatctaaggacgaatgctaggagtccatc

SEQ ID NO: 1704 - DNA, 417 bp, Zea mays
  Clone ID: LIB3227-025-P1-K1-G10
gcacgaacaagttgctgaatggtcacaactggaacacaacattttagaactggagccagtacccaattaaccaaagcgtacacgaacaaggggaacaaagtgctctggtgcaagtagttgccggcacatcacatatgaagagtatattattgattgggagctgaggtgtccagtcaggttattgtcttggttacagcctgtacctttttgttgccattttgcagacagggaaagaaaaaaaatcttgcgtctcaattacggagaagttgtgacagcgtttgttgcctagcgatatcagggagtgaccattcgtttgaaacagagctcgctatgtttttggactacaaaattttggcacaaagcaggtgtacaaggttaaaccttttaaaactttcatctatttgtttcgggatagtt

SEQ ID NO: 1705 - DNA, 416 bp, Zea mays
  Clone ID: LIB3227-025-P1-K1-G11
tttcgagataatctcgctgtccggttctttcctgctcgcggaggatggtgacactcgcagcaggactggtggcttgagcgtcgcgctcgcgggatctgacggccgagttcttggagggtgtgtcgctggaatgcttatggctgcaactcctgtccaggtcgtggtggctagttttatcgcagaggggaagaaatctaagccagccgaagcgcggaaggtcgaaccgatggctgctcccccgccgccgccgccacagatggctgccttcgtgccggctccggtggccaccagccctccgtcggaggggacgtccagcgcgtcgtctgatgactccggcagcccgatcaaccacggtgcgatgccgttcagccactccagtcagcaccagcaccctcaccagcaccagcagcacatgc

SEQ ID NO: 1706 - DNA, 403 bp, Zea mays
  Clone ID: LIB3227-025-P1-K1-G12
tgataatttgccatttgtcgcggattagtttcctctttttctccttttcatgacggcgaccgcgaagttgtatgaaaatcacattagcgtcatacattaagtgacaattaattttgcaaaggtgagatatttaccaaaaaaaaaaaaaaaaaaaaaaaaaaaaaaaaaaaaaaaaaaaaaaaaaaaaaaaaaaaaaaaaaaaaaagaaaaataaataaagatacggaaacttatctgggggcggccgttttaaaggtacaaattttacatcccctatattgcaacgttatgccccttttttggggtcccctaaactgatttaaccggcgcgctttctaaaactgacgacggggaaaaaccgttgggttcccaaatttaatgcccttttgactaatcccccttt

SEQ ID NO: 1707 - DNA, 345 bp, Zea mays
  Clone ID: LIB3227-025-P1-K1-G3
aaagacaaagtctaaaacacttgtaaattacaattacttatcctttacataaccagtttgcaaaaatccacttgtaatgaacgttggctgacagttttatcactgaagtgcatcaaatccacatgacaggtgagtacgaggaacaaacagggaccgtcgaactcattcacatatcgaattgccataaaaagggtacacaatccccaagggcaactagtagcagaaccatcgtcatcagcggccaaccaaagctgctttgcttcacttggggtcagtaaagaacttgttgatagctggcatgatctcgggggtcttgtcgtgcacaaagcttctgaggccatgcat

SEQ ID NO: 1708 - DNA, 334 bp, Zea mays
  Clone ID: LIB3227-025-P1-K1-G4
gggacgaatcatggatggtggaggttgcgtgtgggagttgcgcatcgcgacagggaggaagaggatttcttcgccgtagagttgctttgtttgtttttcctttttgccctggactcttctgttttccttcttaacgagaggaagctgtttctggtacaatgcagaaagaaggcttctggtaatttttagaagttggtgttaagtaaccctagttagggttatgtgggcaaatacctgctttgcccctgaggggtctcacatctctatataaggaacctgtacaccccttcatatgacagagatcagaaagaggccagaggcccaaccctatatc

SEQ ID NO: 1709 - DNA, 374 bp, Zea mays
  Clone ID: LIB3227-025-P1-K1-G5
cgattgacaagtatccagcaccagacattgaccaggagatgaagcaaaaggttgacgattcaatagagatggttgacatgagcatcaaagaagcagcataccatgcgtggctgggttactacaactccatcgctgacataggtagagataaaagaatggttgttgacctagcaaatcgatttggtgcctcgattggcctggagaagcctccagcgatataccggaagaccgctctgaagatggggctcaaggatgtccctgggattcgaataaggaaatgacatgttcctccacagcaataagggaccttttagcctcgacattggattggaggacatgtaattgaattgggttcaaaatatacaaaattactc

SEQ ID NO: 1710 - DNA, 409 bp, Zea mays
  unsure (1)..(409): unsure at all n locations; Clone ID: LIB3227-025-P1-K1-G8
attgcgtatgtaccattcatcgagaggtttcagatattctattccaacataaagaactatgatattacaaagggcagacccaaccttcagaagttcattgaggtaattcagactgatggacattaataggctagagctttatgtttgtagtacattcactcacattgtttgaaatgacccttttatcctaatgaccaggctgaatggcccaatgcaaacagttttcttgataatgctttatcgaggagaaattttaactcgtggattggtatattttaggaagtggacaagattgatgcatacacacagactaaacaggacccacagtttttacttgagcagacaaagaagcggcttgggattgcttaaagctngcggccgaggatgactctcgacagaaataccagca

SEQ ID NO: 1711 - DNA, 396 bp, Zea mays
  Clone ID: LIB3227-025-P1-K1-G9
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtactgtggtggccgtggaggcggcggc

SEQ ID NO: 1712 - DNA, 201 bp, Zea mays
  Clone ID: LIB3227-025-P1-K1-H1
gcagcaccatcgtgtctgacggcgccgtgcatcctctgatgatgtatattaattacacgatgacatcttagtttcggaggtctggggcggtggcggcttccttttcggtttcttgggttggcggtggccggtggtcgtgcatggggatgttgatactagggcaaaacgtgttgcgttcttatgcataaacttggaacaaaa

SEQ ID NO: 1713 - DNA, 425 bp, Zea mays
  Clone ID: LIB3227-025-P1-K1-H10
ccgaaactggattcggaacattgagcaacatgcctctgataatgtcaacaaaattttggtgggcaacaaggccgatatggacgaaagcaagagggccgtacctactgcgaaaggacaagcacttgctgatgagtatgggatcaagttttttgaaacgagtgccaagacaaacctgaacgtggagcaagtgttcttctccatcgcacgtgacatcaagcagaggcttgcagagactgattcaaagccagaggacaaggcaatcaaaattaacaagccagaccagggttccgaggcaccagctgcccagcgatctgcatgctgcggttcataagcagacgcacgatagccataatcattggttatttgacactatttatttcctgcttggcttttataggaagaatctgaggaagccacttatgata

SEQ ID NO: 1714 - DNA, 336 bp, Zea mays
  Clone ID: LIB3227-025-P1-K1-H11
ccgagtcggtcctgtgtgagaaccaaacggccgggcatattgtcattgcgtgggggcagcattcgctgatactatgtaatgtgacctgagtgagctgttgtaacctgttgtgggcatattggcaaagcgattctgattgctgtcgaataaaaaaaaagtaataaaacaaaaaatgaacgtaaaaaaagaaaacttatacgggcggccgttcacgatattccgaattcgttcaaactgatgaacactttttcctcgtcccatacaagccaatcgaagccgagatacgaccatggactccaccggctccggaacagggggtaaggggaagaaaggagc

SEQ ID NO: 1715 - DNA, 416 bp, Zea mays
  Clone ID: LIB3227-025-P1-K1-H12
cccacgcgtccgcaaatccatggcgtgcctgttgactgggcattgggtgctttcattgtgcagacgacgatgaacagaacagagtggagaaaacctcgtctgaagacgatctacgatatggagaaaggcaggtacatcataacaagggtcagccaatgagtcgcgcacatcagcgttgggagtgggtggactttctgcagcggagcactattgaccatgtatgtagattttcctaaattgatttcttacttagtggccaactacctccagcatgttgccttgcggagtcaacttgttgagtttgagcagcaacccctgtatatgatagaaggatgcgggttgccgtggcatttgtgcatgttcagtgttgtatgtaatgttgctaaactgttgttgatgtaattagaattttgtgc

SEQ ID NO: 1716 - DNA, 420 bp, Zea mays
  Clone ID: LIB3227-025-P1-K1-H2
gacggcaaaggaggcggagccggagccggagccggcggcggctgaagaggtgaaggaggaagcggcagcgcccgctgccgagacagaagcagaaccggcagccgctgagcccgaggctgctgctgctgctgaggagcccgcggcggctgagccggccgctgaggagcccgagaaggccgagccggccgctgaggtggccgagaaggccagcgagtgaggccgtgcgccgtacgcgcactgcggcggcggacagcgggtcgggagatcgatgtctcaacgtgcgcgcgtggcgtgccagtcgcgtcgcgcgcgctggcgcctactgttcagtacaacgcgaacgcgacggtttctcttcatctcttcgtgtgtgacagtgtgtgtgtcgtagctatagcagtgcccggtgcggactgcgag

SEQ ID NO: 1717 - DNA, 433 bp, Zea mays
  Clone ID: LIB3227-025-P1-K1-H4
ggcttacttacaagaatgttcctacgtggcatagggatctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctggtgatccgaaccttcactttgttgaagctgttgctcttaagcctccggaagttaccatcgacatggctatgcagcagcagcatgaagccgagcttgctgcagcagctgcacaacctcttcctgatgacgatgatgatctgattgagtagaaaggatcatgagtcttggacttgagcaggagttgtgccttgcacgatttaagttgttc

SEQ ID NO: 1718 - DNA, 420 bp, Zea mays
  unsure (1)..(420): unsure at all n locations; Clone ID: LIB3227-025-P1-K1-H5
tcagtccgagttttattagtacagaggaccgttatagatagtttgttagccactatagatgtctagcttagggaatccttcacataggcgttaggcctagaagcgagatattcaagagtggtagcgagatgccagggcacctcggcccaatgaagcttggcactcgctgtccgaacctgaggtcacgccatccgataataccgagagaccttgctgcgcaatatgacgccggccgaaaggcaancctgcacactctatctgatgataggaactcagaggcgtcagaataattacatatgctgtgtaaccggttagcatctgtgccgttaaacaatagtcatgtgtcaccatgcgatatgttgtttagttagctcgcttggagtgtatgaatgaactgaagcttcataaccataatcattg

SEQ ID NO: 1719 - DNA, 429 bp, Zea mays
  unsure (1)..(429): unsure at all n locations; Clone ID: LIB3227-025-P1-K1-H6
nnccnnnccnttttatatatacatacgacatgccaacggttaaacaacttattagaaatgcaagacagccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggccaaaaagccaaaaaaaataagtgattcgttttagcccttataaa

SEQ ID NO: 1720 - DNA, 412 bp, Zea mays
  Clone ID: LIB3227-025-P1-K1-H7
ggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgc

SEQ ID NO: 1721 - DNA, 378 bp, Zea mays
  Clone ID: LIB3227-025-P1-K1-H8
aacaaatcccatggaagttttgaaggtgatctatcttgatatgaactcacttcagaagcgtgacttgttttatgtactggatctgaactgaacaacatactgtaggtgaggctgcagatgagtaaaagcagtaccagtacaataagagagatgagaaaagttatagcgcacgaagggtttaaagcactttggaaaggagtcggcccagcaatgacaagagcaggttgccttactgcatcacaaatggcgacttacgatgaggccaaacaggccttaatgaagtggacaccacttgaagaaggttttcagttacatctcatgtacagtgaattctctatttctctattatgatgtgtatcctttaatgagatgaatgga

SEQ ID NO: 1722 - DNA, 398 bp, Zea mays
  Clone ID: LIB3227-026-P1-K1-A10
cttggatttgtaatttgtactacttcaattgggttatctggcctgctatttgatttaagatgtatgtaacagtgaactctataaatatttgacactgatgcttgcatgattaattactttaattccaattaatactgccacaacctattcacatatattttggctattagaataacaaaattctttttctttttaaaagaccagaataacaagaattattgaaattttatagcctagcttcatctctaggtaaagaagaaattgttaactaatagcaacctctgggtgagtgattaactaggacatgacctacatgtaagtgagtttgagaagaaatgattacctgttctgttcatgcaactactgaattcagaatttacatagaggagcaatttagt

SEQ ID NO: 1723 - DNA, 411 bp, Zea mays
  Clone ID: LIB3227-026-P1-K1-A11
ggataaagaagaagaaggggctgagattactcgcaagaaaagttccaaccgatcgtctacttaaattcgaacgggttttcaaagcacaaaaacgcatacatatgtctgttttcaaagcacaaagagttctagatgagattcgctggcgttactacgaggaaaccgttatgatactgaatctcatgccttatcgagcatcgtatcccatcttaaagttggtttattcggcagcagcaaatgctactcattatagggatttcgacaaaacgaatttattcatcactaaagccgaagtcagtaggagtactattatgaaaaaattcagacctcgagctcgaagacgtagttattctataaaaaaaacgatgtgtaatataacaattgtactaaatataggtaagaaatcaaaat

SEQ ID NO: 1724 - DNA, 239 bp, Zea mays
  Clone ID: LIB3227-026-P1-K1-A12
aataatctcttcttcacctcactaacaccagctagcaactctttctctcctgcggtaatggccgctcgctcctcctcctcccagccgcagctggtcgcggcggcggcggtcctggcagcggcgctgctgctgctggcggcgggggccggcacggcgtctgcggcggtgagctgcggcgaggagacgttttcgggggcgccgtgcctcgggttcgcgatgggcagcgcggcttcgccctc

SEQ ID NO: 1725 - DNA, 296 bp, Zea mays
  Clone ID: LIB3227-026-P1-K1-A2
gccgcgcacaaatgctaagatcacgctcaacgctcgccccaccatcaagaatcggaactaggagctagctgctactagtgctcatcaagcacactgtacgtacgtacgtatgtactcgatcgcgtggtcattcatcgaccatcatcgtttatatgctgtcacgcacagtgcgggacggccagtgttgcattattgtgtgttttatttcgcatggattaggatcgagccgcgccaatggtagattctacggaataaatataataacattgttatgattgatatcattatgttttaaa

SEQ ID NO: 1726 - DNA, 414 bp, Zea mays
  Clone ID: LIB3227-026-P1-K1-A3
gtcagatcacagaatgtttctcatgaaagtttgttcaaggaaacagcttcactcatggtgtcacccatctttctaactttgttcattggttatcgccgctctttattatattgctttacacctaagaccaggctattccttgtcattttacaagttatatgcctgctaaacatgacgagtaccacttaagtcggagactgcaaggccatcaaactgatgttattgcacattagctgatcagataacttgtaaaatgacaaggaatagcctggtctgaggggtgggtggcggtgtgtgtgggtgggtgctttgatgcctatcagttgggacggttgttgaatgacatgtctgaaggtggataggtcagaccactaatgtttcccattgaaagttgtttatggaaacagcttttct

SEQ ID NO: 1727 - DNA, 238 bp, Zea mays
  unsure (1)..(238): unsure at all n locations; Clone ID: LIB3227-026-P1-K1-A4
actttgtagtatggtagtagtagtgggtgggttgggggggggggggggggggncatggcatacaggcacagttcccgcaaaggttttgttacagcttacgaccgcattccgtgatggctgattgcgcaacaggactgtcacattttttttcaaagagcatctgaacaaaatcaaggtcccagtgctttgtcttgctggagacgaggatctgatttagcccccataagctgtttatgaa

SEQ ID NO: 1728 - DNA, 411 bp, Zea mays
  Clone ID: LIB3227-026-P1-K1-A5
gaggacatgtattcgaggagatgcaaaggcctggtaccccgctctacaacatcaaggctttcctccctgtcatcgagtcctttgggttctcaagccagctgagggctgcaacctctggtcaggcgttcccccagtgtgtgtttgaccactgggacatgatgggctcggatcctttggaggctggctcccaggctgcccagctggtgctggatatccgcaagaggaagggtctgaaagaacagatgactcctctttctgagtttgaggacaagctctaatcttttcgtttttgctactgttactggttttaattgtcactcggagtctgggaactatttatatcttgtttccttttagttgtcaagtgcatgtttctgaacatcattggtcatactgtactatccaagtgct

SEQ ID NO: 1729 - DNA, 409 bp, Zea mays
  Clone ID: LIB3227-026-P1-K1-A6
gcagccaccaaagcagcagcagcagcagctcctcaacaagattcaggccatgatgcaccgcatgggcagtcttcgacagccaaggcggacatggaaatcgatggttgatttgtaggttccagagtggcaagaaagggaatcccctctaatcattatgtatactgtggtcagaatgtccgctatatattgtaacatcaaagaaagcacctccaggcctgagggtgttactgctaatgcgtttggtttacttgtccttgtaatatgcatacacatttagaactcatgcagccattgtgtgtgctcgaaccggtggatcgctgccctgttgtgttgtactactgtgtttagggccttgttggatacgaatggttaattataagacggggctaaagataagtcccgattagct

SEQ ID NO: 1730 - DNA, 419 bp, Zea mays
  Clone ID: LIB3227-026-P1-K1-A7
cagcaagcttagcacgctgaggtttgctctcgcaattgttgttctctcagtggaggctacaattagtgtgcgagttcgtggtgggtcatggcctgatggtctccgtgcccagtttgctgcccacacggtgagtataggtcgtgaggaagttgtcttgcttgattctggggacgataaactgcctgtttctgatgatggcactatcacacttggtcgtcgagttgcatctgttgaagtgagtggggagctgaacgtttctgtcaaggcatggcaaggtggtgaagtctttacgcacagagagaggggtttcaaacctaaagaggcaggttggagttatggcactcttgacgttggcttctgccaaatggatgtatctgtggcctggtcgcttctttcgtcgtacggtgaaaatgaagctt

SEQ ID NO: 1731 - DNA, 371 bp, Zea mays
  Clone ID: LIB3227-026-P1-K1-A8
acgcgtccggaccaagcttagcacgctcacgttaactccgcccaacgatgaacaatcagggaggagcgaccatgtttgtactaggcccatcaagcacactgcccgaacgtacgcatgcccacgttcgtgccgacactcatagtccatcatcggtgatatgctgctaggcacagtgcgggaccgacagactggcattattggatgatggatctctcatggttgaggatcgagccgcacctatggaagattgtacggaacaaatataataacatagtgacgattgatggcattatagtctaaaaacaaaaaaagagacagggctaccgtaataatggatccaagctttcttgcactttcatactacgtttttg

SEQ ID NO: 1732 - DNA, 387 bp, Zea mays
  Clone ID: LIB3227-026-P1-K1-A9
cccagagcggagaagagcgcaagatgttcggcttcgggcaccacggccaccacggccagaacccgccggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggcgacgtgggca

SEQ ID NO: 1733 - DNA, 199 bp, Zea mays
  Clone ID: LIB3227-026-P1-K1-B1
gccttctgtacacgcaggtgcaaccaggcctgctccgcatcctgctctagtaatggaactggtcgtcctagctgttgttcacaactggatcagatgaaaaagaaggtaaaaaaagaagggccgacgctctagaggatcctggcttacgtccgcatgcatgcgacctcatagctcttctatcgtgtgacctaaatgcaat

SEQ ID NO: 1734 - DNA, 375 bp, Zea mays
  Clone ID: LIB3227-026-P1-K1-B10
ctccaagctccgcgccgcgcacgacgccgtcgtcctccacaactgccacctcgagaccgagctgctgaagatgaaggacaggctggcggaggtggaggaggagaagacgaagctcgtcgcggcggcggcggcggcggccggcggcgcatcgggcgcagggagcagcagcccgagctcgtcgtcgttctcgacggtgacgcaccacccggccgcggcgctgcaggtggggcagttcggggtggagccggaggaggccgccgacctcgcctacatgaccgagtacgcctacaacagctacatgaacatgatggacctcgcgcccggctacttcggcggagtcgtctacgactacgaccacttcaactgatccacgag

SEQ ID NO: 1735 - DNA, 409 bp, Zea mays
  Clone ID: LIB3227-026-P1-K1-B11
caagcctagagggccagattgtcgctcttgcgatcactgtgtccatcgcgctcctgcaagagcgacaatcaagcctagagggccagatctgatcctggcgcccccatattgggcatctgatgcaaggtgcaaagactggtgtttggtctgcggttgctttcaaggagttgtgtgccggttgcttgcacatctttaactctgggtctgaagagcaaatcagaagtatttatggtttaggaaatatgcacctgctttgctggagaactttgtcctgctatttatttatagacacttctgatctacaggaaggcggccattcctcactacctctctttgcccattgtctacatttatttgttctactagtagattagggactacagatgtactcctgcagatggttaatttg

SEQ ID NO: 1736 - DNA, 367 bp, Zea mays
  Clone ID: LIB3227-026-P1-K1-B12
aaaatttcatggtcaggatgaacctgtggcaaggattcttgagctctgcattctacatattgctatggctgagatggcatcaaaaggaacaccccacaaagttgtcattaatgaggcagtagatctggcaaagcgattttgtgatggtggtgcccctcgggtaatcaacggatgccttcgaacatttgtgaaggatcatgttgatgttgcaggcacgagccaggaagctaaatcaaaatcatgattttttgcaaatactcatacaacaaaatggtggctgaagtaaagaagtacggagagaacctttctgtcttgagttcaggcgaataccttctgtctccaaggtttaaccttcaacctaaaggaa

SEQ ID NO: 1737 - DNA, 407 bp, Zea mays
  unsure (1)..(407): unsure at all n locations; Clone ID: LIB3227-026-P1-K1-B3
cttatttcttgctgaacgccgagaactaccattggcaatggacgtcgttttcttctgcagcgtcaaccgctctgtacgtgtatctgtactccatctactactaccatgtgaagacaaagatgtcaggcttcttccagacaagtttctatttcggctacacgctgatgttctgccttggcctaggcatactttgtggagctattggctatctagggtcaaccctttttgtaaggagaatctacaggaatatcaaatgtgattaaatccttgctgcttaagctagcaacagaaagatcatatgtattgtcagtggaggcatggcctaaaaaaatggattttaatggtagaccctgattttggaattgctgaggactngctccccttttgttcgttgttatacgcatttt

SEQ ID NO: 1738 - DNA, 371 bp, Zea mays
  unsure (1)..(371): unsure at all n locations; Clone ID: LIB3227-026-P1-K1-B4
aaggagtcatcaggatcctcttgaagatgaaattagcagtcatgagatctttggcttgttttgtgtagtagcagcattagggcacctggagcattcgcatgtgaccgacagtgatgcaaccagtgcaaatcctgtagtcttcaaaactgatggtcaaggccgctggcctccaaacccaggtaatctcttgaaaaggatctgggttataatttttgactgatgggcagaacaatttgtagcactgctgatgccaaagttttctcgatcataaatgtgcaagtttgctccctgacttaaaaaaaaaaaaaaattaaaaaaaaataaaaaaaatatttaaattattttttttttntttttttttatattttttt

SEQ ID NO: 1739 - DNA, 416 bp, Zea mays
  Clone ID: LIB3227-026-P1-K1-B6
cttaaagccagagaacattttacttcatagagatgggcacatttcattgacagactttgatttgtcttgcttgacatcctgccgaccacaagtgtttcttccacacgatattgataagaagaaaaagaggaggaagagcaggagtaatcccatatttttcttcttatcaatatcgtgtggaagaaaaagaggaggaagagcaggagtaatcccatattttttgctgaaccaatgcgagcatcaaattcttttgttggtacagaggagtacattgcaccggtatttatatatatatgtaatatgttggtgctccactttatctatgtgattttccctaacattttcatttcttgtctctatttgacatgtgtgatagtcatcatctgttttatcaatccttgtattgtatgcatgct

SEQ ID NO: 1740 - DNA, 415 bp, Zea mays
  Clone ID: LIB3227-026-P1-K1-B7
aaaaaattcaatcagcacttaaagagcaggaaattttttctcaaagaactggggagcaggacgtcgatgaactgaaggaagaagtgcaagaagcacgaagagtgaaaatgctgcattgcccaagcacggcaatggacattgagaacgagatccaagttctgcgtgatcaactggctgaaaaatcttcaaattctcttcgccttttgaaagagttggagctgcatcgaagttacggggaaaatgacatgccctcgtatgaattaaagggtctagaaaccttacgctcaacgttgcacatagttggtcacgagtgtgcctctgtagatttctcgaacagttcaatccagtggtttcgcatacagcctgaatgaagcaagcaagaaattatttcatgcgccacaaaactagtatatgc

SEQ ID NO: 1741 - DNA, 396 bp, Zea mays
  Clone ID: LIB3227-026-P1-K1-B8
cttggaggccttagctttaggcgaagatgagatgcctgatataaaggatgagaccctgcctgacgaagaaggcttgtctaagccaggggtagccaatgctattgaggaattcaagacttcagtctatggtgaaaattatgaccaagaggaggcagaagcggcagcagggaaagcttcccgtggtaatgcttcaaaaaagcggaaggaggtcactgatgcatctgcgcagataagtgctgcttatgactgggcagaacttgcagacaatggaaaactgaaggaaatgaccacggtggtattgagatcctacctgaccgcgcatgatctcccggtttctggtaagaaagaggtacttatcagcatgatcttgactcacctgggtaagtgaagcccggg

SEQ ID NO: 1742 - DNA, 307 bp, Zea mays
  Clone ID: LIB3227-026-P1-K1-B9
ctttcagctgctcctttggtggcactagttggatttggactgtatgagctgggatttccatcggttgccaaatgtgttgagattggtctacctcaactcatccttcttgtgatctttacaatgtacctgccacatgctgttcacatgctgaagtctatcttcgatcgatttgctgtcctgttcactatacccatagtgtggctctatgcatatcttctcactgttggaggagcatacaggaatgcaccaccaaagactcaatttcattgccgcactgaccgttctggattaattggtggcgcaccct

SEQ ID NO: 1743 - DNA, 317 bp, Zea mays
  Clone ID: LIB3227-026-P1-K1-C1
caagccacgactggcttgggctctccggccgtggcggacgacgcttctcctcgctgtgattgggtggacaaacccagccagaattatcgtgaatccgagctcgtttcggccaaaagaaaagccgcccgctcttttgtgtctgcacgagttaggtattatagctatgctgccgacgcttaatccaggctttcccgtctctcctcttctgtcgaacgagacagaccgggttatgtagcctgccttgctttcggcaagagaggaagaggcggatgagatcagggcaatgggcgaggctaacgcgcttggccagcctgacg

SEQ ID NO: 1744 - DNA, 199 bp, Zea mays
  Clone ID: LIB3227-026-P1-K1-C10
cctctctcgcatcctcatcctctcgagctctactccatcccctcgatctgtagtcgcatcatcatttttcaggcggccatggacgccagcgcatcaagagccgtcggagaatgcgaagaatggctcggccgttcgcaaggccttcggaccgatgaagaagtcggtgactaggtccttcaaggccgtgctgtatttcccc

SEQ ID NO: 1745 - DNA, 184 bp, Zea mays
  Clone ID: LIB3227-026-P1-K1-C11
cgcagagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaaggaaaaaaggcttctacttc

SEQ ID NO: 1746 - DNA, 416 bp, Zea mays
  Clone ID: LIB3227-026-P1-K1-C3
gctctatgctatcggtggtgtctgcatcaagccggtgctcgtgcttgcgctatggatcctctactttctgttccccttgatctcgctcccgctcctccacccgatccagatcataatccgcgcggacgccgtgcgcatgcagctgctcgggttcataatctgcctgttcgtgtccggtgccgggttctacttcaagagccacaggtggagggctgcccacatcatcgtcatcgccctggtccagagcaccgccaatggcatactgtacgcgttcggccgcatcctgctcctcgatgcctcgccgccagggaaggagggtgcgttctcggtctggtacgcgtttgttcgtgtcaccggtgccatgatcggcttcgctgcctcctccgctggccctgggcgcgcgggagggtcctttg

SEQ ID NO: 1747 - DNA, 340 bp, Zea mays
  Clone ID: LIB3227-026-P1-K1-C4
gtgccatctaacagatggaactgcccatctttaagggccacctctaaagagggggggagaaaaaatcttcttgttgctccaaagcccaccgcttgcactaattagatacttggcaacaaagagtgttttgaaccctacacgtctaatatatacagtcgacgtgttctaagtggggaatttgttgtggtcaacaaacatcttcttcatgatctgactgaaatgggcatttggactcctaccttgaaaaaccaaataatatactatgaccgttctgtccagaagataacagataatccggacgatcttaaagcaatttacaaaactttttgggggatcaagc

SEQ ID NO: 1748 - DNA, 385 bp, Zea mays
  Clone ID: LIB3227-026-P1-K1-C6
attgcttgactgccactgatcatgatatgcctatattgcttgacaaaccgatacagggggtcctggtcgatcttacagatggcggcgtggattacagctttgagtgcattggaaatgtttcggttatgagggctgcactggaatgctgccacaagggctggggaacctccgtgatcgtcggcgtaggcgcctctggccaggagatcgccacacgaccattccagctcgtgactgggcgtgtctggaagggaaccgctttcggtggcttcaagagccggacccaggtcccatggcttgttgacaagtacatgaaataggaaattaaggcggtcgagtacatttcgcacaacatgaacctggctgacattaacgacgcctttcaact

SEQ ID NO: 1749 - DNA, 416 bp, Zea mays
  Clone ID: LIB3227-026-P1-K1-C7
cgcctggtgatgggcgtcgaactggcgcaaccgaccgccgccgcggctgcggtgaccaccgctgagcaggctcaggatctcatcgacgccgctaggtacgacgacttggaggacgtcgtcgccctgttctccgctggtgtctcgctggactccacagattcgcaaggccgcacagctcttcacatggcttctgccaatggtcaccttgctgtggtggaatacttgattcaaaatggagcgaatgttaacgccaccaacatggagaagaacacaccactccactgggcatgccttaatggacgtatagaggtaatcagggctttgatctcagcgggggctagcgtgagtgctctgaacagccacgagaaaacgccaatggacgaagcggtgaccacaggcaagatggacgtgatcgg

SEQ ID NO: 1750 - DNA, 415 bp, Zea mays
  Clone ID: LIB3227-026-P1-K1-C8
gtcgcagttgctggttgctttgctccccacatttgtcgacggtcgccgtcgccggttcctcgtgcaacgcaccgcgctaacgatggccgagacggtgggcttcgcgagcggcgacgcggcggcgtggcgcgcagcgctggccgcgtacgaccgccgtctcgcggccctagacaaacccgacctcgtggccgtggactccttttaccgccacgacctgcccgcgctcctgcgctgccgtgacccggatcctttcctcgccaagcccgagctggtgcgcctcctccagtggaagctctctcgcggcaagtggagaccgaggctgatggatttcgtcaagggcttggacgacgccgtggtggagtcggcgtcgcgcaaggcgttcgcggctttgcccgacctcaaaagggccatcacc

SEQ ID NO: 1751 - DNA, 407 bp, Zea mays
  Clone ID: LIB3227-026-P1-K1-C9
cctctctcgcatccgcagcctctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagct

SEQ ID NO: 1752 - DNA, 389 bp, Zea mays
  Clone ID: LIB3227-026-P1-K1-D1
cgttcacttcgtttccttacaatcaaggactgcccaggtttcaccaatgcaagcttggccgtggtagggatgatttgccctcagttggagcaggttgacttgagtggtcttggtgaggtcactgataatgggcttcttccattgatccagtcttctgaatctggtctgatcaaggttgacttgagtggttgcaagaacatcacagatgtggctgtctcctctctggtgaagcgacatggaaaatctctgaagaaagtcagccttgagggttgcagcaagataacagatgctagcctcttcaccatgtctgagagctgcaccgagcttgccgagcttgatctttcaaactgcatggttagtgactatggtgttgccatgctggcatctgc

SEQ ID NO: 1753 - DNA, 83 bp, Zea mays
  Clone ID: LIB3227-026-P1-K1-D10
aaaaaaaaaaaaaaaaaaaaaaaaaaaaaaaaaaaaaaaaaaaaaaaaaaaaaagggaaaaaaaaaaaaaaaaaaaaaaaaaa

SEQ ID NO: 1754 - DNA, 382 bp, Zea mays
  Clone ID: LIB3227-026-P1-K1-D11
cccaaggcagaagtgctgatcctcaacttcgcgtcgagcctgtactacctgccgccgttcatcgcgacgatgcagaacctgaaggccctggtgctgatcaactacggcagcggcagcgcggccctggacaacctctccgccttcaccacgctgagcgggctgaggagcctgtggctggagaagatcatgctgccgccgctgcccaagacgacgatcccgctgaggaacctgcacatgatctcgctggtcctctgcgagctgaacagcagcctgagggggtcgacgatggacctgtcgacgacgttcccgcgcctgtccaacctgacgatcgaccactgcatagacctcaaggagctgccgccgagcgtctgcgagatcgggt

SEQ ID NO: 1755 - DNA, 416 bp, Zea mays
  Clone ID: LIB3227-026-P1-K1-D12
agctaatccttcacagcttacaattttctatggcggatcagtatgtgtgtatgactcagtgccaccggaaaaggctcaagcaatcatgcttatagctgcagctgcagcggcagcggcagctaccaaaagcagtgctgcccctactgttaagcctccaatggtgcctgcagccactgttgccccagcagctgtcgtttctcctgtgcttacacggtctccatcactgcagagcacttctgtagcaactgggcaacctcaggttgttgctgaacctagctcgatatgcaaacttcaggctgatctccccattgccaggaggcactctcttcagcgtttccttgagaaacgccgtgacagggtcgtgagcaaagctccatacagcaccgccaagtcgtccgatggcatggagtcaccga

SEQ ID NO: 1756 - DNA, 426 bp, Zea mays
  Clone ID: LIB3227-026-P1-K1-D3
aaaaaaaaaaaaaaaaaaaaaaaaaaaaaaaaaaaaaaaaaaaaaaaaaactaaaagaagaaaacaaatctttccttagattcttcattaaaaaaaaaaaaaaaaaaaaaacaaactttaaaaaaaaaaaaaaaccttctagcggcgggcctttttagggttccaattttttttccccgtttttgccaaagtttttcttttttttttggccccccaaattaattttcacggccctgttttaaccccccttatactgggaaaaccccgggcgcccccctaataatgcggttgaaggcattacccgctttagctccgtggttgttgcggtcaaggccccccctctttccctttttccaactttttcccccccttttttgaatttggtccccccctttttttccccctttttgcccggtgtttttgttt

SEQ ID NO: 1757 - DNA, 410 bp, Zea mays
  Clone ID: LIB3227-026-P1-K1-D4
cgacgctctctgcaggctcgcggggccggctggccgcctttccaatctaaccttgtctggcaactactttgtcgccgtcgggccggcatgcgcagcgctgatcaaagacggcgtcctggacgtgaagaacaactgcatttcgggctttgccaaccagaggccagcggcggagtgtgcggttttccagagccatccaaagacgtgcccggaggaggcaagcactcaggtgtcatgccctgccgcagctaccatgcacatgaacgctgcgccgccgagggatcagcggaagaccaccagggactactacagctacgtgacgtacgctagcctgcgttagtgaggcgccacgtacggccatgcaatgacgcgccaccagtgcctatagctggaacttggctatatatgttatc

SEQ ID NO: 1758 - DNA, 406 bp, Zea mays
  Clone ID: LIB3227-026-P1-K1-D5
caacgatagttggtcagatgatgactggtcaggcggtgggagaaaatcaaaccgttcctcatcctttggtggccgctcatcatcctacggcagccgtggttcaccatcaccatccttcggtgtccgctcaccatccttgggcggtagggagagcagaagcttcagtggcgcttgtttcaactgcggcgaatccggtcaccgtgcatcggactgcccaaacaagtagatggcgcattcttccctgcccaagcaagtagacagctggagcatcaggacgcacgcagagcgaaaacccaagcgcgcccctgatcgaccagtatactacgcctgacagccagctacagtttttgtgtggctgtctcgtcgggactgaagattttggcatgctgattccaggtatttagat

SEQ ID NO: 1759 - DNA, 409 bp, Zea mays
  Clone ID: LIB3227-026-P1-K1-D8
gccaaccgcaaccagactccagagagagagagagagagagccacacattgcaagcttccaccatttccaagaacaactgccactgcagagagctcgtacaggaagagatggagatgcacatggacgacaagagcaagacgccgctttccaagaaggggagccggaggtcggcgtcggcgtcggcgtcggcgtcggcggggctgaagagccggccgtccagggccgccgcgggcaggtcggtgccgggccgcctggcgggcctggtgaaggagcagagggccaggttctacatcatgcgccgctgcgtcaccatgctcgtgtgctggagggactagctcgtgcaagcggtgcgcatctatccatggccgtagcgcgtaggcccccccaccacgttcggtggatgtgggct

SEQ ID NO: 1760 - DNA, 374 bp, Zea mays
  Clone ID: LIB3227-026-P1-K1-D9
ctagctctctgtctcctgctcagagtcgcagttcgctttgttgtactagagcgctgagcagatctttccttgtttcttcattccggtacgaaggggaggggtccaagtgaagagaagagaaggcctgcgagcgatgggcatcgtcgacgtcgtctccgagttctgctccttgccgaggactcgccggcatctcaagaagaggaagcagttccagacggtggagatgaaggtgcgcatcgactgcgaagggtgcgagcgcaaggtgaagaatgcggtggagggcatgaagggcgtgagctccgtggaggtggcggccaagcagaacaaggtgacggtcacgggctacgtggacgccaccaaggtcatgcgccgcg

SEQ ID NO: 1761 - DNA, 121 bp, Zea mays
  Clone ID: LIB3227-026-P1-K1-E10
cttagagacttataaagttagctatccaatcttctggagaggctgatcctcacatgtttcattttaggcattatctattcggagattcatgggaatgtatataagttgaccttgtcatata

SEQ ID NO: 1762 - DNA, 364 bp, Zea mays
  Clone ID: LIB3227-026-P1-K1-E11
gatggcgtcaatacatacaagtcaatgtgcagggacagtaggataattcctggtgctgctgcaacagaaatagagctggcaaagagattgaaggagttctctttgaaggaaacagggttggaccagtatgctgttgcgaaatttgctgaaagctttgaaatggttccaagaaccctggcagaaaatgccggacttagcgcaatggatataatatcctctctttatgctgagcatgctagtggcaatgtgaaatttggcattgacctggaggaaggtgcctgcaaggacatcacgaccttgaaaatatgggacctctatgtcacaaagttctttgccctaaaatattctgccgatgccgcatgca

SEQ ID NO: 1763 - DNA, 398 bp, Zea mays
  Clone ID: LIB3227-026-P1-K1-E2
aacgaaagcttatgcaattgatgcaacaatggtctgagtggcaggctagaaggatgcaccatttggaggaagctgtggaagtgaccttagaaagtggtgaagagacttattatcctgcattacatgttggttctgagaaatcttgtgccgtgtccttttgggtggataaccaagcaagggaaagtgatacagtagatgatggttctgttccactgtatgaccgggagtttaccttgcactcgactcctctgggtggttcatcaaacactgaaagggtggataaggacgattcacgctgcttcaattgtggttcttatagccatgctatgaaggattgcccaaagcctcgggacaatgttgcaattagcaatgcacgaaaacagcattaatttgaaaag

SEQ ID NO: 1764 - DNA, 410 bp, Zea mays
  Clone ID: LIB3227-026-P1-K1-E3
cttggatggtttgaatggtttcgatggcaccgatacacattacttccatggtggtccacgaggccatcattggatgtgggattctcgcctattcaattatgggagttgggaagttttgagatttctattgtcaaatgcgagatggtggcttgaagaatataaatttgatgggtttcgatttgatggggtgacctccatgatgtatactcaccatggattacaagtgacattcactgggaactatggcgagtattttggatttgccactgatgttgatgcagtagtttacctaatgctggtaaacgatcttattcgtgggctttatccagaagctgtatccattggcgaagatgtcagcggaatgcctacattttgtatccctgtccaagatggtggtgttggttttgatt

SEQ ID NO: 1765 - DNA, 344 bp, Zea mays
  Clone ID: LIB3227-026-P1-K1-E5
ggctgctgggcgaaagctaggcggcggcgggccgaagaggaagccggtgtcgcggtcagttaaggccgggctccagttccccgtgggccgcatcggacggtacctgaagaaagggcggtacgcgcagcgcgtgggcacgggcgctcccgtgttcctggccgccgtcctcgagtacctcgccgctgaggtcctggagctggctggcaacgcggcgcgcgacaacaagaaaacccgcatcatcccgcgccacctcctcctcgccatccgcaacgacgaggagctcggcaagctgctgggtggggtcaccatcgcgcacggcggtgtgctgcccaacattaaccccg

SEQ ID NO: 1766 - DNA, 392 bp, Zea mays
  unsure (1)..(392): unsure at all n locations; Clone ID: LIB3227-026-P1-K1-E6
caacgtccaaaatccagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgcaccatggccgacaaggtgaacgagaagaccgtgcagtgcacggacccggccgggcagcttncgtgccctctggtg

SEQ ID NO: 1767 - DNA, 264 bp, Zea mays
  unsure (1)..(264): unsure at all n locations; Clone ID: LIB3227-026-P1-K1-E7
caacggccaaaagccagaccgctggnaggagcaacccggagacacagaacaggggcggcaaggcgagcgccggcgccacccccaacccccacaacaaggcgcccgcagcaggcccgcccaagaagaccaccgccgccagganccggcgccacacggcaacaggcagggccagcaacggcgaagacggcggccagggcggcaaaaaggagggccacccgaggcaagacccagccaaaacgnagaacaaaaacggccaagaccagg

SEQ ID NO: 1768 - DNA, 412 bp, Zea mays
  Clone ID: LIB3227-026-P1-K1-E8
gttctccgcctccgcctcgagcggcagtgacgagcccggggagctgtccgaggatgaggcgcagagggagtgggaagcggagctgaatcgccgactgaaggaggccgaggagatggaggagttggagcgcaccgccgagcagctgcaaagccaggccgccgccgaggcccccgaggagtcggaggaggagaagcgcgagcgtgtccgccgcgagctccagaaggtagcgaaggagcaagcggagaggagggagacggcgaagcaaatgtttgagttgggtcaaaaggcgtacgggaaaggaatgtatggacgatcaattgaattcttggaggctgcgctcactatcatacgtccctcctctctactcggtggcgaggtatgctggaacatggagtgacaaaatcaaggaaca

SEQ ID NO: 1769 - DNA, 314 bp, Zea mays
  Clone ID: LIB3227-026-P1-K1-E9
gttgaaaacggttccatttcaccgcattgttctcgtgggcataaaaaaaaagaaaaaaaataaataaaaaaaaaaaaaaaaaaaaaaataaaatgtgcgggcgttctttatgttccatgctttcttacgcttgcttgcgtcgtatttgcttttttttattttcacctaaattcatttctttggccgtctttttacatcttactgacttgtatatccctgtctttacccatcttaatcactttgcaatacattcatcttttttcagctggttttttatctaatttgtcggcatttttcgccctttcctacttttt

SEQ ID NO: 1770 - DNA, 225 bp, Zea mays
  Clone ID: LIB3227-026-P1-K1-F11
gtccctcaagatggttaatacagcaatttcttgtttagtgctcataacattactccagtctccaggcgtagtgcttggtgtagagacataaaacagataatgcagcaccagtttgtggcttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatattaaattttt

SEQ ID NO: 1771 - DNA, 362 bp, Zea mays
  Clone ID: LIB3227-026-P1-K1-F12
caacattttattggatgacttgctatcctcgcgcccctctgatggtgggggggggggccttcttgcctaccaggaattccaggaatcagatgagaactcaggatacagggcacctgaggtgatcttggctggtcagtactccctgaagagcgacgtgtacagcttcggagtcgtcatgctagagcttctgactggccggaaaccgtttgacaggacccgaccgcggcctgagcagtcactggtccgatgggctactccgtagctgcacgacatcgacgcgcttgaccagatggtcgaccccgcgctgcaagggctgtacccgttcaaattcctcttccgctttgtcgatgccttcgcccttt

SEQ ID NO: 1772 - DNA, 400 bp, Zea mays
  Clone ID: LIB3227-026-P1-K1-F2
cagagccaggacgaagctgaagcagacggaggtggactgcgagttcctgaagcgctgctgcgagacgctgacggaggagaaccggcggctgcagcgggaggtggcggagctgcgcgcgctcaagctcgtggcgccgcaccactacgcgcgcatgccgccgcccaccacgctcaccatgtgcccctcctgcgagcgcctcgcctccgcgtccgcgtccgccgaccaggcgggccgtgcagggccctgctggggccctctccccgtgttcgtcgacggcccagcccggaggccgtgatccatgaccacgatatggcatgagatggatgcgcttgctaatcgcctaatcgctaccgctagctaagtagctagtgctaattagggctggatcttctttttttct

SEQ ID NO: 1773 - DNA, 420 bp, Zea mays
  Clone ID: LIB3227-026-P1-K1-F5
aggccatctatgacatctgccgccgctcccttgacattgagcgcccaacctacaccaacctcaacaggcttgtgtcccaggtcatctcatccctgactgcttccctgaggttcgatggtgctctgaacgttgatgtgaacgagttccagaccaacctggtgccctaccctaggatccacttcatgctttcgtcctacgctccagtcatttctgctgagaaggcctaccacgagcagctgtccgtggccgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggt

SEQ ID NO: 1774 - DNA, 418 bp, Zea mays
  Clone ID: LIB3227-026-P1-K1-F6
gctttgtgcaggtcaagggattgctcaaggagaagaaactggagagtctggtcgaccaagatctagaacacaactacgtcgacgttgaggtggaatctctggtacaggtcgcactcctctgcactcagagcaaccccatggaacgccctaagatgtcagaggttgtgaggatgctcgaaggcgatggtctcgccgagagatgggaggagtggcagaaagcggaagtagtacggcaagaggtcgagctaggccctcatcgaacttcggaatggatcctcgacttgaccgacaacctccacgctgaacagctgtcagggccgaggtgaaagcagctttggactcactgattcttgtatcttgcaagggcaatagcgatgtgtatcaatcatcctagtcaagaatcccccatttgttcata

SEQ ID NO: 1775 - DNA, 370 bp, Zea mays
  Clone ID: LIB3227-026-P1-K1-F7
ccgggcgggccccgtgtcggaggcgaactggggcctgttctacgggaacggcaccccggtgtacctcctgcacgtgtccggtgcggacgggttcctggggaacgacacgacggaccggaccttctgcgtggccgccgacgacgcggaccagaaggcggtgcaagcggccatggactgggcgtgcgggcccgggcgcgccgactgcacggcgatacagcccgggcaggcgtgctaccagcccgacgacgtgcgcagccacgcgtcgttcgcgttcgacgcctactaccagtcccagggccgcgccgccggctcgtgctacttccaaggcgccggcatggtcaccaccgtggatccgagtcatgacaagctg

SEQ ID NO: 1776 - DNA, 395 bp, Zea mays
  Clone ID: LIB3227-026-P1-K1-F8
taaagcctcaaagcataattaaagagaatgaattgtttcttcctggccggatgtcatttatttacaacatggaggagggagtaaccaatgatattccaacaactcttcataggagcaaagctgattgtccagttccagaggagatggtaactgtcagtgtggatggttcagtacttgaaagaattgctaaaattatgacataccttcggcttggatcatcagggaaggtcttgaagaaaaagaaaaaggagagagatataaaagggaagagcaatttggcaagtggtgactatggtgagtcagtaaaaccttcccaaactaatggttctactctgaaacatcaatcagatatgccaccaccaccggctccaccccctcagaacaataatttcaat

SEQ ID NO: 1777 - DNA, 411 bp, Zea mays
  Clone ID: LIB3227-026-P1-K1-F9
gagatggtgagcatgaacgagatggctgagatcgtgctgggctttgaggataggaagctgcccatccaccacatccctggcccggaaggggtccgcgggcgcaactctgacaacacccttatcaaggagaagcttggctgggccccgacgatgaagctcaaggatgggctgcggttcacctacttctggatcaaagagcagatcgagaaggagaagacgcagggggtcgacatcgcggcgtacgggtcgtccaaggtggtgtccacccaggcgcccgtgcagctgggctccctccgcgccgccgacggcaaggagggcctctaagcgacgacccagggctggggctgtcttcgtccatcacagctggcgtaccatggcaggatatactgtttgcggtagaatatcacagta

SEQ ID NO: 1778 - DNA, 421 bp, Zea mays
  Clone ID: LIB3227-026-P1-K1-G10
gtttgttaagcgtgcccgagctgccaagatccatgcttacataattggccatctgaagaaggagatgcctgcaatgatgggaaaagccaaggctcagcagcgactcatagacaacttagacgaggagtttgcaaaggtgcagagggaataccatctccccgccggagactttcccgacgtcgagcacttcaagcaggtgctgggcgggtacagcatcgacaagttcgagaagctgaagccgaagatggtgcaggcggtggacgacatgctcgctcacgacatcccggagctcctcaagaacttgcggaacccgtacgagtgaaactgacctgacctctcgcgtccgtcggttgtaaaaagattatcttagctgtcacgtccggtgatggcggacggacgaggcagacgttcctgggaggga

SEQ ID NO: 1779 - DNA, 417 bp, Zea mays
  Clone ID: LIB3227-026-P1-K1-G11
ctcaattctcatcttcgggttcgcgtcgcagcgtcttccgcccgggctaccacaatgccgaagcagatccacgagatcaaggacttcctgctgacggcacggcggaaggacgcgcggtcggtgcggatcaagcgggccaaggacgccgtcaagttcaaggtgcgctgctccaggtacctctacaccctctgcgtccacgactccgacaaggccaacaagctcaagcagtcgctcccgccaggtctgactgtccaggagatttaaggtatcaagccgcaaactgtgcctttttttgcggtgtcagggacgtttgctccagtgtttactttagtatgtaggtgggctccattgctgtgtttgaatgaattatgaagtttgagtttgggatgtgaatgatgtgtcgaacctatgagcatg

SEQ ID NO: 1780 - DNA, 419 bp, Zea mays
  Clone ID: LIB3227-026-P1-K1-G2
ggaaaagaacttcttgaagccaaaagaattgaggaacaaaatgaaaggaaacgcatgatagaattgcgaagacttgagaaagaggaggagaaaagagctagagaaaaaatccgccagaaattagaagaagataaggctgaaaggagaaggaaactaggattgccaccagaagacccagcagctgccaaaccaagtgcaccacctcctgttgaagagaagaagagtgcattacctgtcaggccagccacaaaggcagagaggatgagggactgtctaagaaatctcaagcaacagaataaggatgatgatgccaaagtgaagagggcattccaaacactgcttacttacattggaaacgttgctaaaaatcctgacgaggagaaatttagaaagatcaggctgacgaatgcaacatttca

SEQ ID NO: 1781 - DNA, 380 bp, Zea mays
  Clone ID: LIB3227-026-P1-K1-G3
catcgcagaggccgttcatgggtgaagttgtccaggcactgaagctgatctacaatgatccagatgaggcttgcgacgattcctacagtccaaggaattcatctgatcaagacggtgactacgaaggagacctggtctttgagagcggaagctggggctttggggcctctgggtgtctagactaccggaattccttaccgtttgtcactatggactacagttctggacgaatagaagggccgcacgaccctcgcgcggcattgtcagcgggatcccatgcccagtcaccagtgctgcagaatagatcaggccccttgcggatgaagaagaagctggccttcttctaccgctctagaggcagcattagcgagcatgggcac

SEQ ID NO: 1782 - DNA, 411 bp, Zea mays
  Clone ID: LIB3227-026-P1-K1-G4
gtcaactttatccggcaaattacaactgttgatggctactgcaggatgtccatattcttgtgttaaaagggcacctcatgtattttcattttcagatgatactggtacagctcgtgcaatatctcaaggtaatggagaagatgatcttgttcagctcgctgttgggcagtgtccaagaaagtgcatatactatgtgacgccttgccaacgcactattttggaggatgttcttgctagtgtgttgatggtgccttacgatctcgctgaagcagcagttctggattccctcctttcaaaagcgaagttcgagaataacaggtataagaagccccaaagaggagcaaaatcatcctccgattatgttgattggatgtgatctgatcccgagacacaaagaggatgccagattca

SEQ ID NO: 1783 - DNA, 315 bp, Zea mays
  unsure (1)..(315): unsure at all n locations; Clone ID: LIB3227-026-P1-K1-G5
atagagtccttcagaacaattaaaagagcctgacggttctcatttctttcaatctcaatagattgctatagcttgatcggtnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatggggggggcctttttaaagatccaaattttagtgcccgggtttggaaaataatatttttttttttggggcccctaaatataaaatcatggcccgttttataaa

SEQ ID NO: 1784 - DNA, 468 bp, Zea mays
  Clone ID: LIB3227-026-P1-K1-G6
aggtccgtccgatatcccggtcgtccccgcgtccgataaataaaaataaaaaaaaaaaaaaaaaaaaaaaaaaaaataaaaaaaaaaaaaagggggtaaattaaaataaaattaatggggggccttctttatttttattcccttgttttccttttttgcggcccttttttttcttcttttttggggcttctttttttttttttggggcccttttttttacggtttccctggtgtttctccccgggtcccctcttttttttgcgttttgcgattcctcctctgttctccgggcgttttttctttgtttctccgcgctttttttctttttttccttttttgttttttgttttttgtgtttttgcctcctttttttgttgctttttttctcgcggtttttggtgtggtcttttctcgcgtgttttcttccttttttgcctgatttttttccccctttcttttgtccttttt

SEQ ID NO: 1785 - DNA, 323 bp, Zea mays
  Clone ID: LIB3227-026-P1-K1-G7
gaagaggagctgagacggtgcgtcgcctgctgcgacatgatggtcgcgagcgcggagacattctagaacttatagcggcagctgaccgccactatgtgggacagcaactgtattagcaaaaacgctagcctgcggtgtctccaggcgcgctggcattgactataactcgacggaacgcacggcttcagggcgcgttacgcatcattgaaatttgtcacctataaaccttcgatggtatgataggggactaccatcgtggtgacggccgactgataatcttggttgaactccggagatggaacatgacaaacgggtaccacatc

SEQ ID NO: 1786 - DNA, 63 bp, Zea mays
  Clone ID: LIB3227-026-P1-K1-G8
aaaaaaaaaaaaaaaaaaaaaaaaaaaaaaaaaaaaaaaaaaaaaaaaaaaaaaaaaaaaaaa

SEQ ID NO: 1787 - DNA, 220 bp, Zea mays
  Clone ID: LIB3227-026-P1-K1-G9
gggatgcataccaagtctggggatgatgcctttgcttaaggtttttctaccttgctagaacatatctgtggttagaactttgtcagaactacgtgcaatctgtttgaatgcttcaaacctttgtggtggaacctttgtatgtttgaacctctgttgtggaagaactagtgtgctggaattgtgtatgacttgtgatgagaatgttgtgtatgatggcttt

SEQ ID NO: 1788 - DNA, 347 bp, Zea mays
  Clone ID: LIB3227-026-P1-K1-H1
cgccttcgcacactcagatgcacaatataatacacacacacacactcacacgacacacgctgtatacactggatcctaggtgttctttttagcttagctaggaatgcaaatttcttgattcgttggatggctttttttttttcctaccacgcggcgcggcaggtgcccatctgtctcgcacgcctcttcatacactctctcccctcctgtactcgactactgctactgcatgtagtggatgtgaagtacaaagaatacaacggagtatactagtgtagtctggcatgcatatgtaaactgctatactctgctttacgaaatggaaaaaacgtagattgtttgaaaaa

SEQ ID NO: 1789 - DNA, 420 bp, Zea mays
  Clone ID: LIB3227-026-P1-K1-H10
gaaaacctcacaaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatg

SEQ ID NO: 1790 - DNA, 426 bp, Zea mays
  Clone ID: LIB3227-026-P1-K1-H11
cccacgcgtccgacccgactccgccgccgctcccgctccgccccagcgcatcggccgccgccacagcgtaccgcgacctcatcgatcaccttcagctttcaatcatggccgacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcgctcatcaagaaactgcgcaaggcgaaaaaggatgctcctgctggtgagaagcccgagccagtcaagacacatctccgtaacatgatcatttgccctgagatgattggaagcattggtggggttctacaacggg

SEQ ID NO: 1791 - DNA, 284 bp, Zea mays
  Clone ID: LIB3227-026-P1-K1-H12
aaaaggaaaaaaatttttttaaggcctggccgatcccgtttcatgttcaagaagaacgaaattaggccttttgcccggaaaggggaagtttttcccatccccagactggtccaggttctttttttttcactcctcgctttaaattggaaacacacaactggttttttttaaacccctgcgactaactttaaacattcaacacggcttttgcttaattacgggggctggaacatttatgccaagccggttgaaccaaacggtccatgagtgacaaaaaacacgtt

SEQ ID NO: 1792 - DNA, 400 bp, Zea mays
  unsure (1)..(400): unsure at all n locations; Clone ID: LIB3227-026-P1-K1-H2
caggacttggtgaggcaggagatcagcaagaggcgtggagggggcttctccttcatcgtcgtcataatcgttgctctgatcggcgccatcctcggctacctgatgaagtcgtaattctttcaggctgtcctctgctggccataccagaggcagtcgtgcaagttgtgtttgggaagaactcgaaaaaaaaagactgttgaaaccagatgtcctgagatcatccttcatattttgtcgatataggagtgggtacgtgaggaatgctgggccagtgtttaagcttttcttttccttgttgtttctccgttggatgggcattgcggacgctgtaacttgaaagttgcattaattgcttctgtttcatagttttntaaattaacaaagaacaagtatcaaactt

SEQ ID NO: 1793 - DNA, 179 bp, Zea mays
  unsure (1)..(179): unsure at all n locations; Clone ID: LIB3227-026-P1-K1-H3
ggcggacgacagaagccccaccaacggcgggccccacgaggccaggcccgccgagcagggccggagcaccaccggcgacggcagacgggcggaccgagagaagcagacacacgggcgccaggacacgcacgcgcagggcaacgaacccggcacgggngaggcaccaaggcccgcaccaa

SEQ ID NO: 1794 - DNA, 426 bp, Zea mays
  Clone ID: LIB3227-026-P1-K1-H4
cgccatcccgccctgcctcacggcgctgtcgaacctccagttcctcaccgtctcccacaccaacgtgtccggcgccatcccggagtcgctggcgcggctgcgcggcctcgactccgtggacctctccagcaaccggctgacgggcggcatcccggcggcgttcgccgacctgcccagcctccggtcgctggacctccggcacaaccagctgacgggccccatcccggcggggctggtgcaggggcagttccggtcgctggtcctgtcctacaaccagctcacgggccccatcccgcgcgacgacgcgcgcgacgagatcaacaccgtcgacctctcccacaacaggctcaccggcgacccctcccacctgttcgccgccggccggcccatcggcaaggttgacctgtcgtggaactacctcaactt

SEQ ID NO: 1795 - DNA, 298 bp, Zea mays
  Clone ID: LIB3227-026-P1-K1-H5
cccacgcgtccggttgtccggccaatcctggattcatggcagaccgcggaacaagttcctccacctcttctaaatgatgtggttgcaggtgtcaccggcaagaaaaagtagtgaacttgcattgttttctcatgccaatgttgccccacattttcttccccgtgttttttctggcgaccagattggaaggcttttcccaagagtcacggtcttgaactctagatggtatccgcggaataatcattgtacctgaatcatatactgcaatgtggcagttttgaaaatgtttcccctccta

SEQ ID NO: 1796 - DNA, 374 bp, Zea mays
  Clone ID: LIB3227-026-P1-K1-H6
gctggagcaataattatgggggctggaacttgaagggttggtggtgtacttgcaaggtctcaagcatttgacagccgtctgttaaaacaatacgtgattgcataccctgagattcaggaacaagaaataaatgatgagtgggagtttgtaattatagctagtgatgggctgtggaatgtggttccgaatgaggacgctaattcacttgcgaagatggaagaagatcccgaggcagcaaacctgatgctgtcagagactgccttcttccttgtgagcggggataacatcacctgcattgttgagaagatcgagcatgacaagcctggcggcagatggtactcctctccaggcgacaagagtggattgcatttgct

SEQ ID NO: 1797 - DNA, 411 bp, Zea mays
  Clone ID: LIB3227-026-P1-K1-H7
atctcctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgccaagctcgcgcgctataacaagaagcctaccatc

SEQ ID NO: 1798 - DNA, 412 bp, Zea mays
  Clone ID: LIB3227-026-P1-K1-H8
atgaactccttcatcaacgacatcttcgagaagctcgcggccgagtccgccaagctggcgcgctataacatgaagcccaccgtcacctcccgcgagatccagacctcggtgcgcctcgtcctccccggtgagcttgccaagcacgccgtctccgagggcaccaaggccgtcaccaagttcacttcttcttaggctcatagtactaggctgggtggtgttggtagacgtggctcaatttatctggtaggggtagtgatggatgatatgatctgcgtctatttgagctgttaagactgatgaacattgttccacgtcacgttgtgtttgatgggcattgttccaagatcacgttgtaagactgcagaactgtgtctgacatggaacaagtatgatacttgaaatttctgtgagt

SEQ ID NO: 1799 - DNA, 200 bp, Zea mays
  unsure (1)..(200): unsure at all n locations; Clone ID: LIB3227-027-P1-K1-A1
tcggagcgcagctgtgtggtgagtgcgtgattttgttgtggttgaaaatgtagtgatattttaaatgactagaggttnngaganagaggagaaactgagaacgtgcatgtcaacctcatgagccttggtcatttacttttttttgataaagttgttttgtccatgtaaggggcaaacaaggttgacaaagttttttgttt

SEQ ID NO: 1800 - DNA, 128 bp, Zea mays
  Clone ID: LIB3227-027-P1-K1-A10
aaaaaaaaaaaaaaaaaaaaaaaaaaaaaataaaaaaaaaaacaaaaaaacgggcgggggcataacaacatatttatcttatctaatatttttaccttattctaaattcacctttcccttcctttttt

SEQ ID NO: 1801 - DNA, 401 bp, Zea mays
  Clone ID: LIB3227-027-P1-K1-A11
tctcaagcgtgggtttgtggcctccaactccaaggatgaccctgccaaggaggctgccagcttcacctcccaggtcatcatcatgaaccaccctgggcagattggcaacggctatgccccagtgctggactgccacacctcccacatcgctgtcaagtttgctgagctcattaccaagatcgacaggcggtctggcaaggagcttgagaaggagccaaagttcctgaagaacggtgatgctggtatggtgaagatgatacccaccaaccccatggtggtggagacattctcagcgtatcctccccttggtaggtttgctgtccgtgacatgaggcagacggttgctgttggagttatcaagagtgtggagaagaaggacccaaccggcgccaaggtgacca

SEQ ID NO: 1802 - DNA, 215 bp, Zea mays
  Clone ID: LIB3227-027-P1-K1-A2
ggtgaatgaagacaacatattatgtgaggcgctctcgctctatataacacatattctcttttttttttgtgtgtggggattcgccttttttctctctgagagaacaaggggaattttcaccatcccgcgcagtgtcccataaaatatgttttcacaagattgtgctactcgctataccaacataagagtttcagtgtctcagacacatcacatag

SEQ ID NO: 1803 - DNA, 409 bp, Zea mays
  Clone ID: LIB3227-027-P1-K1-A4
gtctgctcgcatttcctcccaatccatcccgcctccaaacccgaactccaagtcgccccgcatcgatggcgcccaaggccgagaagaagcccgcggcgaagaagccggcggaggaggagcccgctgccgagaaggcgccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatctcctctaaggccatgtccatcatgaactccttcatcaacgacatcttcgagaagctcgccgccgaggccgccaagctcgcgcggtacaacaagaagcccaccat

SEQ ID NO: 1804 - DNA, 173 bp, Zea mays
  Clone ID: LIB3227-027-P1-K1-A5
gaaacaacgacagaggtactaggtctttaaattttaatctttaaatgtaccttgcaatgcactatgctcaagtttttcttagatgagaaggaatttttactggtttgtgacatgtaacttccaatgtattacgaatttaatctcagctaccttttgttctgtatcatttaaaa

SEQ ID NO: 1805 - DNA, 362 bp, Zea mays
  Clone ID: LIB3227-027-P1-K1-A6
cccgcatcatcccgcgccacgtgctcctggccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaaggccgctaagtcccccaagaaggcatagaggggcgcctttaccgctgggatgttgaaggctcgggtcagaagatctttacttctgtagtggcgtcgctgttattggaaccggttagtagatctgtgcattgtggttgaaacgtgattccctgatttcagaaatctaatttgcaatttgggtgcacac

SEQ ID NO: 1806 - DNA, 91 bp, Zea mays
  Clone ID: LIB3227-027-P1-K1-A7
tcgggaacgaggacggctcccgccgaatgcgctgatcatggtcaaaccaagttttctgtaccgggttcagaactcttttgccctagacact

SEQ ID NO: 1807 - DNA, 286 bp, Zea mays
  Clone ID: LIB3227-027-P1-K1-A8
agcaagcaagagatagacatgcagctccagtccaatcaagaacaacaaccgcagcaagaggagaggagaggaggctcaccggtcgcgaccaaattctcccagagacggtcggaaatgaggagccaagcgctgttcttcctcacgatcgcccttctcaccgtgctcgcgcgatccagcaacaggcaccaccaccaccaccactcccacgttcaaagcacagggcagggagcatcatcacgaggaggaggaggaggaggggagctgtctagctcggcgccggctccgg

SEQ ID NO: 1808 - DNA, 395 bp, Zea mays
  Clone ID: LIB3227-027-P1-K1-A9
gttggctatgttgtcatggtggataaatttaccaatagaagaacggagttagtgaggattgaaggggctaaagttgctggcatatatcatcctttgatccatgagaaggttatgaaggtcatgcgcaggcatgacaggagagtttttgcatggactgttgatgatagcagctccatgaagaagatgctgtatgagcatgttgatgccattgtgaccagtaacccttctcttctgcagcagcttatgcaggagaccagagctgagtgtatggaagatggttttgccttaccataggaatttctagctgtcagaacataagggtttaacttctcagcagagaggaccaactagcgagttgagtttgagggattattcataaattaaatgataattac

SEQ ID NO: 1809 - DNA, 368 bp, Zea mays
  Clone ID: LIB3227-027-P1-K1-B1
atgaggcgcgagcgagcttgcgtacatattgctagcgcagagcctatgtgtgcacgtggaggaagcataatttgtggagctgacgtgtttcaacttgcacgctgggttcaaggtcctgatacctgatatgtactatctacgcacacgagctgctgctgatgcgatcaagttcacagtggataccacgcttctgaaggagaatgggaacggggttagcgatggaaagcccgcggaggaagacgtagacgctaaaatggcacagatggtctgttctttgaacaaccgggaagagtgcctggcgtgtggaagctagattggagattccatctggacactgcacttcgtgatttgtgaacacagcattacat

SEQ ID NO: 1810 - DNA, 290 bp, Zea mays
  Clone ID: LIB3227-027-P1-K1-B10
tgcttcaggagaccaggccgcgggcagaagtgcgtgacatgtggagcggcttccatgactcagcttcctcttttcttggttgttccacggactagcgaccggggtgccaacggcttgaagactaggagataacaagtaggacgatgttgtaatttagttaccgcgacgcggtggctctggctttcgtgtaaagaagtcctccctttcaacgcgactgggattgttgttgctggtaaaattgttgtaggaatatcatctgtgctccatttttcatcgagctcatctttttt

SEQ ID NO: 1811 - DNA, 390 bp, Zea mays
  Clone ID: LIB3227-027-P1-K1-B11
cccacgcgtccggatgatggaggggatcattgcaacatcgtacaatgaaggcgacaagttctatatcgacccaatgaaattgctgccgctctcacgcttcctgccacaaccaaagggacaatctcaaggagcacctagaggtggtgggcgtggtggaggaaggggttttgggcgaggccgtggtggtggttctttccgcggtggaagaggaccaccaagggggggtggtcgaggtccaaggggtggaggccgtggcggttttagagggcgaggaaggttctaggtgcagtttgagtttgatgatgttttccccttgaagcatcatagctgcacaattggaaacttccatgttattgtaaccagatatgtttaaggtagcagagcacttta

SEQ ID NO: 1812 - DNA, 402 bp, Zea mays
  Clone ID: LIB3227-027-P1-K1-B2
ctagccgcctgtcttgctgaagctgaactgctgatccgtcttccaagctgtggtgtcatcccctgagttctgatccaagatgtatctccagtattacatcaatgagaagggggacaaggtctacaccaccaagaaggagtcacctcttggggtgccgacgcagtctgctcacccagctcgcttctcaccagatgacaagtactctcgccagcggtacctgttgaagaagagatttggacttctgccaacgcagaagccagcactgaagtactgaagcttcaactttccaaccatggatgtgcagtttgtgtcactgcttgatgcttgttggttggaatgtagaataggtatctgaggaaacatatcaaacactgctaggcactactatgacatctcagcgca

SEQ ID NO: 1813 - DNA, 408 bp, Zea mays
  unsure (1)..(408): unsure at all n locations; Clone ID: LIB3227-027-P1-K1-B5
agctgatctacattccactgcctgatgagcagtctaggctccagatcttcaaggcctgccttaggaagtcccctgtggcgaaggatgtggacttgaatgctcttgctaagtacacgcaagggttcagtggagcagatatcacagaaatttgccagcgtgcgtgcaaatatgcaatcagagagaacattgagaaggatattgagagggaaaggcggagaaaggacaaccctgaggcgatggaggaagatgaagtggatgagatcgccgagatcagggcccctcacttcgaggagtcgatgaagtatgctcggcgtagtgtcagtgatgctgatatccgcaagtaccaggcgtttgcccagactttgcagcagtcnccggggtttggcagtgagttccgcttctcggatc

SEQ ID NO: 1814 - DNA, 341 bp, Zea mays
  unsure (1)..(341): unsure at all n locations; Clone ID: LIB3227-027-P1-K1-B6
aactgaaccgcgaaactcatgacgtgctcggactcggtgaagatgattgatagctgtacatgaagaaaactgacaagatgaactccccccataggaactttttttccccctgtagtccgcagggtacaacacacacacccatgcatctcagcttccttgacggcagcagagttactagaaaatatacatggtttgtgcagttcaacgcttcaactgctccagtattcacagtttaatgcattttaggtatattgctccagtttctcaacaaatcactgcttgcaattaaatctacagagcaaagttctcagtttgcttnnnnaaaaaaaaanaanaatatt

SEQ ID NO: 1815 - DNA, 334 bp, Zea mays
  unsure (1)..(334): unsure at all n locations; Clone ID: LIB3227-027-P1-K1-B7
gacaagttcgatgaggtcaggaagaagtggggaggtggcatcatgggatccaagtcgcaggccaagaccaaggcccgggaaaagctgctcgccaaggaggctgcgcagcggatgacctagattgtctactgctgtgtctgccctgtagtttgacggggaagaactgatgaactcgtattgtggttttccgaatctagtttcatatgtttctgtccaccagaccatgtttagaagctttgcaagacagagtttacagtgtttatgtgatgcctcagatccatgcagctttgcttctaattgcctaagagcaacctcaaaagtatttcatggggna

SEQ ID NO: 1816 - DNA, 328 bp, Zea mays
  Clone ID: LIB3227-027-P1-K1-B8
gagtgagctcctaagttttttgattgagatcacggccgacatctttgatatgagggatgacaagggttaatgctacctggtcgacaaggtcctggacaagaccgggatgaatggaactgggaaatggacagtccatcatgctgctgagctttctgtagctgctcctacaatcgaggcgtccttggactccaggttcctcaacggtctgaaggacgagcgcgttgtggctttcaaaatcttccaaggtgactacttcactggccttccggtggacaaggcacaattgatcgatgacgtgaggcaaagctctatatgccttcaaaatctg

SEQ ID NO: 1817 - DNA, 404 bp, Zea mays
  Clone ID: LIB3227-027-P1-K1-B9
cgcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccagctcgccagcgccaagtgagcaccttttttttgcctttttcgtttccgaggagggcgtcgtcgatgccaatttgtttccaataaacagggctgtgcccgccgttctgttgtactcc

SEQ ID NO: 1818 - DNA, 324 bp, Zea mays
  Clone ID: LIB3227-027-P1-K1-C1
gtcactacaaggacatctcggacctccccccgcatcgccttcaagagatccgccgcttttttgaagattataaaaagaatgaaaacaaagaagttgcagtgaatgatttcctcccagccgaagatgccatcaaagcaatcgagcactcgatggacctgtatggctcgtacgtcatggaaagcctgaggaggtgatctgctgctgcttgattgtggatgctacgtaattttctcaacagctcatcgagagtaccgtagtccgtagtacggcaaatgttaacacgcacgaactggaatcatgaccaagggatattaccttctgttc

SEQ ID NO: 1819 - DNA, 400 bp, Zea mays
  Clone ID: LIB3227-027-P1-K1-C11
gggtgagctcctcagtttcttgattgagatcacggccgacatctttggtatcaaggatgacaagggtgaaggctacctggtcgacaaggtcctggacaagaccgggatgaagggaactgggaaatggacagtccagcaggctgctgagctttctgtagctgctcctacaatcgaggcgtccttggactccaggttcctcagcggtctgaaggacgagcgcgttgaggcttccaaaatcttccaaggtgactactccactggcctaccggtggacaaggcacagctgatcgaggacgtgaggcaagctctatatgccttcaagatctgcagttacgcgcagggcatgaacatcatcaaggccaagagctcagagaaaggatggggccttaaccttggtgag

SEQ ID NO: 1820 - DNA, 374 bp, Zea mays
  Clone ID: LIB3227-027-P1-K1-C12
ctacaatgactgctcagaggttcaagccttcctcaatagcgaccagaattatgaggaaggtgatgctgaagaaatcaaacgcattgctcaatcaagtgccttcaatcaccttgaccatgtggtaattaggcttgcacggaagctaccaacaggtgatctgcaggccatcaagaaagctgacgatggcgaggaatccttggacgaggatgacctgacttaaaacgatctcccgagccaaaaggtgaacgtcatagtttggcatcggtgggggaacagcttgtaaaaagaggttatgcgagttacatactaaaaacttgtgggcagcattcccagatctataaacatgaaatttgtagggcccaaattatgttgta

SEQ ID NO: 1821 - DNA, 379 bp, Zea mays
  unsure (1)..(379): unsure at all n locations; Clone ID: LIB3227-027-P1-K1-C2
ctccatgtctgctgatccgtttcctttgacttccaaacatggatggtttgtgtcttctggattttccttggttgtacaatatctcagctcgttttctgagttgaaagaaaaagaagcaactgcagaaatgggcattttgttttttttttctttcacaatctctgtaagaagatactctgattcttgcttgggtcatcctataagttgtggatccttttggttagagtcaactttgttgtgccagtggattatacgggtgagtaagctgattccagcttccctgtgaagcataagtgctctttctaacgaatgaataaagctcatttctctgtgttgctggaaaaaaaaaaaaanaaaaaaaaaatttaataaattattt

SEQ ID NO: 1822 - DNA, 298 bp, Zea mays
  Clone ID: LIB3227-027-P1-K1-C3
gtgccaatagacagaagcaaatctgtgatggatattaacagtgagtatacgtatgggtaccatcagtggtagctaatccagcatgcgcacattgtgaactctggctagcgattgttactgatcgttgcaaggatattcctgttgcagctgaggcttgctgttttgctgaaactctatttcttcacgataactgtatagggttatttacatctgtgcttgtactagtcaggaaaacacacaattttccatgtggagtcaccttcatgttcattggacatcgatgtaatttcatcgggta

SEQ ID NO: 1823 - DNA, 406 bp, Zea mays
  Clone ID: LIB3227-027-P1-K1-C6
aaataggtcagttgggtttgaattcatgcggtccggagaaacagttagcaggtacttcaaccttgttttagatgctctatgtgtcatgtcacgtgacctcattaccatgagaaccacagagaaccacagggacacaaccaaaggtctcgtaggttgttagaggatgctctatttgagtcatgggtattgaagcatttaagtgatttggacctgtgaatcgactaggtaattttttttgtactttcggtcattatagctttattgtttgtgcttatactaatttgagatattttgcaattgtaacaggttgatccaagcaggaggtgaatgtgtgatggttggttattttgcatttcttctaggttgatgcatgacggttcatggagaaggctggtggttgtgatag

SEQ ID NO: 1824 - DNA, 249 bp, Zea mays
  Clone ID: LIB3227-027-P1-K1-C7
gctgcgtcaccgcggcgcctggccgcggcgcgcgtagcaagcggtcctcccgcgcgcccgcggcggcggcgtggcactccctcgtgccgcgcccaccgtcgcagccgtcgccatccttgtcgttctgctcgtcttcggacttcccgtcgttgtccaacaggccagcgcgcggcaggaagagcccggcgcccggcggtgacgcgtctgcgggctcgtacggcggagggggcgtgcggtagtgcacgcact

SEQ ID NO: 1825 - DNA, 296 bp, Zea mays
  Clone ID: LIB3227-027-P1-K1-C8
cttaaaaactgattggcgttaacagagacatgcggtgcttgcactagaggagggtgttgatgcataccttgttggcctgcatgaggacaccaacctgtgcgccatgcatgctaatcgtgtgaccatcatgcctaatgacattcacctggaaaggaggatccgacgtgagagggcctaatatccacctcaaacatagggacaaatacatgaagatctggggttattgataatacggggccattgtaaggtcatatgagtagggtacggttggagcatcgcaagattcatgctatgat

SEQ ID NO: 1826 - DNA, 86 bp, Zea mays
  unsure (1)..(86): unsure at all n locations; Clone ID: LIB3227-027-P1-K1-C9
naaaaaaaaaaaaaaaaaaaaaaaaaaaaaaaaaaaaaaaaaaaaaaaaaaaaaaaggaaaaaaaaaaaaaaaaaaaaaaaaaaaa

SEQ ID NO: 1827 - DNA, 367 bp, Zea mays
  Clone ID: LIB3227-027-P1-K1-D1
gaacctccaacatgacatacaatgcctggcggcgtgagcctgaggagggacctataatgtactgcagccgcactatttttgaggatgctactcctgaactggttagagatttcttctgggatggtgattttcgtctaaagtgggatcccatgcttgcatattgcaaatctttggatgagttccctcagaatggagcaacaattgtccactggataaaaaagttcccgttcttttgcagtgaccgtgaatacatctttggaggacgcatatgggaatctgggaagacttactattgtgttactaagggtgttccatatccatcattgcccaagaaagaaaaaccgaggcgtgtggagctgtacttctc

SEQ ID NO: 1828 - DNA, 398 bp, Zea mays
  Clone ID: LIB3227-027-P1-K1-D10
acgacccgtgggagtcatttgtgaatagtgtatggtacatcaagatactttcacctgaggatgtgcataagatgggaaagccaggaaacgatccacgctacctatcttagctacctatcttaaatcgatacatggagctctttctggctcccatgacgattctgcggcacactgtagcactgttcacgacggcctgctctactgtgctcgcatgttcgcccgtgtcatctgtagcatgcaccaccgtgctcgtcttcagaagacgaactccccgtcgcttgtatccggtgcaggtcaccgctcctggactgatattttgtaggttccacgtaggaatcagtatcagcaactctatcctagtttgtggtaggctcgcgcggcgctcgtttctgtgtcgc

SEQ ID NO: 1829 - DNA, 92 bp, Zea mays
  Clone ID: LIB3227-027-P1-K1-D12
gcgatacttcatacgtgccttcttggcaccgtgcattcacggcgctcttgctggggggggagctgtgcggttctcggtcttctactttcacc

SEQ ID NO: 1830 - DNA, 409 bp, Zea mays
  Clone ID: LIB3227-027-P1-K1-D3
cagagatgattttgagaaagaggacgcgtttcatggactgtgtgcaatggtggcagcaaaccctacaggagccgctggttcattagcttacatctgccaggcctgtgcaagttggactgagataaaaagcgaaggtcttcacaatgaggtgtgccagattctgaatggctacaagcagctgcttggaaacaacggtgggtgggaacaatgcatggccgccctgaaaccagatgttgtgcagaaattagctagatacggagtatgatgagaagcaagctcgtgtggtttattcacctcatacaccgaccatcatctttatggcggagacaagagaggagcagaaaggggtgggggtcgtcgagagtgtctctgctgctgatgcatcatctttacatgtgtggcacttgag

SEQ ID NO: 1831 - DNA, 394 bp, Zea mays
  Clone ID: LIB3227-027-P1-K1-D5
acttctcccagttactaacatccacagcatgttctggtggactagctaggacacttgaatagggttgtcgcaagaaacccccttctggaggtttcgctggctgtgcaatttggggtctttgaacgacaacctccttaagtagtttgcatatgacaaaaaacaagtgatgaaaactactaaaatctgccaaaactgatcttgttcccacctggcgagaaacagtttgaacaatcctctcaactgttagatgtactgccggaacacttgtttgatgagaatttcaacaaggaagttcccaagcgcggcaaagggcgcagtcgcggtggcagagggcatgggcgtggcaaccatcaatataacaatcaccatcacaataaccagcaccaccagaaca

SEQ ID NO: 1832 - DNA, 397 bp, Zea mays
  Clone ID: LIB3227-027-P1-K1-D6
ggatactctcttacttattttcagttaaagttcatgttaagctttcttgattcaactcagtgcatgtgatgtttcaacttgttttgcgtagccttgaatgtctatttttattagtatgttaagaacgtgattttatattgattttcatgtgtcaacaaggtcaataagatttctcatagccttagcgtgctgggatttttgaatggttatgtgctattatattagcattgcgaagttcactgactattgactgtgtgtaacatatataggcacgttcaagcttaccttgcagtttacagaagattacccaaacaagccaccaactgttcggttcgtctctaggatgtttcatccaaacatatatgctgatggaagcatctgcttggatatcctacag

SEQ ID NO: 1833 - DNA, 401 bp, Zea mays
  Clone ID: LIB3227-027-P1-K1-D7
ccgcacgtccgtgacatttcaccgccccaagaccctgaagaaggctagggaccccaagtacccaagaatcagcactaccggaaggaacaagcttgatcagtaccaaattctcaagtatcccctcaccacagaatcggcgatgaagaagattgaagataacaacactctggtcttcattgtcgacctcaaggcagacaagaagaagatcaaggctgctgtcaagaagatgtatgacattcaggccaagaaggtcaacaccctgatcagacctgatggaaagaagaaggcttacgtgaagcttacgcctgactatgatgctcttgatgtggccaacaaaatcggcatcatctaaagttactgcgtcaggcatctgctgtgctctatttccatgtgaaaccaga

SEQ ID NO: 1834 - DNA, 399 bp, Zea mays
  Clone ID: LIB3227-027-P1-K1-D8
aaaatctccaaacgcagcagagcccctagcgccgccggtctcttcagcctcgcagcacaccgccgccagcccgagtgaccgctgcagcctagggtttccggcggcgatggcgggtaagggagggaagggtctgctggcggccaagacgacggcggccaagagcaccgacaaggacaaggacaggaagaaggcccccgtgtcgcgctcctcccgcgccggcctccagttcccggtgggtcgcatccaccgccagctcaagtcgcgtgcctccgcgcacggccgcgtcggtgccaccgtccgcgtctattccgccgccatcctcgagtacctcaccgccgaggtcctcgagctggccggcaacgccagcaaggacctcaaggtcaagcgcatcaccccgcg

SEQ ID NO: 1835 - DNA, 306 bp, Zea mays
  Clone ID: LIB3227-027-P1-K1-D9
gtacggaggcggcggcggctacgggggtggctacgacgactatggcggcaacgacgactatggcggcgacgacgactactgatgggtcatgatcctccgatcgtttgcccggctgctacgcttgccatccacctccaccttcgtctcgctgtcctagatgtttgctgtatcaatcgcatagtagatcatgttctctattcctgccttcagtttcttttctcagttgtggtttgtcgaggcggggttgatgttgagatttgagatcctcacctgaggaatggaaaaatgctaaattgattaattcaa

SEQ ID NO: 1836 - DNA, 406 bp, Zea mays
  Clone ID: LIB3227-027-P1-K1-E1
agcagctccaagtcatcaaagacaaagcaaaatccccaaatttattgttagatagaaatgggcctggcttgacaaagattacggtaaaccaacctagccaactattatcaggcgaacgaatgctcaagtctagtgacagagttttatcagatcctcagagttatggtgaggtgaatggagattctaaccataatttgacggatactgctccagtgagcttagatgaagcagaatatgatggcaatgcatctgatgatggtttatcaggcgaagccgagaattacaattcagctgttgagatgacagcggaacggttgcacagaattccatcaagaataagcagattcactctcacaaaaaacgggcaaccatctatgtctagatcaaaatcaaaggatgctaagac

SEQ ID NO: 1837 - DNA, 57 bp, Zea mays
  Clone ID: LIB3227-027-P1-K1-E10
aaaaaaaaaaaaaaaaataaataaattaatataaaaaaaaataaaaaaaaaaaaggg

SEQ ID NO: 1838 - DNA, 395 bp, Zea mays
  Clone ID: LIB3227-027-P1-K1-E11
aagaaaacgacctggatgtaccttgctgtccctgtgctcttgtatgtaagtgagcgcattcttcggctatttaggagccatgacgctgttaggattcagaaggttgcagtgtatccggggaatgttttggctctctatatgtctaagccacctggattcaggtaccggagtgggcagtatatcttcataaactgccgtgctgtctctccatacgaatggcacccattttccattacatcagcaccaggagatgattatcttagtgtccacattcgcacaaggggtgattggacttcacgtcttaggactatcttctctgagccgtgccgccctccaactgatggagaaagtggactccttagagctgacctttccaaggggatcactgagagcag

SEQ ID NO: 1839 - DNA, 56 bp, Zea mays
  Clone ID: LIB3227-027-P1-K1-E12
attttaattttttttattttcctttttatttctttagtctcatttcataggggggg

SEQ ID NO: 1840 - DNA, 394 bp, Zea mays
  Clone ID: LIB3227-027-P1-K1-E3
cccacgcgttcgcccacgcgtccgggaagctcttagaacctatctcttttcatactcgtcttcgtacgaatccttaagccttaaccagctcactaccatgtttgatctcagcgagcagcatgcccacagcattgttagcaagatgatgatgcatgaagagcttcatgctagctgggaccagccaacaaagtgcatcgtattccatagtgtgaaccaaactagacttcaggggctactcttccagatggcagataagctctcggtcctggtggagatcaatgagagggcatacgaggcaagaactggtggtactctcgagggggtacctcccaggcgcaggggcgagggtcaggataatatgggaaagtggcaggataactttgtctcgtcacag

SEQ ID NO: 1841 - DNA, 150 bp, Zea mays
  unsure (1)..(150): unsure at all n locations; Clone ID: LIB3227-027-P1-K1-E4
tcgcccacgcgtccgcccacgcgtccgcccacgcgtccgctgcctgctactgtccttatctgtttgaataactgctgtgttgccatcttatgtgtacaactctcgaaactcgctgccgttcgatgtatttgagcttttggtatgcanttt

SEQ ID NO: 1842 - DNA, 395 bp, Zea mays
  Clone ID: LIB3227-027-P1-K1-E5
gctagttctatatctcacagtcttttagtttaacaaaataaaaataaaataatgggcggtcggttcttctttattttttcttctcatcttatatctgtctcttacttctgttttttttttttttccttttctattttttttatttctttatctattttttttttttttttttttttttttttattttttcttttattttttttttttttttttctttttttttttttatttttttaatttttttcttattttttttttttttttttttttttttgtttttttcttttttttttttatttttttttttctcttttttttttattttttttatttcatcttgtatttttttttttttttatattattatttcttgtttaaataaaattttttctttt

SEQ ID NO: 1843 - DNA, 55 bp, Zea mays
  Clone ID: LIB3227-027-P1-K1-E7
aaaaaaaaataaaatcaaaaaaaaattttaaaaaaaaaaaaaaaaaaaaataaaa

SEQ ID NO: 1844 - DNA, 395 bp, Zea mays
  Clone ID: LIB3227-027-P1-K1-E8
gccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgttcttggggttgctttgctggctc

SEQ ID NO: 1845 - DNA, 403 bp, Zea mays
  Clone ID: LIB3227-027-P1-K1-E9
gccaattgttgagcctgagatccttgttgatggccctcatgacattgatcgctgcgcttacgtcactgagacagtccttgctgcctgctacaaggctctcaacgagcaccatgtcctcctggagggtaccctcctgaagcccaacatggtgactcctggctccgactctaagaaggtgacacctgaggtgatcgcccagtacaccgtccgtaccctccagaggaccgtccctgctgctgtgcctgctgttgtcttcctctccggtggacagagcgaggaggaggccaccctgaatctcaatgccatgaacaagctcagcaccaagaagccatgggccctgtccttctccttcggccgtgccctccaggcgagcaccctcaaggcctgggctggcaaggtggag

SEQ ID NO: 1846 - DNA, 405 bp, Zea mays
  Clone ID: LIB3227-027-P1-K1-F1
gagcgatcccactcccgatcagcagctgatcgctcactcttgcagctcgatcattctttagctgctctagctctagcctctagccctagctagtagctagccactcggtcgtgtagtcatcagccttctgatcgtcacccatggccactgccgaggtccagaccccgaccgtcgtggcgaccgaggaagcgccggtggtggagaccccggctccgcccgccgtcgtgcccgaggaggctgcccccgccgccgaggccaaggtggaggagccagctgccccggcggagaccgagccagctgccgccgctgagcccgaggcggcccccgtggcggcggaggaagagacgccaaaggaggaagagacggcaaaggaggcggagccggagccggagccggcggcggctg

SEQ ID NO: 1847 - DNA, 404 bp, Zea mays
  Clone ID: LIB3227-027-P1-K1-F11
gcgtcggtgcaggtctccggcgcgggggtcggtaccgcggccttctctgtgaaggggaaggcctccaccggtgcgctccggcttcgctctacgttgaccttcggcgaggtctgcccggcgcggcgggcgttccgcggcctcgtcgtcagggccgctaccgtcgtcgcccccaagtatacaacacttaagcccttggctgatagagtgcttgtaaagattaactcttccgaggagaagacaactggtggaatcttgctccctacgactgctcagtccagacctcaaggtggcgaggtagttgctgttggagaaggaaggataattggggataagaaagttgatgtcagcattcaggttggagctcaggttgtgtattctaagtacgctggaaccgaggtcgcgtt

SEQ ID NO: 1848 - DNA, 345 bp, Zea mays
  Clone ID: LIB3227-027-P1-K1-F12
ggtccattgtgggtgcttccctagaggtgatccagaagaagagggctgagaagcgcgaggtccgcgatgctgctagagaagctgctcttcgtgagatcaaggagcgcatcaagaagaccaaggatgagaagaaggcgaaaaaggctgaggtgaccaagtcccagaaggcacagacgaagggagcggtccaaaagggttccaagggccccaagttgggtggtggcggtggcaagcgctgaaagaacctaagtgtcgttccttgaccttgcaattgctccttcatagcccaccttgttgcaccaacgccacttttggagtaccttgggtaattttgcattttctttt

SEQ ID NO: 1849 - DNA, 123 bp, Zea mays
  Clone ID: LIB3227-027-P1-K1-F2
gttggtgttgcccggtgtcaggaaacggcatcacaattatcaaaagctgttattgtattctgatggcttaagattgcaccctgtgctcgtgataatttgccgtatcaactaccattctatcaa

SEQ ID NO: 1850 - DNA, 293 bp, Zea mays
  unsure (1)..(293): unsure at all n locations; Clone ID: LIB3227-027-P1-K1-F4
atcgtagagtacacctagctgtcgtcaccagtggttgtaatagaggtagctttatgcttgactaaatacccttccgttataacaagtgcatgctcttgctgctcgctgttatgtgtcttcaaaaaaaaaaaaaaaaaaaaaaaaaaaaaaaaaaaaaaaaaaaaaaaaaaaaaaaaaaaaaaaaaaaaagaaaaacataaaaaaaaaccaaannnnacaaacagggggatccaacttcnnnacccccctttagggacacctaaaattaaattatagggtcggtgaatttcaac

SEQ ID NO: 1851 - DNA, 409 bp, Zea mays
  Clone ID: LIB3227-027-P1-K1-F5
gtcggcgatcatgacgtcgtcgggcacggcggaccacgcgggcgtgccgatcaaggacgagcagtacaggcgggcgagcttctacagcatgggcgccgggtacgtgaacccgtcccgcgccgtcgacccggggctggtgtacgacctcggcgccggcgagtacatcgcctacctctgcgggctgggcatcggggacgacggcgtcaaggagataactgggcgccgcgtcgcctgcgccaagctgaaggccatcaccgaggcggagctcaactacccgtcgctggtggtgaagctgctgtcccatccgatcaccgtccgccgcaccgtgaccaacgtcgggaaggcgaactcggtgtacaaggccgtggtggacatgcccagggccgtgtccgtggtggtgcggcccccg

SEQ ID NO: 1852 - DNA, 295 bp, Zea mays
  Clone ID: LIB3227-027-P1-K1-F6
ataggtcctcgttgacattttaatataatttgatgtgtgctgaggcgctatataataacacaaacgaaattttgttgtagacagggtagatcgatctcgtgtatcaacttttgtggtggtagaatgaaaggatataaataagttgatgtaagtttttgtttccaaaaaaaaaaaaaaaaaaaaaaaaaaaaaaaaaaaaaaaaaaaaaaaaaatgtttagattaacttttcctaggagaagacaaactggtggaatctttgctacctacgactgcttaattccatacctcaaggt

SEQ ID NO: 1853 - DNA, 220 bp, Zea mays
  Clone ID: LIB3227-027-P1-K1-F7
aataggaggcacagaaatgatgaaaaataaatggttttgcatagctgtaacagttttggtgccttgaactgtaactatggcagagtttctgtgaacagagtggcatgcattaattatacttgaccactctatatgtcgctgtttgtataattttcaatacgtacaagaactaaaatatattattggatagtattttttataataaactcatctgttgcta

SEQ ID NO: 1854 - DNA, 389 bp, Zea mays
  Clone ID: LIB3227-027-P1-K1-F8
ggccactgcgttcggtgtaactgttgatttcattgaccaggaactgtcacggttcattgcagctgggaagctgcactgcaagattgataaggttgctggtgttctggagactaaccgacctgatgagaggaatgctttctaccaggcgaccatcaagcaaggggacttcttgctgaaccgcatccagaagctttcacgggtcattgacctgtaaggactgtttgtgttggagctattcctgcaatcggcgcctgcaaatgtttcccaccctacgtcttccacaagacatctctccttgagtggggattggggaacaagccctaagaacatctgtgttttaagtgcagaatatttgtgttttaatcagtaaacgctgtcctgtcatttcg

SEQ ID NO: 1855 - DNA, 404 bp, Zea mays
  Clone ID: LIB3227-027-P1-K1-G1
ctgactgttgccagtatcggttacttcatgtttaaaggtctcagtaggggctgaccaaagtgagttggcccaaacatgtgctccgaggctcaccaccaagttttggcagaactggagctaaaggaagacagttcttgcaccgtttacatcaggaagatcatatctaacagcttacggtcttattaagacaggtaaacccatataccagcacatggaacaaagctttcgcttttcagggagttattactcccaaacgcagaaaatggtgtaccagaagcatacacttctgtaacaggcactggcagttcccagtgccaataaattttggaggttaaaataatgctcagataatgtcgaagaaattatgagagatctataaggttaactgaacattgtcgttgtct

SEQ ID NO: 1856 - DNA, 269 bp, Zea mays
  Clone ID: LIB3227-027-P1-K1-G10
ctctctcgtatatagctcacagatccgtgctccgtagcagtctattcttctgaataagtggattaactggagcgatttaactgtacatgtatgtgttagtgagaagcagcagtttttaggcagcaaactgtttcaagttagcttttgagctatcaccatttctctgctgattgaacatatccgctgtgtagagtgctaatgaatctttagttttcattgggctgacataacaaatctttatcctagttggctggttgttgggaggcatt

SEQ ID NO: 1857 - DNA, 387 bp, Zea mays
  Clone ID: LIB3227-027-P1-K1-G11
cccagttacaaaaaagctgcagtgttgcttactgttggttgtcgtgctcgcaacaggtaagcaacttcaagttcggcgaggccgacgaggacagcgcggtgaagaccgcgaagaagatccccaccaagaagttcactgacctcgcgggcaatatcttcaagggcgacgacgaggcacccgggacggcggagaagcaccacctgagcacggcgaagctgaaggagatgaccggcagcgacatcttcgcggacggggaggccccctcccgggactacctgggcgggatccgcaagccgcccggcggggagagcagcatcgcgctggtttaacagcagggacaaacaaccagatggacatagcagcccctcccctacatcattcgtttct

SEQ ID NO: 1858 - DNA, 408 bp, Zea mays
  Clone ID: LIB3227-027-P1-K1-G12
cgaaaagaggaagcagtcaaatagggagtctgctagacgatcaaggctgagaaaacaggctgagacagaggagttggctacacaagtggagtctcttgcagcagagaacacgtcccttagatctgaaatcgggcgggtaacagagagctcagagaagctcagactagagaactcagctctaatggtgaagctgaaggacaccggagaaccgtctccaagcaaagcagacggatactcattctctccccgtgcctcggcggagaacttgctttccatgatcgacagcgccaacgcgccgagcgtcagcaggcacactgagcacggcggtcccaggctccggcagatactggactacagtccggcgacagacgtcgacgtcgtaagctgatgatgaagccggtccggcaa

SEQ ID NO: 1859 - DNA, 410 bp, Zea mays
  Clone ID: LIB3227-027-P1-K1-G2
gctctccctcgacgacgcgcgcaggctcctcttcaaggtcgtcgggtggaggctcgtcctctccgacggcgacggcgacgagcagcgtcccgcgcggctgcagtgcgtctggaaggtgcgcgacgagacctgcggccaggagctcatcgccaggatcaacgccgcgctccacggcgccggacacgccccggcgaccctggcgttcgaggcccccaaccaggtgacggccgagctctccacgccctccgccgccggcgacagcctcaccgtcaacgactacatcgtcgccgccaggatagataaagtcaagacgctcgatcttatcccgaagaagcgggcgtgggcatgagcgtggtcgatgatcgatcgattctcctccctttctctgctgttcatttgaagggattttc

SEQ ID NO: 1860 - DNA, 399 bp, Zea mays
  Clone ID: LIB3227-027-P1-K1-G3
cacagctcacagcaaacaccgcgaagcgcgaagccggcccgctcccaaacccgaccgagcaaagcgcaaagccccccaacctcagatcaatccgcagcatcgatggcgcccaaggcggagaaaaagccggcggcgaagaagcccgtggaggaggagcccgcgacggagaaggcggagaaggctccggcagggaagaagccgaaggcggagaagcgcctccccgcgggcaagtccggcgccggcgagggcaagaagggcaagaagaaagccaagaagagcgtggagacctacaagatctacatcttcaaggtgctcaagcaggtgcaccccgacatcggcatctcgtccaaggccatgtccatcatgaattccttcatcaacgacatcttcgagaagctc

SEQ ID NO: 1861 - DNA, 262 bp, Zea mays
  Clone ID: LIB3227-027-P1-K1-G4
cacatctcacacaaaaaacctcctatcgctattacgctcctcttccaaacccgagcgagcgtagctcaatactttacaacctcatatcaatcccacatatccatcatccccaaatctttcaaaaagtcctttgccaataatcccatggcaattaacccatattctctaaactcctacaatgctacgacagttaacaaatctatatatcttttaaactccttctctatgacatcttcttccctcgctatcacaatatattcta

SEQ ID NO: 1862 - DNA, 411 bp, Zea mays
  Clone ID: LIB3227-027-P1-K1-G6
gcctcgccacctcgtcgtcgccaactgcggcgactcccgcgcggtcctctccagcggaggcgccacgatccctctctcagctgaccacaagcctgaccgccccgacgagctcgaacggatccacgcagcgggagggcgcgtcatcttctgggacggcgcccgcgtcttcggcatgctcgccatgtcccgagccatcggtgacagctacctgaagccgttcgtgatctccgacccggaggtgctggtggtggagaggaaggacggcgaggacgagttcctgatcctggccagcgacgggctgtgggacgtggtgagcaacgaggtggcgtgcaaggtcgtgcgcacctgcctccggaacagggcgccacgcggtggccgggagcagtcgagcccgacctccaacctgagccc

SEQ ID NO: 1863 - DNA, 406 bp, Zea mays
  Clone ID: LIB3227-027-P1-K1-G7
cctatatgttctgaaacctttgcagtatgtggggattgaagtatggcaggtcaaagctggttcagtttttgacaacattttgatttgcgatgacccagactatgcaagacatgttgtagatgaaacttttgctgcaaataaggaggctgaaaaggaggcctttgaaggagctgaaaagaagaggaaggctagagaagaagaggaagcacggagggcacgggaggaaggggagagacgaaggcgggagagggatagggaccgcggcagggaccgatacaaggatagatataagcgtcataggcactacgactaccatgacgagctatagatcctgtattcttttgaaatctgcacgatattggatgtctgtctacggagagcgcacgtgcaaaacttgtatgttgta

SEQ ID NO: 1864 - DNA, 406 bp, Zea mays
  Clone ID: LIB3227-027-P1-K1-G8
gtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgccgtacaagatcagcaccaacgttaactgcaacacgattaat

SEQ ID NO: 1865 - DNA, 378 bp, Zea mays
  Clone ID: LIB3227-027-P1-K1-G9
cccacgcgtccgcccacgcgtccgaattttaaaaaaaaaaaataaaaaaaaagatgggaaaaaattacaagtttaagttatacagtatatatttcaaatattttatattttatcttttgggcgggcccgtttataggttccaagcttacttccccttgcattccaccttaatgctcttttattgtgacccctaagtccaattcactgcccggctttttccaacataacgccgtggtaacccttcgcgttccccacctttattggtcttgggtgacattccccttttgtcagctgctttaattactaagaggcccctaccgttcgctttttccaacattttcccacccttaatgccacttgggaccccccctttagggc

SEQ ID NO: 1866 - DNA, 400 bp, Zea mays
  Clone ID: LIB3227-027-P1-K1-H1
gacgcagcaaggcgacggcatcagcaatgtcgcgcgctattggccgcttatcagggaaaggaggcaagaccaagtacgccattgagaactcaaccaggacccgcatcgtcatcgctgatacaaagatccacatacttggatccttcgttaacatcaaggtcgcgcgggattcactttgcagtctcatcttgggttctcctgctggcaaagtgtattctaagctaagggctgtatcagctaggttggcggaaaggtattaaattaaataggttttgcccgcaccatattgattggaggggtttgagtgagattaattccatatcaagtcaaaatccttcataattttttccaatccttttcaattccatgaggtataggaataactgaacaaggcctaatt

SEQ ID NO: 1867 - DNA, 402 bp, Zea mays
  Clone ID: LIB3227-027-P1-K1-H10
caagattacactggagacagcaaagctactgagagaagattatttggcacaaaatgcatttaccccatatgataagttctgcccattctacaaatccgtttggatgatgcgcaatattattcacttcaacacattggcaaatcaggctgtggagcgggcagctggtactgatggccaaaagataacatacggtgtcataaaacaccgtttgggcgatctattttatcgcctagtatctcaaaagttcgaggatcctgccgaaggtgaagaagctttggtcggcaaatttaagaaactgtatgatgacctcaccactggtttccgcaatctcgaagacgaggcacggtgaactagtgtagattctgtgtaaacaaggactgccaaatgttttataagatacat

SEQ ID NO: 1868 - DNA, 408 bp, Zea mays
  Clone ID: LIB3227-027-P1-K1-H12
gatttcaatatccaccaactattattgtcatatggtgatgtgggcacaaagggcgctctaaaggatgagcatgtttttgcatcggcaaaatgtcaggccttaggggagcttttaccttctctggcaaatgatggtcacagagtactcatatttagtcagtggaccacaatgcttgacatccttgaatgggcattggaaattataggagttacatatagacgccttgatggagggaccgctgtgacagaaaggcagactatagtggacacgttcaacaacgatctttctatatttgcatgtttactttctacaagagctggaggccagggtctgaaccttgtaggagctgacacagtcattatacatgatatggattttaacccccagatggatcggcaagctgaggac

SEQ ID NO: 1869 - DNA, 391 bp, Zea mays
  Clone ID: LIB3227-027-P1-K1-H2
cgttcttgttcatgaaatcgaccaggagcaccgcgctggccgaggagcggctggcggcgatgctctggaggacctgcatcgcgtccgcgtggtggaggtagtagatgatgccttcgagcacccacacggtgttcctcccggggacgtacccgcagctctgcagcttcgctatccagtccccgtctcgtatgttggcaggaaccctagccaatgatttcgccgccacggtgagtttctggcggcttgcggaactcgccgctgcctcgcgcagaaggtcggatttcagttctaggagctccgggaagtcgagttcaaataccgtgcatccctttaggcagctcagccggtaggctcttgcatccatccctgaaacacaatagagtgagagagc

SEQ ID NO: 1870 - DNA, 406 bp, Zea mays
  Clone ID: LIB3227-027-P1-K1-H3
aaaagaaatcacgcaagggatgttcgatggtgaacatcttatctggaagaaaaatgctatgcttcaagtcctgaatgatcgaagggggtcttacctgaactaataccatgagtgtgaccccaagttcgcgaagcttgaaatcttgatgcgctcgttgcgcatgtatatttgcacctttggttattaatcactagaggtagatgattgaaactaatctgcttaaccaatgtgcactgctgggcgctggcgtggttagctatatcagttaggcagttcgacagaggtcaaagagattgagattttgttctttcttggcaatgtcacagcttttgtgaatctggtctcatcatactgtccgctagtttatccaatgattccatggtggaatcaatccatagcaacattg

SEQ ID NO: 1871 - DNA, 413 bp, Zea mays
  Clone ID: LIB3227-027-P1-K1-H4
cggacgcgtgggccagcatctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtgg

SEQ ID NO: 1872 - DNA, 413 bp, Zea mays
  Clone ID: LIB3227-027-P1-K1-H5
gacaaaatggcaacattgatttaattcccctttacttttgcaacacaagaaatctagtcatcacaagtctcgttggcagcttccaaaactaaaaggagttggagaagatttaccacaatacgtagacatatattagctaaaccctgaatctgtatagtataatcaacatcacatcgaggagaaaatgaatgggagatggctgcattcccatgtcatccacgtggtcggcaggaacaagcattgctgcattggaaacaatctggaatgctttgggctttaaatcccgtaccgtttttaggtaggattaagctcatgtaacacagcaaacttttcacttagatgcactatgaatcaagtgaatcgtaggaaacggattctcgtgctgaagggagggatgactccagaatttactc

SEQ ID NO: 1873 - DNA, 407 bp, Zea mays
  Clone ID: LIB3227-027-P1-K1-H6
agcaagttgagctggaggtgttcaacttcactggtgccggaggagttgccttatcaatgtacaacactgacgagtccatccatgcctttgctgacgcttctatggccactgcttatgaaaagaaatggccattgtatcttagcaccaaaaacactattttgaagaaatatgatggcaggttcaaggacattttccaggaggtgtatgaagctggttggaaaaccaaatttgaagctgccggcatatggtatgagcaccgccttatcgatgacatggtagcatacgcacttaagagtgaaggagggtatgtctgggcttgcaagaattatgatggagatgtgcagagcgatttcttagctcaaggttttggctcattgggtttgatgacttcggtactggtgtgccct

SEQ ID NO: 1874 - DNA, 405 bp, Zea mays
  Clone ID: LIB3227-027-P1-K1-H7
agcaacttcaaaagggtcttctccgccgaaagttgaagagaaatcaagggtagaggaaaaagccccgaaagtagaacctcccaagatgcaagcaccgaagccaactgcaccattaaaaacgtccccttcagaaccacaactccctccaaaagaacgggagcggcgggtgccgatgccaaggctcatgaagcgtattgcaaaccgtcttaaggattctcagaacacctttgcaatgctatctacatttaatgaagttgacatgaccaatttgatgaagcttcgttctgattataaagatgaatttgtcacaaagcatggtgtcaaattgggtcttatgtcttgctttgtcaaggctgctgtttctgcacttcaaaaccagccaattgttaatgctgtcattgatgg

SEQ ID NO: 1875 - DNA, 299 bp, Zea mays
  Clone ID: LIB3227-027-P1-K1-H8
cccacgcgttcggccactcgtacgaacgtggtgcttgttggtattgctcgcgggggtcgatttcaggggctcgatctcactgtactagtacagagttgtagaccaaccaatataaccaaccgtcattcacgattataatgcgatcagcgtccaatgtggacgggttcacccacttcgaacttgttctaaatgtgtggcaccagtattgtacagaaatatacaaccttttacttgtacattctttttaacttttaaggacatggtagatttcatattgagatgatttttgtgttttttta

SEQ ID NO: 1876 - DNA, 380 bp, Zea mays
  Clone ID: LIB3227-027-P1-K1-H9
gcacagagtaacgatgatgcgattaagctggggcttgcggttcttgctgctgtgaatgaatttccagcactggatgtgacggcactgaacaaattcgtgcaccagtgaatataagggacggacattggcatcataatgtgatcagcttcgcatggtgccgtgttcgccccggtcgaacatgttctacatgtgtggcacgagtatcgtacagaaatataccagtttattacttgcacaggcttgttagtctggaaggacaagggagattccagtgttgagatgattcttgtgtgtgtttataccagctatcaaagtaagaatatgcgtgcgtactgttgaggctgatctttacttgagaataaggtttgagttacccggat

SEQ ID NO: 1877 - DNA, 425 bp, Zea mays
  Clone ID: LIB3227-029-P1-K1-A1
cttcgagaagcagatcctgagatccggcaccggccccaagccgataaagggccagaagggcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcgcatctgtcagctatggaaacgttggccatgcttctcaagtaatgaaataattccggtgtcacctcatgctacatacaggaagattgg

SEQ ID NO: 1878 - DNA, 406 bp, Zea mays
  Clone ID: LIB3227-029-P1-K1-A11
gtcctgcaagcaacgccatagctttttgaagtggaaccacaggatgtgccatatgtgtactgcttggtctatgtcatattcgttccgctccgctggatttactaccgctacaagaaatggcattactatctcctggtgagtccattactgtctcacattttttatgtcccggagatgcgtcaattgcccgaaatgtgcttccacatatttttacatcataaatcataacttaacattgtttgtttcagtgtcctactttactctaaatttatgtgttatccacaccacaaagtctgcaatagaaagcttagttgaaaggataaatagttttagatagcacatactactatgatgagtggacgatgggctgggttatgacattgcgccaacatcttgcagttgcaca

SEQ ID NO: 1879 - DNA, 284 bp, Zea mays
  Clone ID: LIB3227-029-P1-K1-A12
ggggcgcggcaagggcggcaagggcctgggcaagggcggcgcgaagcgggggcgggaggtgctgtgcgacaacatccaggggatcacgaagccggcgatccggaggctggcgcggcggggcggcgtgaagcgcatctcggggctcatctacgaggagacccgcggcgtgctcaagatcttcctggagaacgtgatgcgcgacgccgtcacctacaccgagcacgcgcgccgtaagaccgttaccggcatggacgtcgtgtactccctttaagcgccagggctcg

SEQ ID NO: 1880 - DNA, 333 bp, Zea mays
  Clone ID: LIB3227-029-P1-K1-A2
taccggaacggagggtccgcccagcgcgaccggtcacgcgcacactacacaaggtgactaaaaataagaagagaaagaaaaagactgaaagggggggaaaaagcaattttatgacaaaaagcaaaaaagaaaatgaaaaaaaaaaaaaaaaaaggaggtaaaaaaaaagaacggggcgaccaattaaaagggtccagattttggtacccagaatttgcaaggaatacttatttaatgggatcacgaaaagtaagtaatctgcgaggggtttaaaaaaggggggggtgggaaaaaattggggggttaaaaaaaattaaataattttatataaaa

SEQ ID NO: 1881 - DNA, 423 bp, Zea mays
  Clone ID: LIB3227-029-P1-K1-A3
ggcaaaagttgcgagttggagtcatatgatttgatgtcagctaatgatgctccagagagggatccaatggactgggttcttgaagggagcgcagacggaggctccacctggaatatacttgatgctcggaattcagaaatgttcgagagccgtttcttgaggaaaacatttacagtggataagagatataaggcaaatgctttcaggtttaggtttctacgcgtaagagattctcattctaatccaaggtttcagataggatcaattgatctatatgggaaaaccatatgaactccccccggagctgtgtttcacttttcggctttctgaactgctcggtctcacgagcctgtgtagtatcataaattcataatattgtaatgcgagcatttactgtggacgcaacgctctcttcagtatgaa

SEQ ID NO: 1882 - DNA, 399 bp, Zea mays
  Clone ID: LIB3227-029-P1-K1-A4
cgagcagctcgagttggtcgccctccttgcctacgatgaggatgaggacctcttctacggcgagcaggcccccgccgccgccgccgcccttaagacagattcggtgctcaaggcgctgaacttgggctccccgaagagcggcgacgccccgcgggggttccgggagaaacccaggcactccgagaagccgaccaagtacgccggcagccccaagagcagcgctcctcgcgtgatccaccagcctcgctaggttcgctggccggcccctgatggggactcggtgactcacatggaaggctgctgcctctctagcagcatctgctactggctgcagctgccgtcggcgtcgtggtctgtctgtcaaagtcgaagtataaaaacgtgagtagttgtactact

SEQ ID NO: 1883 - DNA, 374 bp, Zea mays
  Clone ID: LIB3227-029-P1-K1-A5
gagataaccagtttggaacccgtgataatgaacttgatcacactaggggcagtaaagatcatggttgcagtgcaaaacatatcattaatgattataaaaattttggtggccaaaatgttcttcattgcctttcaaatgctcgacatctagagctgttaggtcattctggagaggtcattatgaggagagaatcgttaaattgtccaacttttagcaacctgaagactttggccctgggagaatggtgtatcagtacggttgctgaccttcgacatattacttgtcttgcttcagcattcacctagtctggagaagctttatcttcagcttgaaatgaaccgtgacatcaagaaagcattggtaagaggtataga

SEQ ID NO: 1884 - DNA, 92 bp, Zea mays
  Clone ID: LIB3227-029-P1-K1-A6
attcgattgtactgcgtggcatgaaatgatcgattcgaagaatattttgaacatgctgccacctaatcaaaaaatttcatgtttaacttcat

SEQ ID NO: 1885 - DNA, 412 bp, Zea mays
  Clone ID: LIB3227-029-P1-K1-A7
gcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacaggacggcatcaagagatgcaagcattttgagattggtggagacaagaagggcaagggcacatttcttttttaagcttctcgtccacctttcttgttggtgagttgaaactttgggtctactactactggtataaaaacatgtcggcaaattttaatggtaatggagcaatggaagcagaccatgctatgtattcaaatttcaatgcctgacatttgttctggg

SEQ ID NO: 1886 - DNA, 309 bp, Zea mays
  Clone ID: LIB3227-029-P1-K1-A8
cgagaagagggtgccgcagcggctgcttgagatcgccggtgtcgccgcgttctgggcttggtacccgttgctggtggcgtgcctgccgaattggtgggagagggtggcgttcgtgcttctcagctttaccatatgcgggatccagcacgtccaattctgcactgaaccacttgtcgtccgatgtgtacgtcgggccacccaagggcaacgactggttcgagaagcagacggcaggcacgctcgacatcctgtgccctccttggatggattgggtccatggaggtctgcagttccagattgagcaccata

SEQ ID NO: 1887 - DNA, 394 bp, Zea mays
  Clone ID: LIB3227-029-P1-K1-A9
aggcaatcgggcacaaggaaagaatgtgagaaaagccacaagcttcatgacacgaagagcaaccatgacttatccttggagataaaaccatatatcagcaaacggatgcgcatagccacctaccacagtaaacagatgtacaacacttcgccagatgttggtatggatcttattacactcgccactcggtaaaagaaaggttcaggtttagcaattaccagccacttttaaggcttgcatattaattaatcgcaagatagagatctatatatgcgaacgtttgtcagtaataggcgaaccacagctacagcaatttctgattacacacttcaatgtccccagcaatgaatatgatacgggtgacgggggttggggcaatagtagtagtactacc

SEQ ID NO: 1888 - DNA, 417 bp, Zea mays
  Clone ID: LIB3227-029-P1-K1-B1
atcatcgacggtgttgacatctgcactttaggactccatgaccttaggtcacggtttggtatcatacctcaggaacctgttctctttgaagggaccattaggagcaacattgatccgcttgagcagtattccgatgatgaaatctggcaggcattgggccgctgtcagttgaaagaagccgtagcttcaaaacccgaaaagcttgatgcttcagtcgtcgacaatggtgagaactggagtgttggacaacgtcaactgctatgcctgggccgggtgatgctaaagcacagcagaatactgttcatggacgaggccactgcttccgttgattcccagaccgatgctgtgattcagaagatcatccgggaagactttgcagcttgtaccattatcagcattgcgcacagaatacctacg

SEQ ID NO: 1889 - DNA, 412 bp, Zea mays
  Clone ID: LIB3227-029-P1-K1-B10
agcatttgtgctacgagggcttttgcaatggcggcttcggggttcggcggcggcgaggcgttccggctctcggccgcaccaggggccggcttactgaagctgcacaagggcgacatcaccctttggtctgtcgactgcgccaccgacgccatcgttaatgctgctaatgagcgaatgttaggtggcggaggtgttgatggagctatacatcaagctgctggaccagagctagtgcaagcatgccggaaagttccagaggtcaaaccaggagttcgttgtcctactggagaagctaggattactcctgcttttgagcttcctgcctctcgggtgattcacactgttggccctatatatgatttggacaagcatcctgaggtgtcattaaagaaggcctatgaaaatagcttga

SEQ ID NO: 1890 - DNA, 406 bp, Zea mays
  Clone ID: LIB3227-029-P1-K1-B11
gaagaacttcatcagaagtccattatctatagaggtgtttcggcagacattcttatgctcgacagatcaggacatctgcagctggtggattttaggtttgcaaagaagttggaaggtcaaaggacatacacaatatgtgggatcgctgactctctggcaccagagattgttcttggtaggggtcatggatttcctgctgactggtgggcacttggagttttgatctatttcatgcttcagtcagacatgccattcgggtcctggagggagagcgagctggaacctattacaaaaattgccaaaggccaccttgttatgccagtgtctttcagtgcagaagttgttgaccttataaccaagctactcgtggtcgacgaaaacgcgcgcctttgaaccagtggtgctg

SEQ ID NO: 1891 - DNA, 356 bp, Zea mays
  Clone ID: LIB3227-029-P1-K1-B12
gaaacctgctgagagaaaaaacaaatttatggggtccaacaaaatgtgatagtgaaagccattttgcttccagcagctctagcctgttaaggttctcctgtggatgcatcgagacaacagcatgctggcgccaagtttgagggcagcattgggctactatcagagaaaccaaataatcccatacctaactgttcatctggaagttactcatcatgacaagtgcctgaaatttttcctctttcctgttaccttgtgtcagaacattatgtagctgtagatatattgattatggaaggatgaagttgccaaattgacctgaggagattcctttctccagccaggaaaaattctgaaca

SEQ ID NO: 1892 - DNA, 423 bp, Zea mays
  Clone ID: LIB3227-029-P1-K1-B2
ctaaagtctaccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggcgcgcaggggcggcgtgaagcgcatctccgggctcatctacgaggagacccgcggcgtgctcaagatctttctcgagaacgtcatccgcgacgccgtcacctacacggagcacgcccggcgcaagaccgtcacagccatggacgtcgtctacgcgctcaagcgccagggccgcaccctttacggcttcggcggctagggcgctaggctaggccatgctcgacccgccccccactctccgctctggcgtcgtc

SEQ ID NO: 1893 - DNA, 414 bp, Zea mays
  Clone ID: LIB3227-029-P1-K1-B4
caaagatggtagctcatgttcctttttaccttttagcccagcaaaaaggtccaccgtcgtcataatttttcatttgccgacctcctcccaacagaatgaagaaaatatctgcatgagtgcattggtgcaggcatgatttctctagcagaaggccatataacgattttgttttgaagatccaagttcctttttaaaaaaggggctggtctgaacattcaggcttatttctctagcataatactcataaagagtcctgtacttttaggtcttgttcggttattcctataatacatggattgatggaattaaaaaaaatttagaagaactttgacttgcttaagaattcaacacatctaatcccactcaatccatatggattgagagctaatcgaacaagtcttacatggttgacta

SEQ ID NO: 1894 - DNA, 413 bp, Zea mays
  Clone ID: LIB3227-029-P1-K1-B5
ggaatgatgaggctcaagagaagtgaaacttaaatctttgacagttttgacagttttttgacagttttgaagggcgggcctggtgcagcggtagagcctaccgtctgtaaccggaaggtcccgggttcgagccccagcctctgcatattatgcgggtaaggcttggcgcttaaagatacccttccccagaccccgcacagtgcgggaagcctacggcactgggtacgccctttggggacttgaggtggcagtcatggtatcttctgcttgtcagcattcggtctgatccacatgcagtatatgcctttatgatatggcccccgcacagcattttctcttgaagcttcccgtctccgtagtcgcagctgaaagagagtggaacgccttgatttgtaggatttcttgtcatgctg

SEQ ID NO: 1895 - DNA, 371 bp, Zea mays
  Clone ID: LIB3227-029-P1-K1-B6
tgaacatgcatgtcctctgctgactgaactctgatgtgtgtgtatgtatatgcagctcgcaacggggaccggtattgctccgttccgctccttcctgtggaagatgttcctggaggagcacgaggactacaagttcaccggccttgcgtggctgttcttgggagtcccgacgagcgacagcctgctgtacaaggaggagctggagaagatgaaagagatggcgccggacaacttccggctggaactcgcggtgaggcgggagcaaacgaacgcggcggggggagaagatgtacattcagacgcgcatggcggaatacaaggaggagctgtgggagcttctgaagaaggacaacaactacgtctacatgtgc

SEQ ID NO: 1896 - DNA, 391 bp, Zea mays
  Clone ID: LIB3227-029-P1-K1-B7
atcctaagttgaccccagttcgtgaagaggtcaaaattgtcagggctacgagcttttctattcgtctccctgaatatgatgtacctgttgttgacaaggctgtggatgctacatggagaagggagcaaccacgaaagataccattcatgccccaagatgcagactcttctgtgaaaactatgtccaggccatctgattcctcctgggataagatcgctgcaactctgatggcttgtcttatggctattgtaatgttggttcgattagtcaaagatcttgtcacaaggagattgccatctaaaggtgggtcagaagaaatccactctacgctgtacccagaccccatccagaaagaggaattccgtcctccttctacgatccctggatttgc

SEQ ID NO: 1897 - DNA, 411 bp, Zea mays
  Clone ID: LIB3227-029-P1-K1-B9
cccacgcgtccggacacctgaagcgaaggctaccaaagactggcaaaaacaattggccgagaaacttgccaaccatctcacctcttgcgggttccagtctcatctgcaagacgaaggcgaggctgaacaaactgatgcttaacctcagcagtgcattacgtatgtatgactacgagtggccaggaagttttagcatggagggtccttgcatgaagcaatgtctcttgtctcccacttcagaaattgttacatgtgggtctatgatttactccctccgttctttttctatttgtcgcaatttagttcaaaaatgaactagtgggtgacaaatattaaaaaacggaggtagtacatctaaccgagagatatatagttctatgagtgcgcaggaagtttttatgccgttatatt

SEQ ID NO: 1898 - DNA, 421 bp, Zea mays
  Clone ID: LIB3227-029-P1-K1-C1
caatgccaagcctgttaccaaggcggttaccaaggcgtcggctaacggtggtgctgggagggagcctgacgagatgtgtgagctgtacccataccttgcggaggaggtgagggcgcttcagagggcacacccaggcttgttcaagcgggagtttgggatgatcgaagacagcaaggcccgtacactggacgagaggatcaagaagcagaggcgtgcactgatgaacctacatcttcgtcgccacgacctgaccaaggaagtgaccaggacgctcatggacctggctgagtgatgcagtggactgagctgagtatcatctaagaattctattttatggtatttaagtgcactgatgatcgattaccagcaaatgttgtatgacctactcaagcatggtaggtgaatcttgattttgttatct

SEQ ID NO: 1899 - DNA, 396 bp, Zea mays
  Clone ID: LIB3227-029-P1-K1-C10
cgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagaca

SEQ ID NO: 1900 - DNA, 414 bp, Zea mays
  unsure (1)..(414): unsure at all n locations; Clone ID: LIB3227-029-P1-K1-C11
gtaccttcatgggtcggtgtcccaacgtcagttgcgataccatttggcacttttgagaaggttttgtcagatgggcttaataaggaagtagcacagagcatagagaagcttaagatcagacttgcccaagaagattttagtgctctaggtgaaataagaaaagtcgtccttaatcttactgctcctatgcaattggttaatgagctgaaggagaggatgctaggctctggaatgccctggcctggtgatgaaggagacaagcgttgggagcaagcatggatggctattaaaaaggtttgggcatcaaaatggaacgaaagagcatattntagcacacgcaaggtgaaacttgatcatgagtacctttcgatggctgttctcgtgcaagaagttgtgaatgcagattatgctttt

SEQ ID NO: 1901 - DNA, 412 bp, Zea mays
  Clone ID: LIB3227-029-P1-K1-C12
gcaggtcgaagcagaaaggaataaagctactcgcagatcagcatcgtcgtgggaagaagatactgatatcaaggcattagagcctcttcctctacatcatcggcacatggcaacagcaaatcatcagttacaaaaggctgcgaagcttttagatacaggcgctgttcgtgcaacaagatttttgtggcgacaccccgttgcacgagtcagcgtgctattctatctggtgttcgtgcatttgttcttgatgcacttgttacaccgccttcaggacttcgcatccagagaaggaacatcagccatgggggatctggcccacgcaaacctgccatagcccatagtctctgtgcccttcttgtatcttgttcattcaggcattccccactgattcttgctccacacgccttgaggt

SEQ ID NO: 1902 - DNA, 418 bp, Zea mays
  Clone ID: LIB3227-029-P1-K1-C2
tgcaacttgtgcatttggtggaggtgacgaccttcatcagcctatagggatgaccgaaagctccatcagaaaggtttgctatgtagctttctgggatgaagtcacccgtgcagctcaagaggaggaaggacacacgatcagtgaagaccttgtgattggcctatggcggatcattcttgttagcgatcttcctttctcagatcaacggttgaatgggaaaattcctaagctgataggccatcgcctcttccccatggcacggtactcaatttgggtggattcaaaatctcagttccggagagacccattgggagtccttgaagcccttttgtggcgctcaaactcttctctagcgttatctgaacacggagctcggagtagcctgtacgatgaggcgaaagcaattgttaagaaacac

SEQ ID NO: 1903 - DNA, 421 bp, Zea mays
  unsure (1)..(421): unsure at all n locations; Clone ID: LIB3227-029-P1-K1-C3
agcaccgccaattccagccggagcgctacgtggccaccgtaccagcctcgcccgacgggagcccgccgttctccgcccagccgcacggcgccgtctcggcgggcaactccccgcgcgccaacgcgttgggcgttgggttcgggatgcagcgcgtccggagctcgccgaacctcagcaccctggacgcggcggcgcggcgcttgcatcagcacggcgtggacggcagcatatcgggctacgtgagcggctcaccaaggcacgccggcgcggggcccatgctgttgcagaacaatttccaccactaccagcaccagtacccgacggcgcccgtgcccgtgcctgtgcccgtgcccgtgccgcaccacggtgggcggtacgacgcgcgcgggtacgtncgggtaggcaactatctggcgccgat

SEQ ID NO: 1904 - DNA, 407 bp, Zea mays
  Clone ID: LIB3227-029-P1-K1-C4
ggctcgtccatattagaagaatgggccaagcaggattggggcagggcctccattaagccagggcgtcgttgggcttaccaaaaggggcgagggggatgtgtgcaccggaaaagggaagccgaaacgcataagcatgctggaccagatgagcatctgtatgccttggacctggagaacacggaagaagaatcggcgctttattttgatctcacaccgggttatcgggcgcaccacatgcacacatgtcttgggatggaagacaagtttagagactattactacaagaacaggctgatgcaactcaacttggacatgcagatctccacttcgcagcccttcttggagtcccatcaacccttcctttgccaagtagttgggttctttatagtcgaaagacgtgttctttg

SEQ ID NO: 1905 - DNA, 352 bp, Zea mays
  Clone ID: LIB3227-029-P1-K1-C5
gtcgcgatgcttttagactacacaaataattggaatgactcatgggttgagaaagacgggcggaaatggaaaatagcgtcgctgagagtgactgcggtttgctatctttctacatcgacctcatctggtgcgctcttaatgtggtttaatccatcccgtcatgactgcggtctaaatgtgttctttatagtcatgacactaatgcttgcttttgcgcacgcaatacacgctttacatgctaaggtgcatggaagcgtaatccctggctctgacatctctgtgtactgcgcatacctgtccttcacgagtctattgagtgaaccggatgactatgagtgcaacgggctttaca

SEQ ID NO: 1906 - DNA, 418 bp, Zea mays
  unsure (1)..(418): unsure at all n locations; Clone ID: LIB3227-029-P1-K1-C6
gcaaaccccaagacaggcttgctttttgcgccacctccaggcgcagctgggaagcttagatctccacttccaccaccacctaacgaccctgcagctgcaaggatgaattctggacatactgcaggaatcagggctccaaaagaacccaccaagagaaataacgatcctttntcagatctttctgctataaagcaaaatctaccttcatctgctgaacccggacaaacaaagagccccaggagctggatgggcagcattctgacgatggatgcatgatctactgctactattggcatttgtttatctgaagaaagggaatgggtagttgaagcaccgaacaaggatctggaactgctggatgcctctacccctttcgaaactgaatggttaaaatgattgatcaacctaccagttccag

SEQ ID NO: 1907 - DNA, 303 bp, Zea mays
  Clone ID: LIB3227-029-P1-K1-C7
aagctattgatgatattgatgctcggatgatatggaagcaacgatagcagtaccagttgaagatggacagtttgcgaagtcttctacataaatttcacatgtcttgcttttgtgactgatcagctctggagtagctagagtgatgtagttgtgggcttttgaacaatagctggagtgatatgaaacattagtgatgtagttgtgggctttataattgtgaatgatattagtaaatgatctagttgtgaatgatattataattgtgatgcttttgtgaatatataattgtggtgcttttgtgtt

SEQ ID NO: 1908 - DNA, 216 bp, Zea mays
  Clone ID: LIB3227-029-P1-K1-C8
caatgggtatccgaggaggccttgcaacctcaaaccaaggtggtcaactggttacattattggagcacttggttcattgggcttgttggttggaataagaatgatacattggggtggcctaattggtgggcttttcttcatttcaaaatcttcaaagggggttgtgagaagtgtcttttgctatggtggatcaatggtggtgcgcgcagatgtacc

SEQ ID NO: 1909 - DNA, 414 bp, Zea mays
  Clone ID: LIB3227-029-P1-K1-C9
ataactctactttttataattgtaattaatctggccattgggatattacctcatgctgataattttgcccacattggtggatttgcttctgggtttcttattggatttgtgctgctggcaagacctcaatttggttggatggaacgcagcgagctacctcagactagtcaacctccaaagtacaaatcgtaccagtatgtcttgtgggttgctgcactcctcttgctggtagttgggtaagtttcaatcataaaggacaactaaactaaagcttacatctcactctgcagtctgtactaggtaacgtggtatccacagaccatagtagcctcgagctatgcgttgttgcaaactactacgttttgtttcaaattataagacattttatcttttttagatacattacctttacta

SEQ ID NO: 1910 - DNA, 398 bp, Zea mays
  unsure (1)..(398): unsure at all n locations; Clone ID: LIB3227-029-P1-K1-D1
agccacgacgtgacgctgacgctggagccgctggccaacagcccgccgctgttcgcgggcacctacacgttgcacccgcgcagccacgccgagttccccgtgtgctggtggacggggcgcctgcgcgcgcccgacgccgcccaggtggagttccacgtcggcgtcgacggcggctccttctacctggcccccaacgcgcagccgggccagcgcgtcccggtctccgtcaccccgcacggctcgccgctgcaaggccgctgccccgccgtcggctgcgccatccaaggccgctgctccgtgcaccangtgcccagcggcgactgccgcaacgtccatggaatgaagatcatctactgtaacccggacgtgttgatgcgatgcggacatggggtcgtcgc

SEQ ID NO: 1911 - DNA, 412 bp, Zea mays
  unsure (1)..(412): unsure at all n locations; Clone ID: LIB3227-029-P1-K1-D10
ggaggaagaaagagaggcttggttagctaccatctcattggctctctgcaaggcatttgatcttctcgacatgctaaagaaggaagaagaaatgcttcaagctgtaaaggaaaggaaggcaaaggatgggaatgcatttgctcgtgaaatgctcgatgaacgaacgaagaaggccgaaacatggcaccataatgctgccaaccgtgtggcatattccaaaccagctgatcctatcacttgtgcaacatttgctcaagatgtcattgaaggtagagcaagcgtttcacaagctcacgagcacaaacaccagcccctgatatttggacctgcaagtattgttggtggtggtctaaccaaggaaaggggaaggaatgacagcgcangtttttcagcctagctacaggatgccaac

SEQ ID NO: 1912 - DNA, 412 bp, Zea mays
  Clone ID: LIB3227-029-P1-K1-D12
cgtgaccatggccggcaggatggaaggcatccctaaggacccatacaccgggatctgcatatccaacgtgaccgcccgccttgcgccggacgccaaggagctgtaatggaactgcaccaacgtcaagggggtcaccttccacgttttgcccaaaccgtgcccggagctcgccgcggagggcaagccgtgcgcctttccggaggaagagctcgtgattggcccacccgagctgtcgaaatgtagctattgaggccgattgccaaaagagatcattgatcatatatgctcttcggtgatagtctagacaaacagtatgagaaatgcagctgaaatgcgtttgcattacagtgtccatctcacattactgcttgctccaattacaatgtgtggcagtggtataacttgtgactac

SEQ ID NO: 1913 - DNA, 419 bp, Zea mays
  Clone ID: LIB3227-029-P1-K1-D2
tgctgctgtcccaactgagcggtaaggacatcaccgagctcattgccgcgggcagagagaagtttgcttcagtcccatgtggcggcggcggtgtggctgttgcggcaggtgcacctgctgctggcggagctgctcctgcagctgaggcaaagaaagaagagaaggtggaagagaaggaagaaagcgatgatgatatgggcttcagcctcttcgactaggttgcacagtcatcacagtattgtttcgggcagtgaaatcaaagggaaaccagagtcatgtttagattttaaccttattttatgttggaaagtactgcaaagactgctaattgtctctgtatttggtaattcagctgtagattgctatgatggttgggatttactcgtgaaccagagtttttctatcttatatcctgaatt

SEQ ID NO: 1914 - DNA, 417 bp, Zea mays
  Clone ID: LIB3227-029-P1-K1-D3
ggctgcagaatgaggctggttacggcaagatgggcatatgtgggctcagcatgggtggagtacatgctgcgatggtgggatccctgcatcctactccagttgccacactgccatttctcgctccacactctgctgtggtacctttctgtgaaggggtctacaaatacgccacagcttgggacgctttgagaaaagatgctgcagtattaactcaagatgtaacacttttggcagaagatgctgcacagaaaagcgggatcaccatcgaacaagtcagggataggttacggtcagtgttgtctttgactgatgtcactcgatttccagtcccaaagaacccacaggcggtcatctttgttggtgcaacggacgatggttatattcccagacattcagtgatggagctccagaaggcat

SEQ ID NO: 1915 - DNA, 406 bp, Zea mays
  unsure (1)..(406): unsure at all n locations; Clone ID: LIB3227-029-P1-K1-D4
acatgaagacgcgcatcatcccgcgccacgtgctcctggcgatccgcaacgacgagggagctcggaaaggctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttcgtccttgtgtcttattgtatgttcgtcttcatcgagaagatcttcagcaatcagagctcgttgtgtactaatgttcccaaaanaaaaaaaataanattaaa

SEQ ID NO: 1916 - DNA, 415 bp, Zea mays
  Clone ID: LIB3227-029-P1-K1-D5
cgagccaagtgcatgaaattgttgggcgcataaatggtcgattcggaacgctgactgctgtccctattcatcatttggaccggtctcttgatttccacgccttatgtgctctttatgcagtcactgatgttgctcttgtaacatcactgagagatgggatgaaccttgtgagctacgagtatgttgcatgccaagggtctaagaaaggagttctgatacttagtgagtttgctggggcagcacaatcccttggagctggcgccattctagtaaacccttggaatattacagaggttgcagactcaatacatcatgctttaacgatgccatccgacgagagagagaaacgacacagacacaactatgctcatgtcacaactcacacggctcaagattgggctgaaacttttgtatt

SEQ ID NO: 1917 - DNA, 197 bp, Zea mays
  Clone ID: LIB3227-029-P1-K1-D6
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcggccgttttaaaggatcaaagtttacttacccgtgcatgcaacgtaaaagtttttttatagggcaaccaaaattaaatta

SEQ ID NO: 1918 - DNA, 417 bp, Zea mays
  Clone ID: LIB3227-029-P1-K1-D7
ggcacagagaggacaacctttctctacccaagtgctgttgatcaatttaagaagcagttttctcatcttgaagagagtggtggtaacggcccatcagttccaacagacaggaaacatgcatcccttcccaggaccactgtggttcactcgaatccaattcctgccaaagaacaacctcttggtgcctcatcaagggttagaccagtctctgatgattcatgtaagaacccttgggagaaaggaagtggtcctggaaatgtttccaggacatctctgactccacaagggctgcaagcacaagcaggatcagtaagagttaatggcccggtgacggattcaaggtatcctcctcaccaacagatcccacaagcatacggttaccgccaaatgcctgcaaggttggacagtaccaaccca

SEQ ID NO: 1919 - DNA, 416 bp, Zea mays
  Clone ID: LIB3227-029-P1-K1-D8
ccatggcataggggaactgtttcactgcgccccaaacattcctcattattcaagaaacaaggccgttggtatcatgaaagctgggcagacatttacaattgaaccaatggtcaatgcaggggtttggaatgatcgtctgtggcctgacgattggactgcagtgactgcagatggtaaacggagtgctcaatttgaacatacacttttggtgacagaaacaggatgtgaagttttgacggcacggttaccctcatcaccggacgtttttccatggttgaagaagccgtgatggggaacgccaccaacagcaagtgatactgttacactgggtcagcaaaaagttttgttctgctctatcagtcggccaaagctgaaattttcaaatattctagatcagagtgattagcatgctactg

SEQ ID NO: 1920 - DNA, 387 bp, Zea mays
  unsure (1)..(387): unsure at all n locations; Clone ID: LIB3227-029-P1-K1-E1
gcctggttgcccgaggctgacccagcacctgcgatggaggagaaggctgtcacaaatggagcggcagctgctgatgttgctgctcctgataataaggataacaccaaggaagaggttagcaagagcaaggagccagtagcgaataaggatgctgaagagcagaacaaaggctcggaaaatggtgctgagggccattcaagtggagatgtcaatatggcagaggctgagatcactgaggaaggtggtggtggtgatgctggtgcggcaaagcaggtggattctggagatgtcaaaacggatgccgatacaaaggaagatgccaatgcgagaacagaagaaggtgaagatgccaagatgactgaggctgacgtangaagtacagaggtc

SEQ ID NO: 1921 - DNA, 414 bp, Zea mays
  Clone ID: LIB3227-029-P1-K1-E10
atcgccccctggcaccacatatgctactctactggaagaactgtctgagaaggacccccaggcatttatctgccatttctataacgtctactttgctcatactgctggaggccgaatgattggcaaaaaggtttctgagaagattctggacaagaaagagctggagttctacaagtgggagggcaatctctcccagctgctgcagaacgtccgcaacaagcttaaccaagccgcttcaagctggtctcgggaggagaaggatcactgcctggaggagacggagaagtcgttcgcctactcaggaggcctcctccgccacatattcacctgatttaacactgttggctgatccagtttcaaacgctgtacatacataaccttttgactgttaaaactttattactggtgaggggg

SEQ ID NO: 1922 - DNA, 404 bp, Zea mays
  Clone ID: LIB3227-029-P1-K1-E11
ggaacctcgtgttttgcgtggagaaggtaagccgctcaacgctcgtcgacgtgcggagctatgcacaaatcgaatcgccaacgttcttacaaacaccgattgggtttgtttatggaccgagaggtgacgaccgtgcaagtgatgtggtgccaaccacaagatgcagtcggtggacgacccaaggaaggatggactcaaccagtatttgctcgccaagcgagtacctcccccagcaaacactatctaagtgtcaaactaaaggtactccttaggatgattggttgatggtgtgacttggcctccatccctgccaccgggatagatggtcgagtgggttactgcttccgccagagaggaccaggaggagtagcgtggccaggcttcgccatgttgctcggttttct

SEQ ID NO: 1923 - DNA, 413 bp, Zea mays
  Clone ID: LIB3227-029-P1-K1-E12
gactgcttactcatctgacatccaagttgagtttagtgaaaggaggaaaagacctaggtctgtagaaaacagcgcagacggtgtgagcaacccgacgtggacgcctgacaaaggaagggctggagtttcatcatacagcaaggacgagactgaagatgatggcgaagacgaagtcattactagcggcttacaaaagggaaacagtttcacatggaataccctaggaagaagaaggtcaagccacttcagttcgtcatcggactcgagagggcgcccaacattctaatggcaacatacatgaatgttatggcctcgacctgttggttgatggaatacccttgtagagcagggctgcgactatgactgagtaccttcaagcttatgaactttattaggattactagtatactgta

SEQ ID NO: 1924 - DNA, 420 bp, Zea mays
  Clone ID: LIB3227-029-P1-K1-E2
cacaagcaaaagcaacaaggcagcagcacaagcaagaaccacacctcctcccttcgcctgtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggccaccgagggcggcggctgcgactgcaacacctgcaagtgcggcaccagctgcggctgctcctgctgcagctgcaactgagccggcccggctcggcgatggcgcacgagagtcgagaggacgacgacgaggaggcgtataataaatataatagcggcgtccagtaaataagatcctgtcaact

SEQ ID NO: 1925 - DNA, 393 bp, Zea mays
  Clone ID: LIB3227-029-P1-K1-E3
ccgggacgtcaagtccagcaacgtgatgctggacgaggcgtaccgcgcgcggctgggcgacttcgggctggcgcggcaggcggagcacggcgagtcccccgacgcgacggcggcggcgggcaccatggggtacctggcgcccgagtacctgctgacgggccgcgccagcgagtgcaccgacgtgttcagcttcggcgcgctggcgctggaggtggcgtgcgggcggcggccgatcggcgccacccctgagggcgtcggcgggtgctgcagcaacctggtggagtgggtgtggagcctgcacgcggaggcccggattctgggcgccgtggacccgcggctgggcggtgagttcgaggagggcgaggcccggcgcgccctgctggtggggctggc

SEQ ID NO: 1926 - DNA, 384 bp, Zea mays
  Clone ID: LIB3227-029-P1-K1-E5
agcggcccgaggagatcggcgcgggcgaccagggccacatgttcgggtacgccaccgacgagacccccgagctgatgccgctcagccacgtgctggccaccaagctgggcgcgcgcctcaccgaggtgcgcaagaacggcacctgcgcctggctgaggcccgacggcaagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacctcaacccgtccgggcgcttcgtcatcg

SEQ ID NO: 1927 - DNA, 394 bp, Zea mays
  Clone ID: LIB3227-029-P1-K1-E6
agcggcccgaggagatcagcgcgggcaacctttttcacatgtacgggaacaccagcgcgtagacccccgagctggatgccgctcagccacgtgctggccaccaagctgggcgcgcgcctcaccgaggtgcgcaagaacggcacctgcgcctggatgaggcccgacggcaagacccaagtgacggctagggacgtgaacaaggacacagccatggtgcccgtccgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacctcaacccgtccgggcgcttcgtaatcggcgggcccc

SEQ ID NO: 1928 - DNA, 419 bp, Zea mays
  Clone ID: LIB3227-029-P1-K1-E8
cgccccaccgggggggcggggggcaaggcttcccttgagccaaacaaaggataaggcctctaatcttatattttgcacaccgtacgcacacgcaaaggtttggtatggtcacgcaatcgaagactttctctaatcacacacagattaacaatttgtatggaggctcacccagtagggataactaggggccacctgaaaagggctactccaaaagccgcttacaccccgagcgcacatgtccggccaccaaccaagggcaggactgcactgactgtaatgctccaacgagccattctgtagcatgtgcacaaactaacacacgtgctgaacctaggtcaataacgactcttgacgctgatccccccattgagatgacgcactttattcagcgcttccttgagaaacttcatgacatggac

SEQ ID NO: 1929 - DNA, 415 bp, Zea mays
  Clone ID: LIB3227-029-P1-K1-F1
cgagcgcacgctcaaagagatcaaggccgtccccgaagacgagggttaccgcaaggccggtgaatccttcaccggtcaccgcctccagatctgccaggaggaggaggactggaagcgcatcgaggaccgaatcggatgcgggcaggtcgaggagctcatcgaggaggccgaggacgagctcaagctcatcgctaaaatgattgaatgggatccatggggtgttcccgatgactacgaatgtgaggtgattgaagacgacaccccaattcctaagcatgttcctcagcaccggcctgttgctcttcctgaggagttcttcaaggcactagatgctgtcaaatctgatcctgctcttcaaggcgatgctcctcctcaagtgaaagcgtaaggatggctgttcctggctaacgtcatt

SEQ ID NO: 1930 - DNA, 412 bp, Zea mays
  Clone ID: LIB3227-029-P1-K1-F11
gttcaggagcgtggagcaccgggtgccagccaacaagagcagcgacacggcgagggtctccgtggcgtccttcttcaacacggacgtgaggaggtccgagaggatgtacggccccattccagaccccagcaagcccccgctgtacaggagcgtcagggcccgagacttcatcgcaaagttcaacaccataggactcgatggccgcgcgctcgaccacttcaggctctagctgcctggctggctacgtttcagattcgtcctttcatttgctttggtctctaattaataattccaaataataagcccgcggatggacctctgtctgtctgtctgtaatttagtttccaagtttagttgttgtggtaataattcctgtatgaattatgtcataaataaaagctagggaaccttg

SEQ ID NO: 1931 - DNA, 409 bp, Zea mays
  Clone ID: LIB3227-029-P1-K1-F12
gattaattatgctacaggctgtatatttgagtatgatgctaagcaccctgaagggtctggtattggctttaaagaggaagacacgcccaactttattggttccttttattccaaaactaaagcaatggtggaagagctattgaaggagtatgataatgtctgtactcttagggtcaggatgcctatatcatcagatctaagcaaccctcgtaacttcatcacaaagatagctcgttacgacaaggtggtgaacattcccaacagcatgacaatcttggatgagcttctgcctatctccattgagatggcgaaacgggactgcaggggcatatggaacttcaccaaccctggcgctgtaagccacaacgagattctagagatgtacaagaaatacatcaatcctgatttc

SEQ ID NO: 1932 - DNA, 194 bp, Zea mays
  Clone ID: LIB3227-029-P1-K1-F2
ggattgtcgtgttagaacataaacttttcgtacgcatcattttccctttcaaacaattgtccaaatattcgagttgaacatgtatttcaataatcagagttgtaagcttgtgaacaatgtgaatctgtgaactttctgtcacctatgattcatgtatatgtggcttgtaatctgtgcctatacattaatatgct

SEQ ID NO: 1933 - DNA, 419 bp, Zea mays
  unsure (1)..(419): unsure at all n locations; Clone ID: LIB3227-029-P1-K1-F3
atcgcctgcaccgtcgagcgcatcaaggccgccgtctgtgcggaagccggcaacccgcagtagccatccatgcgatatagaggagggagaagggggcatgcagcaaggttttgtggaaatgttagtggggagtcaagaacgcacctcagactccttgccgtgtggtgctcatactgaaaggaaaaagaaggcgtcaccactatgcaagggggatggttcgggtattgacttcgccgtccaatcaaactactacagaaaggacgtacgggtgctgtggagaagatggatcgatgctgtttctagggtttacttcctcattgttcgtggtgctgcagtagttcaggctaaggtgcctgtgcctgctcgcagtcgtagctagagaacacagagatntgttgcctctgatctttcctttttgg

SEQ ID NO: 1934 - DNA, 278 bp, Zea mays
  Clone ID: LIB3227-029-P1-K1-F4
aaaaaagggcgggccacgccacccgtccccaccacttactaaaaataacatccaaattctaatcaaccaaaaaacaaaggggccgaaaacaatttttttttattccaaaccaaaaaaacaacccaacctggacgcctgacaaaaaaaaggctgaagtttcaacatacagcaaggacgagacttaagattattgctaaaaccaagtcattacaaacaacttacaaaaacaaaacaacgtcacatggaataccctaagaaaaaaaaggtcaaaccacttc

SEQ ID NO: 1935 - DNA, 417 bp, Zea mays
  Clone ID: LIB3227-029-P1-K1-F5
cccacacagaaaaccctagccgccgccaccgaagcggcctcccaggtaagcaggatcgtccagcccgccgccgccatgaagcgcaatccccgcgtcacgagctcccgccggaagtgccgcaaggcgcactttacggccccgtcctccgtccgccgcgttctcatgtccgcggggctgtcgacggagctccgccacaagtacaacgtgcgctccatcccgatccgcaaggacgacgaggtgcaggtcgtgcgcggcacctacaagggccgtgaggggaaggtggtgcaggtgtaccgccgccgctgggtcatccacgtcgagcggatcacccgcgagaaggtgaacggctccaccgtgaacgtgggcattcacccctccaaggtgatcgtcaccaagctgaagctcgacaaggaccgt

SEQ ID NO: 1936 - DNA, 412 bp, Zea mays
  Clone ID: LIB3227-029-P1-K1-F6
ccgctgaagcgggggcagctcaagcggcaaatcgtgaggaccatcagcagcctcgtggtgccgaggcacgccgccgtcgctggcgctgcttgctgccgctgggtcgagggagacggcagatcgcggcagcggattcggcggaggacggagctacaactgatgatgaatctctcagaggaggcgtgatcagagatacgattcgcagcgtcaggtttgtgtgtacgtactacttgccgatgccgatgcaaaagcagcacgtagcgcatctgttgagcgcgtgttcttcttagagcttagtaatagcttaattatccttgtttttccccctgttgtacaaaacaaaacttgcaggcttttttagatggttgatagagttttgttacataaatgtaatgctagcttcatagctttt

SEQ ID NO: 1937 - DNA, 415 bp, Zea mays
  Clone ID: LIB3227-029-P1-K1-F7
cgaaccccaaaccccaaaccctagcttcgctcgttgcggcgagccggcgatggcgaagtctctgcgatccaaacgcgagaagcggcttcggacgttgcgccgggagatagcggagccgttctacgacaagaaggaggccgccaagctcgccgcgcaggccgcagccctagctgctgccccgctcccggtccgcgggcccccgccgtcccaggatgccggcacctcccgcgcagctagctcggcctcggctatggatgtggagatgtctggtgcagggaacagcaggtctaagaccttcctgaggccacttggcagcattagcaagaagaaggtgcagcttcatttgaagatcaagaaagacaagagaaaagctaggaagaagggaaagttttcttttaagaagtagaggagtgta

SEQ ID NO: 1938 - DNA, 64 bp, Zea mays
  Clone ID: LIB3227-029-P1-K1-F8
ccggggcggcccacgcgtccgcgaaccccaaaccccaaaccctagcttcgctcgatgcggccaa

SEQ ID NO: 1939 - DNA, 375 bp, Zea mays
  Clone ID: LIB3227-029-P1-K1-F9
ggagggtgagggggagatggcggagaatccgcagctgtttgggaacgggatgccggtgccgttctacggcgagatgttcgtcctcgtccgcgacggcgtcgagttccacgtcgacaagatcccgtcagctcctggaggtcatgtgaaaacaaaaggcacaatttacctgtccaatataaggatggtgtttgttgccagcaagcctgttggcaacttctttgcttttgatatgccactgttgtttgtgcatggtgagaagttcaatcagcccatatttcactgcaacaacatctctggattcgttgaaccagtcgttccagacaatcagaacagggccctgtactcaactcacaccttcaagatcttgttcaagga

SEQ ID NO: 1940 - DNA, 348 bp, Zea mays
  Clone ID: LIB3227-029-P1-K1-G10
gggagacagaaggatattttatcaaaagtggaattgtcacggtgattaaagatgctttaattcctagtggaacaatcatataaagtcagccaacaccatgtatataaggttgggttgcatcatatggtgatcgccaatgtgcatcaagttctctcatcccttgcgagaccatgcttatttccattgcaaaatcatcaagctctgcatcaacttgttgtggataataatgaaataataaatggtgccattccatggcaacatttttctgtcagtagtttatgaggcactgttctaaatgtactgttgagtggaatttgaatatgtatgcttttgcaatcgcacacctaa

SEQ ID NO: 1941 - DNA, 306 bp, Zea mays
  Clone ID: LIB3227-029-P1-K1-G12
acggcagaatttcagaatgtaaaccttgtgtggacttctcctgcacccagttgtgtacacaccttttctcgctgtttgccacaaatgatcgcgtatgtggttcagacgatactacagcacaatggctgctatcatgcagcttttgatctgggcctatgattctgcctgcgagaagctgacatatgcctagtacttgcgtgctattatatacatatagataatagacagggtcttttaacatgtacttgcaaagggaactgttgctgggaagatggttatttgaatatctattgtaagaagccactt

SEQ ID NO: 1942 - DNA, 404 bp, Zea mays
  Clone ID: LIB3227-029-P1-K1-G3
agattgtctaggctgggctggtcttgtctatgagcatgttcttggagaagaaaagtacacatttgtggagaatgtgaaaaatcctcgctcttgtactatactgattaaaggacctaatgaccataccattgcacaaatcaaggatgctgtccgtgatggtctaagatctgttaagaacacagttgaggatgaagcagttgtgctgggtgctggtgcttttgaggttgctgcaaagaagcatcttatcgacaatgtgaagaaaaccgtcaaaggacgagcacaacttggggtggaggcgtttgcggaagctcttcttgttatacccaagactttggctgagaactctggtttagatactcaagatgtgattgtttctctccagaatgagcatgaccgtggattag

SEQ ID NO: 1943 - DNA, 415 bp, Zea mays
  Clone ID: LIB3227-029-P1-K1-G4
ctctccatggccaacgccgggcccaacaccaacggctcccagttcttcatctgcaccggcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttacgtgtggatctgtgaaccccatggcgcctctgcttgattcgtgtttcacctgttatgtt

SEQ ID NO: 1944 - DNA, 386 bp, Zea mays
  Clone ID: LIB3227-029-P1-K1-G5
gtccgcccacgcgtcccgttcaaactttattggtaatgcgtgccttatgcagatcctgtacaatatctactgagggttcttctaatccttttttatggttcgtttttttccaggataacatttcataggattctaactcgtactacatcttaacaatgatctccctttgacggtattgagtctttcgtcattaccttctcgtttggtatgggtgccattccatggctcatgatgtctgatgtaagctacttctttctctactgctctgctagctcattgtctgcctgaactgcccactgcccccattttttctccgccattatacgtcggcataggaggatgttcctggccgcacaaccgctagagacaggtacacaggacgccta

SEQ ID NO: 1945 - DNA, 417 bp, Zea mays
  Clone ID: LIB3227-029-P1-K1-G6
gggagcacctgcctgctcctgcgcggcggcggttgagcggcgtggaggaggcactacccgttcttctgggctgtcaggccttccgtaccgccgccgccgtcgccactcccactcccacagccgcgcacgcgcttctcctcctcctcctcactgcgctccaccaagagatccgccgcaaagacgtcaatggactcgtcttcagtcggtgaacccttctacgtcgtccgcaagggggacgtcatcggcatctacaaaaccctcagcgaatgccaagctcaagtcagcaattcggttcgcgacccttctgtcaccgtcttcaaaggctactcgctgcgtaaagacaccgaggaatacctcgccgcgcgcgggttaaggaacgctctctacgccattgatgcaacagatgcacgagatgaa

SEQ ID NO: 1946 - DNA, 413 bp, Zea mays
  Clone ID: LIB3227-029-P1-K1-G7
attcagtcgagtggcacaaagttgacaccaaggagctgccattcgttggccgcgccaccccacatggctctttattccttggcttgtcagagggcaatggatccatcaatgcttattgtatcagtgtcactactactgataatgatcgtgctcctaacttatccatcactatgctcccgttgaaatacatggataatgaagttgatgcagggccctgcttcttttccttggaggatggatgtttttgttcattcagtttttcgcttgataaatgcagttggactcttcatcccaagaagctcgaattgtttccaaaggaggcacatttaaacctgagaacatatcagacagagaacctttcatccctggaggttccagaggaaacattgttggctgtgaagccggagattgca

SEQ ID NO: 1947 - DNA, 382 bp, Zea mays
  Clone ID: LIB3227-029-P1-K1-G8
gaaatgctgaactcccagaggcggtggaccttttatacaaaggaactatgagagttttgcttgtattactgcatgactttcctgaatttatttgtgattaccacttcagtttctgtgatgtgattccttcaagttgcattcaaatgcgcaatgtcattcttagtgcttttccacgtaacatgagactgccagacccttctactcctaatctaaagattgatttgttggctgaaatttcaatagcaccacgaatcatgtcagatgttgatggtaccctcaaatcaaagcagttgaagactgagtttgatgaatatctcaagaggccggaaggctcttcctttctaagtgtcctgaagcaaaatttgctgctgcctcagaatga

SEQ ID NO: 1948 - DNA, 407 bp, Zea mays
  Clone ID: LIB3227-029-P1-K1-H1
gcctccgaacacttctgctcgacccttgtctcccgtcacctctcttcgttcccgtctgtccgttttggttgtttggtgaaatctgtcgctatcttcgtcgactccagttcgtcgtccatttcttaaagttcaaaaaggcctgctttgtccccatttttctccccgtcccaagtttgccagatctaaagcatcacgttgaacgatcataatggcaaatcaacaaggaactcggcggggcatctctaaaaggaatatagataccaatgacgtcttactccatcagaagctactagctcctaacgaagaaccaaatctggaaaaatacggactacaacattatccgccattttagtaatttatgaaactatgaacattgtttttgtgacatgtaaatgatattatcttcc

SEQ ID NO: 1949 - DNA, 412 bp, Zea mays
  Clone ID: LIB3227-029-P1-K1-H10
acggaaaattgcagatttcaatctttcgaatcagtctccagatatggctgctcgtttgcattctactcgtgtacttggaaccttcggctaccatgctcccgagtatgccatgactggccagctaactcagaagagtgatgtatataagctttggggttagttcttttagagcttctaacacgaaggaaaccagtagatcatacaatgcctagaggtcagcagagtctggttacatgggcaacacctagattgactgaagacacagttaaacaatgtgttgatccaagattgaagggagaatatcctccaaagggagttgccaagcttgcggctgtggcggcacttcgtgggccatatgaatctgaatttaaacccaggatgagcatcggagtaaagcactctctcccttatt

SEQ ID NO: 1950 - DNA, 253 bp, Zea mays
  Clone ID: LIB3227-029-P1-K1-H12
tcgaaaaaaaaaataaaaacatgaaaaaaaaaaaaaaaaaaagaaaaaaaattaggggggcgaaacacattcgggcgggagtggtcaaaatctgaaaacttttcttaacatggatgctatcaatgacttggtagtgtcaggaaaaaccaaccatagtggacagactgatgtaataatattctgaagtggcacgaatctagaagttaggcaccacagaatctgaaggagagctgctttcttagcttgttgactt

SEQ ID NO: 1951 - DNA, 416 bp, Zea mays
  Clone ID: LIB3227-029-P1-K1-H2
ggaagcagaggccaataggctcaaactgacacctgagtatcttgagctgaggttcattgaatcaatcgccaataactcaaagattttcttcggtgaaaagattcctaacatgatcatggatcaaaggttgctcaagaactaccttgatgctgctcctaggaaggaccattatgagatgtagaagcgtgttccgtgagttggaagcaaaagacctttgtgtgtgtgatcccaccgtccacgcagtagataggattcccacgagccgttcagtacctcagtaagccagaaaagactcatcaggaccctcttgaagatttagatgcaaaaattttcttcgccaaaaatgtacagttttgctcactgacttaggacatgtttggagcatctatttttttagaaactggtttatgaaaact

SEQ ID NO: 1952 - DNA, 59 bp, Zea mays
  Clone ID: LIB3227-029-P1-K1-H3
cctggagtggctggaggggaaaggcttggatgcgcgccagattttattgcgggccctgg

SEQ ID NO: 1953 - DNA, 393 bp, Zea mays
  Clone ID: LIB3227-029-P1-K1-H4
ctcatccctgacccccgtaccgcagcgtaaaccctagtccccggcggcgaccttgcggcctccgctgcgctctgactggtgcgcgcttagacgaggagctgcggcggccaagaccaatcgaccatggctacccgtatccagtttgagaacaactgtgaaattggtgttttctccaagctgacaaatgcttactgtctggtagcgattggagggtcagagaacttctacagtgcctttgaggctgagcttgcagatgccatccctgtggtcaagaccttttattggtggcactataataataggccgactttgtgttggaaacaagaatggacttctattgccacatactacaaccgaccaagagcttcagcatctgaggaattgcttgcctga

SEQ ID NO: 1954 - DNA, 420 bp, Zea mays
  Clone ID: LIB3227-029-P1-K1-H5
agtccctcttcatcgacccaaacaggccctcacgctaatcaaatcgttcttgactgggagcccaatgcctgtgcaatccagcacacacagcaacatgtaatccgtgttgttgcaactgattcacgagatgaatgaacatcccgaagcacccaagtcagccagttgtccaacccggcttgttctgcaacttgctgtagttgtttatgtatcagagctaccggtgccggttaccgcagcagccgtgcttttatcggccctgttggtgcttgttgcagtaccagttatcccctaaggcaggggacagaaactgcggaatagtttttgtttgcattgacgtgacagcactgtaatcttaaacatcgtaccatagtcctttctatgacaaaggtgtggtttctgatgtctgcaataaatgatctg

SEQ ID NO: 1955 - DNA, 420 bp, Zea mays
  Clone ID: LIB3227-029-P1-K1-H6
acgtgctatcaggcttcactgagaactgtaaaagtggttttggaagaaaccgtatcacctacacagacacgtgcgccgtgagtggccaagatctgaagacgtatcacaacatggatgctatcaatgacttggtagtgtcaggaagaaccaacccgagtggacagactgatgtaatcgtcttctgcagcggcgggttcgagaagttaggcaccacggaatcggaaggggagctgctttcccagcttgtcgacttgctgaagctgtctggggctagacacacgattctctacgcttcccagccatctggttatctactggagaacccttccggctcgccagtggctaggcaccttgcggagaggactaacggtacaaaaactggcctactgagcaaatgtgacggagagtgcctagtcaaat

SEQ ID NO: 1956 - DNA, 168 bp, Zea mays
  Clone ID: LIB3227-029-P1-K1-H7
ggctatctggctttactgagaactgtaaaagtggatacagaagaaaccggggcggggacacagactggttggccgaaagtggccaaaatctgaagacgtatcacaacatggatgcgatgaatgatcttgataaaggtcaggattgaaccaacccgtgtggacagtatg

SEQ ID NO: 1957 - DNA, 405 bp, Zea mays
  Clone ID: LIB3227-029-P1-K1-H8
agatctctgagcttggtatttatcctgctgttgatccactggattccacatcaagaatgctttctccccacgtgctgggtgaggatcactacaacactgctcgtggtgtgcagaaggttcttcagaactacaaaaatcttcaggatattattgctatcttgggtatggatgagctcagtgaggatgacaagctgacagtcgcccgtgcaagaaagattcagcgtttcctgagccagcctttccatgtcgctgaagttttcacgggtgctccaggaaagtatgtggagctgaaggaaagcgtgaagagtttccagggtgttttggatgggaagtatgatgacctccctgagcagtcattctacatggttggtggcattgaggaagtcattgctaaggctgagaaaa

SEQ ID NO: 1958 - DNA, 406 bp, Zea mays
  Clone ID: LIB3227-030-P1-K1-A1
gcgtgctgcagctacaattggagcatggttgaacatattccagttcttggttgtgatggcaatatgcaccaactgcttgcttctcgtttgtctgtatgacgaggaggggaaatggaggattgagccaggactagcagcaatcctcataatggagcatgctctcctcttaatcaagtttggtttctcacactttgtgcctgaggagcctgcgtgggtgaaagcaaatcgtgtgcgatatgtagctcaggcacaaaacgtctgctccaaacaacttttgaggagcatttcaaaatttgacggaaaactggattgagaaacatcatgcacagtttagcggttatcgctggttttgtagtttaggtagagcggttttgtatagtacaaagatgtacaaatctaggggtgg

SEQ ID NO: 1959 - DNA, 195 bp, Zea mays
  Clone ID: LIB3227-030-P1-K1-A11
cgccagcatcttcccgacctcgagctacttcgtctcccagtatgatatcaggatactgatctgtaaggaccccaaggagggcaactgttggatgcagttcggcaaggactacttgctggcttactggccgtcgttcctcttgtagtacctggcggacagcgcgtcgactgtggagtggggcggttaggttatcta

SEQ ID NO: 1960 - DNA, 369 bp, Zea mays
  Clone ID: LIB3227-030-P1-K1-A12
tcaacggcgccgtgtgcctcgcgcccaccaacccgcgcgacgagtaccagcactggatcaaggacatgcgccacagcaacagcgtcatggacgaggaagggtacccggccttctcgctcgccaacaggatcaccggctaggccatcaatcactcccagggcgagggccacccgttcaagctggtgccctacaacctcctctaccaagacaagtttgctctgtggactgagagaccatgcgttttacacaagattcgatgcgtgcgaatggtcaacatcatctacctcaacttcgacgccttccacggcgacaaggaccacggcggcgtgcgcgacggcaccaacatcgtgctctggaagtggtacgggg

SEQ ID NO: 1961 - DNA, 103 bp, Zea mays
  Clone ID: LIB3227-030-P1-K1-A3
acgaaaaaaaaaaaaaaaagaaaaaaaaaaaaagaaaaaaaaaaaaaaagaacaaaagaaagaaaaaaaaaaaaaaagacgagaaaagaaaaaacgaaggaaa

SEQ ID NO: 1962 - DNA, 354 bp, Zea mays
  Clone ID: LIB3227-030-P1-K1-A4
gccttacacccaaccagttgtgactttgtggtacagggctccggaactactattaggagcaaaggagtattcgactgctatcgatatgtggtcattaggttgcataatggcagaactcttgtcaaaagagccactcttcactgggaagtctgagatagatcaacttgataagatttttagaatactcggcacacccaatgtggagcggtggcatgtgtgttccaaattgcctggcttcaaaggcaaccttcgtatagcgaccctacaatatgataaagggacaatatttccagctgtatccttcacgggggggcttgacccttgttaagaagcttgggtttgaccctgcttaaa

SEQ ID NO: 1963 - DNA, 378 bp, Zea mays
  Clone ID: LIB3227-030-P1-K1-A6
cccaattttgggactcaatcttctgaggctgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagttcattacataggtgcaccctgtatgggatcttttaggcgggcc

SEQ ID NO: 1964 - DNA, 383 bp, Zea mays
  Clone ID: LIB3227-030-P1-K1-A7
caccgcgtgcgaaccaagcagaccacaacaagaagaagcgtagtcgtcgccggaaggaaaggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcattcgaggaaagaagggcactgggggcattactatcaagaaaaccggcatgtccttgattattg

SEQ ID NO: 1965 - DNA, 335 bp, Zea mays
  Clone ID: LIB3227-030-P1-K1-A8
tcgagtcgcgccggcgccgtcgccgaaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggtaagaaggtcatggccgtccgcattatgaatctcactctggaga

SEQ ID NO: 1966 - DNA, 277 bp, Zea mays
  Clone ID: LIB3227-030-P1-K1-A9
cccttccgtgggtccaacccaagcgttattccaagtgcttgatcttgtgcccctgatgccttgggacaggtttcacaattttaagccctccttcaatttgtccaggcttattcccaaatcttgcaggccatgctttaagagcttgggtaacaaaacccaccaattctgctgtttgattcaagaaaattaagctgaggttctccccttggtgaatgaatcttctgagggggggcctggagggaacatactttttcaacttgcatttgctgtgccacaa

SEQ ID NO: 1967 - DNA, 396 bp, Zea mays
  unsure (1)..(396): unsure at all n locations; Clone ID: LIB3227-030-P1-K1-B1
gtgggtccaacccaggcgttattccaggtgctggatctggtgcccttgatgccttgcgacagcttccacagtttcaagcactccttcagttagtccaggctaatcctcaaatcttgcagccaatgcttcaagagctaggtaaacaaaacccacaaattctgcggttgattcaggaaaatcaagctgagtttctccgcttggtgaatgaatctcctgagggtggtcctggagggaacatactaggtcaactggcagctgctgtgccacaaacgctgacagttaccccagaggaacgggaggctatccagcggctcgagggaatggggctcaaccgtgagcttgtgctagaagttntctttgcatgcaacaaggacgaagagcttacagccaactacc

SEQ ID NO: 1968 - DNA, 329 bp, Zea mays
  Clone ID: LIB3227-030-P1-K1-B10
gaaagaatccgactggttccagatgagcttccccaaggcagaagtgctgatcctcaacttcgcgtcgagcctgtactacctgccgccgttcatcgcgacgatgcagaacctgaaggccctggtgctgatcaactacggcagcggcagcgcggccctggacaacctctccgccttcaccacgctgagcgggctgaggagcctgtggctggagaagatcatgctgccgccgctgcccaagacgacgatcccgctgaggaacctgcacatgatctcgctggtcctctgcgagctgaacagcatcctgagggggtcgacgatggacctgtcga

SEQ ID NO: 1969 - DNA, 104 bp, Zea mays
  Clone ID: LIB3227-030-P1-K1-B11
aattcgtgtatctaagggtgaatttctaaagcaaaaaaaaaaaaaaaaaaggcaaacaaaaaaaaaaatagaaaaaaaaagcgaggtcatgataacttggaacg

SEQ ID NO: 1970 - DNA, 362 bp, Zea mays
  Clone ID: LIB3227-030-P1-K1-B12
gtacccaatctcccctacaccagaaaaattcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatacgcgacgccgtcacctacaccgagcacgcgcgccgcaagaccgtgaccgccatggacgtcgtctacgcgctcaagcgccagggacgcaccctcta

SEQ ID NO: 1971 - DNA, 405 bp, Zea mays
  unsure (1)..(405): unsure at all n locations; Clone ID: LIB3227-030-P1-K1-B2
ctgaagtacgggaacaaatttacaaggtggcatcagtaaacctgtgctccaatgtttcggggcaaattcttgctagccttgtaatgaacccaccaaaggctggggatgaatcctttgaatccttcatgtcagagagggatggtatcctttcatcgttggctcggcgtgcaaaggctttggaagaagcattcaacagtttagaaggaattacatgcaacaaagccgaaggtgcaatgtatctgttcccacgccttcatttaccccagaaggcaattggagctgcccaagcagtcggcactgcgccagatgcatactacgcaaaacgcctactggaagccactggaatcgtcgtcgtncccggttctgggtttggacaggtccctggaacgtggcacttcaggtgca

SEQ ID NO: 1972 - DNA, 407 bp, Zea mays
  Clone ID: LIB3227-030-P1-K1-B3
aaacgagaagtcgaagtacccgttaccgccgccgcctctcgcctagccgccggagaagcgccgctcgctcaggaggacagccatggcgccggagccggaggatgatattatgaacgagaagaatccccgcccgctcgacgaggatgacatcgcgctcctcaaaacctatggactggggccgtattcgaccagcattaagaaggtcgagaaggagatcaaggaaatggccaagaaaatcaacgacctctgtgggataaaggagtctgatacagggctggctccacctagccagtgggatttggtttcagataagcagatgatgcaagaagaacaaccgttacaagtagcaagatgtacaaagattataagccctaatacggatgatgccaaatatgttataaatgtaa

SEQ ID NO: 1973 - DNA, 278 bp, Zea mays
  Clone ID: LIB3227-030-P1-K1-B4
ggaattgtatcagccagtcgagagcttagttcccgaatctttttttaatcgtaacggaaaatttgtccgtcatccttctgatgagaggaactcattaaacaggcgaaataggtcttttttgcgctgggaaaagtttgcgcttgatgcataataatttttaggacggcaacgctcttagagcgcaggttttgttcacctcctgtaccgaggaatgcttactaagtcccatttcacattatggtctttatgaaatagtgcacctcggttaatgttctttt

SEQ ID NO: 1974 - DNA, 387 bp, Zea mays
  Clone ID: LIB3227-030-P1-K1-B5
ctttgaagagaaaggcaaactttgaagagagcaagagatttaaagaacagttgaaggcttacaaaagggaaattgcagagaaaagcgaggaatgataacttggaacggaggacaaggccgtagaggctcttaatctgtgatgacctgcccttgattttgtgaaggatctgtcgagtgtttttgaatataatgtttctaaaaaatattatactcttttcctagtagcagctaaactttaacagcttaaagtttcttccatgactaccgaatatgtttccaatttgttcatgcatgcgtgcaggagtcctctgtatcaaatttggacaacccactcttgttgcctagtataagcaggttattggcgagttccttttatttatgctattt

SEQ ID NO: 1975 - DNA, 391 bp, Zea mays
  Clone ID: LIB3227-030-P1-K1-B6
ctcgaactatatatgcttactcaattaatgttgaatggttcctcatacactgatcaccatcaatggcgatgtatcagtgccatggcgttcatcataatgtaagctctgaataggaaatgacacaattcagaggctataggagactaattctaagacacatcttagctaggttcataaggtaactagaaagaaaaggtaaagctatgtggatcttacatggagatgtgccatggcgttcgttagtgccattgcatctttcggagatcgccataccacatcgttcattttctctgcgcagaatggaggcgaggtgttctactaaaatgccaagctcctggttgtcctatgtctggtttccaaggtgtttaggttagttatgtttttctcatat

SEQ ID NO: 1976 - DNA, 354 bp, Zea mays
  Clone ID: LIB3227-030-P1-K1-B7
cgcgtatagaacctctaaaatgttcctaactcgccagtctgaggagcacctggagctcatggacgcctgcggagccggtagcaaggggaagaagggtgcggccgggcgcacggcagacggccccagtaagaaatccgtgactcggtccgataaggtcgggctgcagttccccgttggccggatcgggcgctacctgaagaatggccggtacgcgcagcgcgtgggcactggcgcccccgggtacctagacccgtcctggagtacctcgccaccaaggttatgaagttagcagggaacgcctggcacgacaactagaagactctcatgattctgcgccacgtgcttctggggatc

SEQ ID NO: 1977 - DNA, 399 bp, Zea mays
  Clone ID: LIB3227-030-P1-K1-B8
gttccaactcctgagcactttctcctcgtcccagacaagccaatcgaagccgagatacgaccatggactccaccggcaccggagcagggggtaaggggaagaagggagcggccgggcgcaaggtcggcgggccaagggagaagttggtgtcaaggtccgtgaaggccgggctccaggtccccgtcgggcgtattgagcgctacttgaagaagggccggtacgcgcagcgtgtcggcaccggcgcccgcgtctatctagccgatgtactagaataccttgccactgaggttctggagctcgccggtaatgcttccagggacaacaagaagactcggattatttcgcgccacgtgcttctggggatccggaacgacgaggagcttgagaagcttttgggcg

SEQ ID NO: 1978 - DNA, 399 bp, Zea mays
  Clone ID: LIB3227-030-P1-K1-B9
gcacaaggagatctggtgtgcgtgatttacgtgagaagctatctggtataatgcacccacagccatcaaatgctgatccaaagcccaagccaaagccagtatcagaggttgttaacatctcaaggcgtcaaactgctgatgaaatgcctgcacgtcaaagcaagagagcaccaaaacagacttcattgaagaagacttcacagccaaaggctgaaagtccactcggcagtttcctgagttcccttgggcttgagaagtattcgattaccttccaagcagaggaggttgacatggcagccctaaggcatatgacggagagtgatctgaaagctttgggcattccaatgggtcctcggaagaagattatccttgccttggagccaagagcataagggaatg

SEQ ID NO: 1979 - DNA, 387 bp, Zea mays
  Clone ID: LIB3227-030-P1-K1-C11
agtttgataggcagccttcggataatgaaaggcatcatgttaggcctgatgacaggcatggtggcagggatgacgataggcaggctgataggtctcagtcaagagagccgcgttagaactgatttctgtttcgtaccttccctttgttgtatgtgcagtagcaaactagcataatagcttccgtgcatgttttgaactttatgccctgtagcaagctgcaaacatgtgcaaatcgtgtacagcagttgtagtttaatgctgtgtgcgtcctagccccatatttaataatttacttgaataaatcgtagttgtctgatatctgatgtatagcaggggctacacacccaggtcctttatggtgatgactattgagtgttttcttataag

SEQ ID NO: 1980 - DNA, 389 bp, Zea mays
  Clone ID: LIB3227-030-P1-K1-C12
agtcaatcaagaaggctttaactcggcatacaactcttttttcatgtaagagaagcattctgccatcaaagaaacggaaagcagatgacgctgttgtctcagacagggacaaatttgctaaaactgtggttactcagtcagccacgggaactgatccaaatgcttccaatcctcctgtttggcctgcaacttctgaagcatctgggcaacaatggggagcttcttatgcacagcaggctgcatatcctgcatatggaacttacgactacagccatcaaatgccccagcctgctcctcaagcagctgcctatggtgcttatcctccaacatactctgcacaggcttatacacaacaaagctacccacagcctgcagcaattccagcagca

SEQ ID NO: 1981 - DNA, 252 bp, Zea mays
  Clone ID: LIB3227-030-P1-K1-C3
atcgtctacacagttcgtaaacggtgtatcgtggatgcatgttgccgcgagcagagtacgtaggcatgaaccgatgtgtgcgcttctgtctgtgtactctctctatgtagtaatgtgtggccagtgggtgctttgatccagatgtattcgctcgtgagtggtgagtcgtggaagttgatcgtttcagtatcattaccgtgtattctttcttttacatgcgattctgaaaagggacctgcacgaagttccagt

SEQ ID NO: 1982 - DNA, 264 bp, Zea mays
  Clone ID: LIB3227-030-P1-K1-C4
gacagttgagcacagcacagttgaccagaagagatagtcgccggaacaaaaaccttgaccagttccacagcgctgtagtttcgcagatgatgagcagctcggcatctcatgactgaataaacgcaatgcccgccatggagggagactccggtgtctttcttgtacctgaggtggttaagttgttactcgaatgctgtatcacgagtggtgtagtcctgctattcgtaataaaaaaccagcacgaaaaatacatttttttataaa

SEQ ID NO: 1983 - DNA, 313 bp, Zea mays
  Clone ID: LIB3227-030-P1-K1-C5
ggcaaaacacagttttatactataaattgcactgattacataatagagtttaagatagaaggtaagataaaaggggattgcctaacacacccaactggaaagaattataatccaaccctaccacattccaaaattccagaaaggagaaacgcttctgagcaaaagcatgtaaaacatgcctaaaaatctagaaatcagcacatttggaacagaatgggcccatttttagctaaactaccggccataattcagttctttatagggacatacactcctcccgatacgaacaaaaaaataacgtcaacgaaaattt

SEQ ID NO: 1984 - DNA, 376 bp, Zea mays
  Clone ID: LIB3227-030-P1-K1-C6
gtcctcaaggagggaggcgtcctccctggcatcaaggtcgacaagggcaccattgaggttgttggcaccgacaaggagaccaccacccagggccacgatgacctcggcaagcgctgcgctaagtactacgaggccggtgcccgctttgccaagtggcgtgctgttctcaagattggccccaacgagccgtcacagcttgccattgacctgaatgctcagggtctggctcgctacgccatcatctgccaggagaacggtctggtgccaattgttgagcctgagatccttgttgatggccctcatgacattgatcgctgcgcttacgtcactgagacagtccttgctgcctgctacaaggctatcaacgagcaccatg

SEQ ID NO: 1985 - DNA, 399 bp, Zea mays
  Clone ID: LIB3227-030-P1-K1-C7
gagagagcgcgccgtgccgcgcgccgctccggtccctccccttccaaatgggtttattacgacaagatggtggcaattctgtgcccgaccccgcctccgctgccgaccctgcctccgcctgcccgtccccctccgctgcctctccagttgctgcctctggtcgcaaagcgccgccgcgacaggcagccagcgcggcgctttcagtgggggatgaaagctcctgagcgtcttcttggtggtgccggagacgtcgtaggtcccagggtttcagggtcaggtgcgaagttgggtgaacttggaccgcagaaaaatagtgctgttcaagggaagcggaatggtttcatggccctcacagagtcaattcagaagtttgaggaggcttttgcgaggatggagagt

SEQ ID NO: 1986 - DNA, 392 bp, Zea mays
  Clone ID: LIB3227-030-P1-K1-C8
cagtgattcaaaaaatagatattttgattttgagaagctagctgaggttacctcaactgttacttacaatcttaacaaaattatcgatattaattactatcctgttgagacagcaaagaggtcaaatatgcgtcacaggccaattggcataggtgttcaaggcctggcagatactttcatattattgggcatgccgtttgattcaccagaggctcaacagttgaataaggatatattcgaaactatctactatcatgctctgaaagcttctgctgaactcgctgctaaagaaggtccctatgaaacttatgaagggagccctgtcagcaagggcattctccaacctgacatgtgggatgtagtgccatctaacagatggaactggccatctc

SEQ ID NO: 1987 - DNA, 220 bp, Zea mays
  Clone ID: LIB3227-030-P1-K1-C9
gagcaacaaacgatacatctgttcgtgttgctatgctaactccaactggggggggtgatacattcaataaggacagccctcccggtctcgaattcggataatcctccgccgaggtatgaaacatgaggcgggcaccaccatagtggttacccaggaggacgttctgcaccactacaatgtgcctgcaccccgtcgctaggacaatccgtcagcactggct

SEQ ID NO: 1988 - DNA, 343 bp, Zea mays
  Clone ID: LIB3227-030-P1-K1-D1
gcgcccgcagcaaccaacgaggcaacggatcgagttcctctccgaactccaactctgcgccgcaatccactcaagaaggttagccctcgtggtctcggatttggataatcctccgccgaggtatgaaacaggaggcggccaccagcatagtggtgacccaggaggacgtcctgcaccactacaaggagcctccaccccgccgcgaggacgatccgccagcactggctgcgtcgctgtcgttgccgtcgtcactgtcggaggacgatggcgacgccatgccgcagccatcttcatacgcggtcttgccgcgccgggaaggcgagctggtgtctgcggaggagct

SEQ ID NO: 1989 - DNA, 358 bp, Zea mays
  Clone ID: LIB3227-030-P1-K1-D10
aggaaattcaatgtggacggcaagaaagttcagctcgtgtcatgaaagccaagcagataggaattctttacgttgttggtgtctttgggttgatttccgtttcttctcgctgtgttctgtagcttcaagggagcaggaaattcaatgtggacggcaagaaagttcagctcgtgtcatgaaagccaagcaaataggaattctttacgttgttggtgtccagcactcgtatttgttgttgctcgaggttccaaacagatgtaggagcacattgagctatgtagtactagtgctggtctagataaatagtcaaaacctatcgccgatgcgggggtaaaattttgcaaatttttgggagggg

SEQ ID NO: 1990 - DNA, 282 bp, Zea mays
  Clone ID: LIB3227-030-P1-K1-D11
gagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctacctattaagta

SEQ ID NO: 1991 - DNA, 384 bp, Zea mays
  Clone ID: LIB3227-030-P1-K1-D12
gctgcaaggagtccgcgcccatggcgagcaccaacatggcgtcggccacctcgcggttcatgctggccgcgggcgtgcccaccggcagcagcggcggccgcgtcaacttcgcctcggcgcccaaccggcttggcaggaggctcgtggcccgggccgacaacgaggccgccgcagctgaggcggcggaaggggagggtgccgtggccaccaagcccaaggccgagaagccgccgccgatcgggcccaagaggggcgccaaggtgaagatccttaggagggagtcctactggtacaacgggatcggcaacgtcgtcaccgtcgatcaggatcccaacacccgctacccggtggttgtgcggttcaacaaggtgaactacgccggcg

SEQ ID NO: 1992 - DNA, 377 bp, Zea mays
  Clone ID: LIB3227-030-P1-K1-D2
aaaccaaaaaaaacaatcgaggcaacggatcgagttactatccgaactccaactgtgcgccgcgctccactcaagaaggttagccctcgtggtctcgcatttggataatactccgcctaggtatgaaacatgatgcggccaccagcctagtggtgacccacgaggacattctgcaccacctacaaggagcctccactccatcgcgaggacgatcacgcagcactggctgcgtggctgtcgttgccgtaggcactgaccgaggacgatggcgaccccatgccgcacccatattgatactcggtctcgccctgccgcgaaggctagctcgcgtctgctgtggagcttttgctgatgccgacggttaactttgtcatggt

SEQ ID NO: 1993 - DNA, 191 bp, Zea mays
  Clone ID: LIB3227-030-P1-K1-D3
ccggggcgtgaacaaggtctggcaggcggatcggctagggcaggacaagggcgggcccggaaagctggacttgactgttcatatcaccattataatttacaaataatataagctgatgctgcttatgtggagagaggcaagcgttatagggttgatgctataaaaattaaccctctattctcttgggtttc

SEQ ID NO: 1994 - DNA, 391 bp, Zea mays
  Clone ID: LIB3227-030-P1-K1-D4
tgagactccaactctgggatactgctggtcaggaaagattcaggagtttaattccaagctatattagagactcttcagttgctgtcattgtattcgatgttgcaagcaggcagtccttcttaaatacatctaagtggatagaggaagttcgcactgagaggggcagtgatgttatcattgtgcttgttgggaacaaaactgaccttgttgacaagaggcaagtctcaatagaggaaggggagggcaaggcgaaggaccttggagtcatgtttattgaaaccagtgctaaggctgggtttaacattaaggcgctgttccgtaaaattgctgctgcacttcctggaatggagacgctctcatcagcgaagcaggaagacatggttgatgtgaa

SEQ ID NO: 1995 - DNA, 377 bp, Zea mays
  Clone ID: LIB3227-030-P1-K1-D5
ctgataaacaactatgatttaacagaaagaatgttgaaggaagctggaactgagggtgggaaagcacaacaacacttcgaggaggttcttaagagcaacatcgcaatatatgtggaagagttgctcctggagcagttcagtagtttgatcagattcgtcaaatctcgtccagcggatgagacggctgcaaattccgagaaagccagcattgccgaagttgagccactggtaaaggatttcgcgagccggtataaggccgcgatcgagctgatgcactatgatgtgatcacatctttcagcaactttctttgcgggatggagatcttgggagcgacgctcgcacagctgctgctatactacaccagggctttcgagtg

SEQ ID NO: 1996 - DNA, 339 bp, Zea mays
  Clone ID: LIB3227-030-P1-K1-D6
cacccctgcaggggaggtagttgagcagtaaaaggatgacagacctgagctgagctgggcaacatccagcggcaggagcatttctggttcggttcgattcgggctcacgagcgcatcgtgctgattcgcagggtgcactcgagctcgagtgcggagttgttgttgtactgtaggttgaggtttcaaaacatccatccgtccatcggccccgcctatttgtggatggtgtttctcgtgccattttagttcagctgtattgatgcttcgtcatgtatgtgtattgtaccattcgttcttgttacctactggtaaggcaacatttaatccatgttcaacgcg

SEQ ID NO: 1997 - DNA, 396 bp, Zea mays
  Clone ID: LIB3227-030-P1-K1-D7
cttgaatccattgactcgggtttacttgtcattgagaagttttatgaagtctttagctagattgttcttgaggtaaatgttccttagtcacaatttttggcgggaaccctcttgttctgttactttcataatgttctgctgtttaataatatctggagcttgaattggtatcaaaaaaaaaaaaaaaaaaaaaaaaaaaaaaaaaaaatggcttgcgtcccggcagcgccgcaggggccgaacacgaagccggagagcgcgtggcggctgtgcacggtggccgaggtgcagcaggcaaagacgctcctcgccgtgacgcccatcttcgcgtgcaccatcgtcttcaacaccgtgctcgcgcagctgcagacgttctcggtgcagcagggcagcgcc

SEQ ID NO: 1998 - DNA, 396 bp, Zea mays
  Clone ID: LIB3227-030-P1-K1-D8
tacaatatcaggagctggaccggctgaagcagacatatttcctgaggtggatagcacttggaagacatttcatgagatacagaagcttttgagcaaaaccaacgggaaggttattgctgatgttatgaccccagcgcctctcgtggtgcgtgaaacaactaaccttgaagatgctgcaaggttactccttgtgactaagtaccgcaggcttccagtggtcgatagctcaggcaaactggttgggatcattacaagagggaacgtcgtccaagccgccctcgaaatcaagaaaaaggttgaagggacactctgagatgactacctccaggtatcctttttgctgccacatggggggcttaggacttggacacatctctagttggcaactgatcaatc

SEQ ID NO: 1999 - DNA, 272 bp, Zea mays
  Clone ID: LIB3227-030-P1-K1-D9
ctctcaaccacctgttgggaatgctgctttgagagagttattttagatgtacctagaatgctgcacttgactgagcatatgattattagaatttagaaatactattagctaatgctgcttatctggagagaggtaagtgttagagggttgatgctatcaaaattgtccctctatccccttggtttccttttgttagttatgttcacaaaagagggtggcaagactacttcaaatcctacggtattcaatccccagcttactttcaccactac

SEQ ID NO: 2000 - DNA, 399 bp, Zea mays
  Clone ID: LIB3227-030-P1-K1-E1
ccgagagcgcgttcaagaagctcgaggaggtgtatgggagctttgacgcgccgtcgcagaagaagaagggctttgttctgccgaggcccaagatggccaacgctgacctgggcaggattatcaactctgacgaggtgcagtctgtggttaagccactcaacaaggaggtgaagcgcagggagaagaggaagaacccgctcacgaacatggctgctgtgctcaagctcaacccctacctcggcactgcccggaagatggccacccttgctgaggctgcccgagtcaaggcccggaaggagaagcttgattccaagaggaccaagcttacctcggagactgccaaggtcaaggctgccggcaaggcgtggtacaagaccatggtctcggacagtgactaca

SEQ ID NO: 2001 - DNA, 386 bp, Zea mays
  Clone ID: LIB3227-030-P1-K1-E10
tgatgttcaagatgtatatacacctcttcagactgaccttattcttccagtttctgagtgccgggagaatctggagcagttgctagaaagtatcccaaacatgtttgagaataatagggttgctgattctgcttttggagcagcaatgaaggctggcttcctggcgatgaaatctactggcggaaaacttcttgttttccaatcagtgctgccatcacttgggattggttctttatctgctagagaagccgaaggcagagcaaacattacaactggtgacaaggaagcccataaacttttgcagcctgttgacaataccctccagacaatggcactagaatttgctgaatatcaggtctgtgtggacgtattcctcacaacacaat

SEQ ID NO: 2002 - DNA, 329 bp, Zea mays
  Clone ID: LIB3227-030-P1-K1-E12
tttagaatcattaggagctatgaagcggtgtcattagaaccgcttcacctgtttagcgtaccggtgcgcgtgccggctgttgtatcttctctcgacgtgtgttgtaaactgggcagggacatggtagctagtggtgatgtgttgtgttagcaggctgactgctgtcatcgtagtgacggatgaactgctggcgtttggaaactcgtgttcggtaattaagtgctgcttagtgtgataatttcctccggttaaaaaatgaagaaaaaatatttacttattatatgaacagaggtaggattatgactgcctgacattatgttttgtacaaa

SEQ ID NO: 2003 - DNA, 398 bp, Zea mays
  Clone ID: LIB3227-030-P1-K1-E2
gaagcgttggaggagagggacggcgtcaagctgccaagctacaggggcgacaacgtcaacggcgacgacttcaccgagaagagccgcgtgccagacccgcagaggatgatccgcgcctactcgcagtcggtggcgacgctcaacctgctccgcgcgttggcgaccggaggttacgctgccatgcagcgcgtcacacagtggaacctcgatttcatggatcacagcgagcaaggtgataggtaccgtgaattggcccatagggtggatgaggctcttgggttcatgaccgcagcagggcttacagttgaccacccgataatgacgactactgacttctggacctcgcacgagtgccttctcttaccctacgagcagtctcttacccgtaaagactccac

SEQ ID NO: 2004 - DNA, 395 bp, Zea mays
  Clone ID: LIB3227-030-P1-K1-E3
cgccgcagacccctccccttcgctttctttcctagcgccgacgcccaccagacgagatggccccgaagaaggacaaggccccgccgccgtcgtcgaagccggccaagtccggtggtggcaagcaaaagaagaagaagtggagcaagggaaagctaaaggagaaggtaaacaacgcggtgctgttcgaccaggctacctacgacaagctgctctcggaggtgcccaagtacaagcaaatcacccctttcatcctctccgagcgtgtgaggatcaacggctcccttgctcggagggccatcaaggacttgttggcgcgtggcctcattcggatggtctcggtccactcaagccagcagatctacaccagggcaaccaatacattatgatggggaaga

SEQ ID NO: 2005 - DNA, 273 bp, Zea mays
  Clone ID: LIB3227-030-P1-K1-E4
aaacaaaaaaaaagaaaaaaaaaaaataataaataaaaaacatagaattcgttctccctctctttaatgccctgaagcactttctatgcccaccattctgaagaataggtccagtcaactttgactcataaacaaatcggcttggcaagaggttcgaaggccgggccgacaacaatgccgtcgcaattgaaactgatggaggagaagattattttttcttcaagcgcaaagcctaaaaggcagggtggatcggtcctaagaagggctccaagg

SEQ ID NO: 2006 - DNA, 163 bp, Zea mays
  Clone ID: LIB3227-030-P1-K1-E6
cgtccggaataccggccgagccagcatccgtcactcttgagatattaagagggatgaaacgctgttatctgaaccggttttattttttataagacccataagcgggccggactacggcatacggtttctagaatcggttgaataagataacggccacccctgc

SEQ ID NO: 2007 - DNA, 396 bp, Zea mays
  Clone ID: LIB3227-030-P1-K1-E7
gccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgttctttccgcaggaagggagactagagcggatgtggtcttcaagttttgctctatgccagatactagcgtcatgaactgcctttagctaagattttccataagttgttctcgagcagctatgtgttgcatgttggctacttccaaacttatatctggtttggtttggattgtgatgaactaatggctctttgaat

SEQ ID NO: 2008 - DNA, 217 bp, Zea mays
  Clone ID: LIB3227-030-P1-K1-F1
agttctttctcactacctagagactgctaggttcagtcaattttgggatgaagcagcaaagaaccgccacatatcggaagcagtgccaggtttcgaacaagcaatccaatcctatgcgattcatgtactttccttgacataccagaaagttccaaggcctattcttgttgaggcaatcaacatttaatgtctcgtgttggacaaggtttttgtgttc

SEQ ID NO: 2009 - DNA, 280 bp, Zea mays
  Clone ID: LIB3227-030-P1-K1-F11
tgttcagaaaacgatcaagcttttgacattctctactgcataaccttcaagctgatggatcagcaatggcttgacatgcatgctacttacatggacttcaacacggtcatgaagtctacacggcgtcagctagaaagggagctgctaattgaagatattcagaggattgaggacatgccatcatacaggcttatggcccggtggctagaagaaactgaaaccttaacatggctacatatttcaaggcggcttgagatgctaatggatcggaacctatgtg

SEQ ID NO: 2010 - DNA, 263 bp, Zea mays
  Clone ID: LIB3227-030-P1-K1-F12
ggattttccggtctgggtctcggcatccacaacctcggattttgtgcctgcagggatctccagacggacctgaacaatatgtggcagtgatgaattcaatattttctgctcaacgttccatggtaccaattgactcttgtattgtgggaacccaggattctgctttcttgcagcaggctttgtacataacaggaggagtttatttgaagccacaagaactaaatggcctatttcaataccttgccgctgtatttgcaactgat

SEQ ID NO: 2011 - DNA, 303 bp, Zea mays
  Clone ID: LIB3227-030-P1-K1-F2
aaaagaaaaagaaaaggcaaaggcaaaggaatcccaatcaggcaagcaaaaggaagaaccagctgctgcggagtgcggagatgtcttcgcagctgatcgaggagcaccggtcgggcgcggaggtgcacgtcgggcacgagctgtgcgagcgcaagtcgcgcgagttcatggtggagctgggccttcccgacgggctacttccggtgcccagtctggacgaggtgggctacaaccggtcgacggtgttcgtgtggctgcggcaggccgccggcctgacccacaactttgggtccattggcaagc

SEQ ID NO: 2012 - DNA, 392 bp, Zea mays
  Clone ID: LIB3227-030-P1-K1-F3
gcgtaaatctgttgaaggcatcgacaaagattcactgttagaactggctctttcatcactcccagaagatgttttagattatggatcagataccatgatggggttgaagcaaaagtttaactccttgaaggaaactatcagacacttcagccttctaccagcaggcggtggtggaatcctggcacatactgttgctcgagttgcttcttcaatcaagattaaaggcgataactctggagatggcattgagtctcttatcaacaaagtagaaaggttgattgtggatggagacttgattacagcggccgatgccttggagcaagggttacatggaactgaagcagaggagatagctaccgagtgggtgaagcaagccaggaaacgagcgatcg

SEQ ID NO: 2013 - DNA, 221 bp, Zea mays
  Clone ID: LIB3227-030-P1-K1-F4
cccacgcgtccgatcggaacgaggacatgatccgcagcgctctcagggctatatcttctctaagccgcataagcggcagcgactacagcatacggttaaggaatctgatgaacaagataacgaccaccccggggctggccgagaagtacaactcgttgcgcggcgaatgagacctgggttctgtacatggtagaggaataggttaaagacccagagttgtc

SEQ ID NO: 2014 - DNA, 396 bp, Zea mays
  Clone ID: LIB3227-030-P1-K1-F5
acccaacccagatccagatccacctagctcagtgcagccgtggctaccggatctcacaacagaatattggtctctgagggtgcggcaccgccgctagagtcccactcgtgcattctccggtagcccgcgaatacctttcctcttcttcccattacccccagcgtgcgttctctcctctcttggcggcgactcggcgaccggcgctgccaccccatgtttggtgcccaggtcttcctggggcccttcgccggcgacgagcatcaccagatgagggatcgagggcggcgcaggcggcgagctcgtgggcggaacagactggtgagattgaggatggatcaggagcttgagccctagaccattatccaaaaaaactatggtgcattgctgcaaactaca

SEQ ID NO: 2015 - DNA, 389 bp, Zea mays
  Clone ID: LIB3227-030-P1-K1-F7
tgaatttgaagttgctgattgcaccacaaaggattacccagaaaatagttttgacgtcatctacagccgtgacaccatccttcacatacaagacaagcctgctctgttcagaagcttcttcaaatggctaaagcccggtggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagctaggtgaagttgaaaagaacaaagacgctttcctggcagacttcacccaggaggact

SEQ ID NO: 2016 - DNA, 389 bp, Zea mays
  Clone ID: LIB3227-030-P1-K1-F8
agcagatcctcgtgcaaagcaaagcgctagccttcctactgtcccgatggcccgcacgaagcagacggcgaggaagtccactggcggcaaggcgcctaggaagcagctggccacgaaggcggctcgcaagtctgccccggctaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggatttcaagaccgacctttgcttccagagctccgccgtcgccgcgctgcaagaggcgtgcgaggcctaccttgtcgggctcttcgaggacaccaacctttgctccattcacg

SEQ ID NO: 2017 - DNA, 389 bp, Zea mays
  Clone ID: LIB3227-030-P1-K1-G10
aactacagctcttgcacaagctggccttctggaaccgaaggatgtcgaccccttgaatttaactgccatggcatgccctgccttgccactgtgccctttggcacaaacagaagctgaacgggggatcttacccattcttaaacgaattagagcagtcttcaataaggttggtatcaaggattcggagtctgtggttgtgaggataactggatgccctaatggatgcgctagaccatatatggcagagcttggtttcgttggtgatggcccaaaaagttaccagatctggctgggtggaacaccaaaccagagtacgctagcagaatcatttatggacaaggtgaagcttgatgacatcgagaaagttttggagcctctctttacctatt

SEQ ID NO: 2018 - DNA, 341 bp, Zea mays
  unsure (1)..(341): unsure at all n locations; Clone ID: LIB3227-030-P1-K1-G11
catacccttagcgctggttaagctcttgcctttagcttatggtgctctgttgttttgcattgtctgaacatcctctcacatcctgagtgtacgttcagtttgaggtttcctgtgttgtccgtctgaattccttcaaactttgcggttggaactggatgaagaataaaactccaacccgtcctggttcttttgtgggtctgtttggaatagatgctgcctgccaatgatcctgnntaaaaaaaaaaaaaaaaaaaaaaataatattaataaaaaaaaaaaataaaaatttttaaaattaaaaaaaaaaaaaaatattatggggcggccgctctagaggatcc

SEQ ID NO: 2019 - DNA, 283 bp, Zea mays
  Clone ID: LIB3227-030-P1-K1-G12
aaaaaaaaaaaaaaaaaaaaaaaaaaaaaaaaaaaaaaaaaaaaaaaaaaaaaagaggggcgttcgctaaaaaatgttataaaacaaaagcgagcgggcctacattatccatgctttctttcgcgtgcatgcgacttaatagatctaagctaacgtaacctaaattcaaataacttgccatctttttacatcgcctaaactgaaaaaaccgggccttatcctaccttaatctgattgcgaaaaatccgcctttccccagcttaattaatttcgaaaagatccc

SEQ ID NO: 2020 - DNA, 290 bp, Zea mays
  Clone ID: LIB3227-030-P1-K1-G3
ccagttcaaattgaattccagagtaacagccggagacgagagaagaaatcggctggccggtcgtggcagtcctgtaaatagaccgcggcaacgttatcgcggagataaaagcggccagcggacgtgggtgccggaggtgcctcgaagcgcgcgaagtggtcgtcagctggattggtccctcccccactgctggtgggccatctgcagctttattgctgcgtgggaccatgtgtctgttgagccagggtgggttggggtccggtggggggagtcatttgcccctactcttt

SEQ ID NO: 2021 - DNA, 197 bp, Zea mays
  unsure (1)..(197): unsure at all n locations; Clone ID: LIB3227-030-P1-K1-G4
cacgcgtccnttannttaaattgattttcagagcaacagccctatgacccgagaagaaatcgcctggggggtcgtaacagtgctgtgaatagaccgttgcaacgatataaccaagattaaatcttccagcgtacgtgggacccattgactcctggatgggggcgacgcgggagtctgctgttttgctgccatgcttc

SEQ ID NO: 2022 - DNA, 338 bp, Zea mays
  Clone ID: LIB3227-030-P1-K1-G5
gcggcccgctccccaagggccacggcgtcatttagcacgggtgcaagccgtacgcgcacaaccagtgcatcatagggaccccgctcgtgggatgccaggacctggagtgagtgagccggtggccatggttttctatactctgctatgctctccctcgccggcgttcttttcgtgtcccaatctggaaggacgactgacggttcggtggctggtttagctatagacaaaaaaataaaaggtacggccgcgtggtggcggtgctaatatgcttagccacgcgcggttgatctttgagaagttaagcgtgtacgaaatgacagctttgttcgtgtactgtc

SEQ ID NO: 2023 - DNA, 423 bp, Zea mays
  unsure (1)..(423): unsure at all n locations; Clone ID: LIB3227-030-P1-K1-G6
cgcgnntccggtgnnngtttgagtgccatgtanntcctccatattcaaatcagtgcnttccaacaggacatactgcgtgtgtgtctggatgtcatagccatagggttcatttaatcgctgtccaacantgcaggcantgaacctgggttatacataagatgccttgctctnggaaaaggtnggctgcatcacttagagcttccatgcaagtaccagaactttgggtgcttgggcatatatccttactattgcaagctgaaacacgaatcgcaatgccaatacagaccatatacttgtccatatgctggatctgaatgcacggntgctggtgatattccgtatctagtaaatcacttgaaagatgaccataaggtcgacatgcacaatggaagcaccttcaatcatcggtatgtcaagtcaaat

SEQ ID NO: 2024 - DNA, 389 bp, Zea mays
  Clone ID: LIB3227-030-P1-K1-G8
gcaaaatcccgtaaaaataaatcttcacaaaaagatcctgctaatgtccgccagacatttgcagaggaagatcaagaaaatttgtacaatcttgttcaggataaagctacttctggaaagcagggtcttggcatcaaaggcctgccaatgaaagttgctggccaacgttggaagggaaacaaaacttcgtttgttgatagtgatgatgataattcagcccagcccgatgaatattcagaaatcgaagagaatggcgatgaggaagaacatatcagtgcttctgaatcaatagacacagataagaatgcagacaaagaattgcttgtggctgctagacccaaaaccaaggtcaagaaactttgcaaaagaatacttcgtcaggccccatc

SEQ ID NO: 2025 - DNA, 373 bp, Zea mays
  Clone ID: LIB3227-030-P1-K1-G9
gcaaaatcccgtaaaaataaatcttcacaaaaagatcctgctaatgtccgccagacatttgcagaggaagatcaagaaaatttgtacaatcttgttcaggataaagctacttctggaaagcagggtcttggcatcaaaggcctgccaatgaaagttgctggccaacgttggaagggaaacaaaacttcgtttgttgatagtgatgatgataattcagcccagcccgatgaatattcagaaatcgaagagaatggcgatgaggaagaacatatcagtgcttctgaatcaatagacacagataagaatgcagacaaagaattgcttgtgggtggttaacccaaaaccaagggcaagaaactttgcaaaagaatac

SEQ ID NO: 2026 - DNA, 249 bp, Zea mays
  Clone ID: LIB3227-030-P1-K1-H1
caaaatcgaagagaagcaaaagcaggtggttgtggagaagacaggggctactactggaagctatgatgattttttggcctctctcccagagaatgactgccgatacgcgctgtatgattttgattttgttactggggagaatgtgcagaaaagcaagattttcttcattgcctggtactcattgacatttccgcatacgtgctaagatgctgtactccaacgtctaaggaccgcatcaagtactggctt

SEQ ID NO: 2027 - DNA, 175 bp, Zea mays
  Clone ID: LIB3227-030-P1-K1-H10
ttattcgtccagttcccagtccagttcccaaaaaaataaacaaaaaaaagagatcagggggctctttttttcgttgcttatttatctctcctcttccctctcggtctcgccctttctatcctgtactctccgtatccctcctctcatcgtctcttgcgtattcacatcttttttt

SEQ ID NO: 2028 - DNA, 231 bp, Zea mays
  Clone ID: LIB3227-030-P1-K1-H5
cgaagcgtttgcggatccggaaggtctaacctggcaggtcatcaacgcggcgtgggatcagggactaccgctctgtatcgagagcgctcttccgtgccataatggtgaggcgtattcccgcatactggacacggcgaatcctatggacgatcctgatcgtcaccatgccatgtttctttgcgtaccgttagcagcatcatcccccgctccgagaagctcgccttttggagc

SEQ ID NO: 2029 - DNA, 297 bp, Zea mays
  Clone ID: LIB3227-030-P1-K1-H6
gaaaagcaagatgtcggacggcacggcgacctgcatcgacatcatcctcgccattatcctgccgccgctcggggtcttcttcaagttcggctgcggggttgagttctggatctgccttatcctcaccttcttcggctacctccccggcatcatctacgccgtctgggccatcaccaagtagccggccggtgcgttagcatgcaatgcgcgcgcagggtgatctcgtggcgggggacgcggtgtgcgcgtgtctcgagatgtggtccctttcttgcttgttttgttgctgctggtcct

SEQ ID NO: 2030 - DNA, 140 bp, Zea mays
  Clone ID: LIB3227-030-P1-K1-H8
tcggtccccaagcaggctaatggcggcgatgttgctgctgccgaactcgatgatgtatgggaggatgttttatggtttcctcggcacgcagttaccttagacagagaatgtatccataggcagtgtcagtttcataagat

SEQ ID NO: 2031 - DNA, 305 bp, Zea mays
  Clone ID: LIB3227-031-P1-K1-A1
ggatcgattagtatcgaggaaatgcgtcatgcccttgcaaaggatcttccctggagattgaagggtccccgtgtgctggagattattcaagcaattgacagcaacactgatgggctcgtggacttcaaggagtttgttgcggcaactctccatatccaccagatggcggagctcgactcagaaaggtggggcatacgctgccaagctgctttcagtaagtttgatcttgacggtgatggatatatcacgccggaggaactcagaatgcacactgggttgaagggatctatcgagccgctgctgga

SEQ ID NO: 2032 - DNA, 420 bp, Zea mays
  Clone ID: LIB3227-031-P1-K1-A10
caaatatatcactatacgaatgttaggcagagtagcagcactacgagaattcttccgagcgaaaaatggtaattgttcttgcatggagttctcatctggagagttgaccagggacacgggattacctcaaggtgaaaatcagcgaataaatttggaaatgcagcaagaaaatgagaacggaagacttgaaggtcctactgaaggatcactgggtggttctaacaggcacttaagcagtactggttcctttgttcaactcaatgatgcagcagatgagttctttgacgtgccagacgaatcagaatatgatcagagagaagttatgtttccttctgatgagagcttgcatgctgcggaccagcgtcacgctaaactgtccactgctgctgtttttgtaaaaaggttgcatgatcttgcagt

SEQ ID NO: 2033 - DNA, 284 bp, Zea mays
  Clone ID: LIB3227-031-P1-K1-A11
caaatatatcactatacaaatgttattcatagtagcagcactacaagaatgcgtgggagcgaaaaatgttaattgttcttgcatggagttctcatctggagagttgaccagggacacggcattacctcaaggtgaaaatcagcgaataaatgtggaaatgcagcaagaaaatgagaacggaagacttgaaggtcctactgaaggatcactgggtggttctaacatgcacttaaacagaactggttcctttgtttcaactcaatgatgcagcagactagtttttt

SEQ ID NO: 2034 - DNA, 213 bp, Zea mays
  Clone ID: LIB3227-031-P1-K1-A12
cttggcgaaagttgcaatagttgacaatactccacaggttttccagttgcaagtggataacggcataccaattaagagctggtttgatgaccccgcagaccaggaattaatcgagttactcccgttcctggagagcctcgtggactcagatgacgtgaggccaataatttcgaaggccttccatgacaaacctgagtagaaatagtcctggag

SEQ ID NO: 2035 - DNA, 382 bp, Zea mays
  Clone ID: LIB3227-031-P1-K1-A2
gggggaccgttactggaggacaatccaattgttcttggatcaatacgctcctggagtgcagaatcatgatgccagcttcaaaagtgaaattaccgaggatgatgaagctgctgattgactggaaaatctggatcggactttttccaaatttctgtttcctgatgttgctgcaatttgtcaccaatgaactgaaactcaccgcaaacaattaattcaggcaattattctgctccattgtacctgaagcaaccgaagttgtgaatatttttcgaggatattctccaccatgctctgccgctacatttgcccctggaacttaagttatttgcccatgaaccgaatatatatcctcttgattgaatgtatgaatggatattttttt

SEQ ID NO: 2036 - DNA, 382 bp, Zea mays
  Clone ID: LIB3227-031-P1-K1-A3
gcccggcgtccgcggcagcctcaagagtaagctggctggctgggttggctcgccggcctgcatggggcacaattccctcggttcaatccaaccgccgcccgactataataataaacgcgccttcgcctggcggtgccgcagtcggcctgcggtgtactgttagtctgctgctgatttccggtgttatactgctggtacatgtgtcgtgtgatagatgtgtcaactatatatcaatctcgtcgccggcagctctagcatgtttgagtatgtgttgctgctctgtggtgccggcgacgatgactgctagactgtattggatcggtctcttgaacaaggataaatatgtgctgttacttttctctatggcagaaagtcagattgg

SEQ ID NO: 2037 - DNA, 387 bp, Zea mays
  unsure (1)..(387): unsure at all n locations; Clone ID: LIB3227-031-P1-K1-A4
cgcgtccgcgcaggggagacggacgtgggggtggaggtagcaacggtggtggaacaatggaggtgactgcgtctgggaggtgcaaggatgaaattggagcatcagttggtggagcaggcaagtatgggcgcatggcaacagttggatgactgtacataatgtagtgaaacgtaaatagtgagatggagagtagtaaggtgcacctaaaggcttttgtggaccttgagtggtgttaaatggatcttgtcgctgaccactgatgtgatgttaatctgttctccttgcagttgcacccatttcccaaanaaaaaaaaaaaaaaaaataataaaaataaaataaaaaaaaaaaaatacaaaaaaaaaaaaaaaaaataaaaaaaaaaatat

SEQ ID NO: 2038 - DNA, 437 bp, Zea mays
  Clone ID: LIB3227-031-P1-K1-A5
gtccttttcttttttttttttttttttttttttttttttttttttttttttttttttttttttttttgggggttttttggggaccaaaaccgggagggaaccttaaaacccttttttgcaaataacaacggcccaaaaaaacggttccctttttataattaaaacaaagaaaaacctggttttaaatacgcctatcctcgtttttccaacataccacttcaattggggtttttccacccggaccccaatttttctttttccaccctttgaacccccccaaattttcaaagggtttgggtggcccacccaaaatgggcaaccttttttttttaaaaccctcctctttgttttccaggaaccatggccgccatttccaggccttaatttcttgccaatggcgggccaccccgttttttttttatggtttgggggttttc

SEQ ID NO: 2039 - DNA, 376 bp, Zea mays
  Clone ID: LIB3227-031-P1-K1-A6
aaaccatctgagcaagaaaagatgcggtatgacttctggaatgaagcatctaaacttgctgatctgcaccacccaaatgttgtcgcgttttatggtgttgttcttgatggacctgggggatccattgccacagttacagaatatatggtcaatggttcacttaggacagctttgctaaagaatgccaaaaccctcgatcgacgcaagagattaattattgccatggatacagcctttggaatggaatacttgcatagcaaaaacattgtgcactttgacttgaaaagtgacaatttgcttgttaatttaagggaccctcagcgtccaatatgcaaggttggtgatcttgggctttcaaaagtgaagtgtcagaccc

SEQ ID NO: 2040 - DNA, 291 bp, Zea mays
  Clone ID: LIB3227-031-P1-K1-A7
gtcgccttcgggagcgagtacccgatgaccgtcaagcagctgcacgagatcgcgcgcgggctggagctcgccgggacgcgcttcctctgggccctcaagaggcctagcgtcgcccaccccgacgaggacctcctgccgccaggtttcgaggagcgcacgcgcggccgtggctccgtcgtgacgggctgtgttcctcagaccagcatactggggcatggcgccgtcgccgcgttcatgatgcactgcggctgggctacaccatcgagcgcttagtacggcatccttggcatg

SEQ ID NO: 2041 - DNA, 147 bp, Zea mays
  Clone ID: LIB3227-031-P1-K1-A8
cggacgcgtgggcggacgcgtgggttttttttttttttatttttttaaaagggagggccaaaacattttttaccaaacccccacttcactccaaacacaagagcttattagaatcaaaatcatacctcaacctcttgacaaattaat

SEQ ID NO: 2042 - DNA, 254 bp, Zea mays
  Clone ID: LIB3227-031-P1-K1-A9
agcaaggcatgcgctggagcaagaagctaaatgctggctgggagtctattcggggggcaaagcgctctgttttcatggcgccctactacttaaagcagtctgacttgtaacgctgatacttacagtgaaactagatgcacacatctatacatggatgctgacacgtgaaataaagaaagattatgggaatcatgcacacctaatcgacaatacctatcgtctattactgacattgatacaagatgtatggtaac

SEQ ID NO: 2043 - DNA, 326 bp, Zea mays
  Clone ID: LIB3227-031-P1-K1-B10
gcagcaccaagaagcaccattttttttcttaggatttaacttagaataaagcctggcgggggtaacagctcccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgtgcgggcccaaccgttcagttcttcacagttcccgtcggagttgccgtaactccccccacggttg

SEQ ID NO: 2044 - DNA, 83 bp, Zea mays
  Clone ID: LIB3227-031-P1-K1-B11
taagcatataacgaagcaaagtactcaatatgatacttaagttaatattttgggacgatcctctgaatcgtgccatgagccaa

SEQ ID NO: 2045 - DNA, 417 bp, Zea mays
  Clone ID: LIB3227-031-P1-K1-B12
ggtaaccggcggacctgatgtccccttccaccctgggaggcaggacaagcctgagcctccaccggaaggctgccttcctgatgccacccaaggttctgatcacctcaggcaggttttctccacacagatgggtttgagcgaccaggacattgttgcgctttctggtggtcacaccctgggaagatgccacaaggacaggtctggatttgagggagcctggacgtccaaccctttgatctttgacaactcttacttcaaggagcttctgagcggagagaaagaaggccttctgcagctaccaagtgacaaagccctcctctctgatccatccttccgcccacttgttgacaaatacgcagcggacgaggacgctttctttgctgactacgccgaggcccacctgaagctttcagaatt

SEQ ID NO: 2046 - DNA, 412 bp, Zea mays
  Clone ID: LIB3227-031-P1-K1-B2
gcgcaacatgaatgtaattgtcacttcatcgagtactcgtgacagggggagaacttccacgaggagaacccgagctgctcctaagaataatgaccaattgttggcaatgagcacaatcacttctgaggttgatgatgagattgttgatgtaaagcccatagtatcaatgtctgttgaaggatggaatacttcaaattcaaagaaatctcactcaaggctagacaatattataatggaggctataaagaacttgaatgagcctacagggtcccacagaactactattgctaattacatagaggagcaatattggccacctagtgattttgatcacttattgtctgcaaaactgaagtatttagctaccagtgggaaattgttgaaggtgaatcggaagtacaggatagcacct

SEQ ID NO: 2047 - DNA, 425 bp, Zea mays
  unsure (1)..(425): unsure at all n locations; Clone ID: LIB3227-031-P1-K1-B3
tggaaaagatggccgaaagctagagatgacgcgccgatagccgaggagaacgggcttcggccacgccaaattgaaccagcaggcagttatagcggttaaaaaggccgagaagattcgccaaacggaccgaggtccaggatcgagtatcctacgctgcggtggctgcttctgtggaccgtagtagatcatacataggattcgacagctagtatgttggtctgggatatatagtggtgggaaacctgaactccaccctctacaagtcagcattccttgattntagcatgaaaaaaggaatgtctctaaggtattcagatgcaaacgtgttcttgtttgtcatgtatgtaaattattccaatgattntaacttgggtcggtgtacaaggtaaccagctgttcgttggttaacgaagaagtcacgaatc

SEQ ID NO: 2048 - DNA, 164 bp, Zea mays
  Clone ID: LIB3227-031-P1-K1-B4
tatagctatatagaatatatattggtgatacacctgaactacaccctctacaaatcatcattccttcattataacattaaaaaaggaactcctctaactaattcagaaacaaactttttctactcttccacatatctaaattattccaataatttcaacccaaa

SEQ ID NO: 2049 - DNA, 399 bp, Zea mays
  unsure (1)..(399): unsure at all n locations; Clone ID: LIB3227-031-P1-K1-B5
gtcaatttgtaggagagaggaccccatacatcaaagatgactaaagaagaggaagatgaagaatacctcgaagaggaagaatatgcccttgctggtgcaggggggaacacatttagtttcacaaccttcatgctcttaacccctctgatcccggtgcgtggcagattagactccgataggcaagtcgtccaggtctagctccaccaaggccaagaatttatcgataagaatgctgatatggtttcaagtgtggctctacatatgcatctccatctatggagtagggatttgttctagccactattgcccttatttttcaactagctgaatgtccatgcgttgcaacgggaatatataatatcagtatactacgatgacttatttttaannaaaaanaaa

SEQ ID NO: 2050 - DNA, 419 bp, Zea mays
  Clone ID: LIB3227-031-P1-K1-B6
gaagagggcaagatcagatggcagcattcttaataaaagcaaactatcaatgtccagtaatggcccaaatggagttttaaactcagcacttactggttcaaaaaatgaagggcgacatccaaactggagttctgattcagtgcatgggatgtcttcagcctctgacaattccatgtcaaagtcaaggtatactccgacagtgtctcacattaagcatataagctgtgaactagactattacaatggttctggtgattcaaatttcctggatcttgactggctttcagcttcagacaatgaaaggtcaaaagccataagcactcctgatgtgaatatttcaactgacgatggtgttcatgatgtaatctatgggataacggatgatcaagctgctgagatccaggctcagggattatttt

SEQ ID NO: 2051 - DNA, 400 bp, Zea mays
  Clone ID: LIB3227-031-P1-K1-B7
acgtgctcaagggcatgacaaggaactacgtgttcatggctgtcctcagcagcacggggatcttccagttcatcatggtgcagtttctaggagagttcgccaacacgacgcccctgaccatacaccagtggctagccagcgtgctcctcggtctggccgggatgcccatcgccgccgccgtcaagctgatcccagtcggctcgtcatgataccattggagattgctgctgcctgggatgggaagcacggcatgaaaagagtcacgctgtccaagctgcatggtattcggtggagctgagctgagctctctctgcgtaaacttttgaaatgcacggagggcaggctagggaaatggagcagccgctgcagtttgagaagttttgtagcctggaaatgtggc

SEQ ID NO: 2052 - DNA, 440 bp, Zea mays
  Clone ID: LIB3227-031-P1-K1-B8
gggaaggacagccgcgggcgacgcatgcgtgcgaaagatggccgaaaagctagagatgacgcgccgcatagccgaagagaaacgcggtccggccaacgcttttatgaaccatcaagcagctatagcggttcagaaggccgagaagattcgtcaaacgggacgagtcccaggatcgagtatcctacgctgcggtggctgcttctgtggaccgtagtagatcatacatacgattcgacagctagtatgttggtctgggatatatagtggtgggaaacctaaactccaccctctacaaatcagcattccttgattttagcatgaaaaaaggaatgtctttaatgtattcacatgcaaacgtgttcttgtttgtcatgtatgtaaattattccaatgattttaacttgggtccggtgacaaggtaaccagcttttctttgttaa

SEQ ID NO: 2053 - DNA, 424 bp, Zea mays
  Clone ID: LIB3227-031-P1-K1-B9
tgatctcttcgcacatcagacaaggcttctactctttcagaagaaagtcattgtcaagagaatcttgaacaaaatgaccagatgtttaggcctggttggaaggacatttttcgaatgaatcagagtgagctcgaggctgagattcgaaaaggtctctcgagattctactcttgatccaaggaggaaggcctatctgatccaaaatctcatgaccagccgttggatagctgctcagcagaaatcaccacaaccaagcgtcgaaggacataatggatgtacacgacgacctggatgtgttccttcgtaccgagacccagggaaacaaatatttggctgtgagcattacaaaagaaactgcgagcttgatgctgcatgctgcaataagctattcacttgcagattctgtcacgataaagttagtgac

SEQ ID NO: 2054 - DNA, 399 bp, Zea mays
  Clone ID: LIB3227-031-P1-K1-C1
ccgcctcccggttcaaccaaatccctctcgcctcatccccaccagcgcaaagccgccctatcgtcctgtcgtgagaggcaatggcggcccgtggcaaggcgattggcgctggtgccgcgaagaaggcgacgtcaaggagctccaaggctgggctgcagtttcccgtcggcaggatcgctcggttcctcaaggccggcaagtacgccgagcgcgtgggcgccggcgcccctgtctacctcgccgctgtcctcgagtacctcgccgctgaggtcctggagcttgctgggaacgcagcgagggataacaagaagacccgcatcgtgccgcgtcacatccagctcgccgtgcgcaacgacgaggagctgaccaagctgcttggtggtgccaccatcgcgagcg

SEQ ID NO: 2055 - DNA, 418 bp, Zea mays
  Clone ID: LIB3227-031-P1-K1-C10
ggcaattcagccagcaaacgtgggatacgttgattggcccagaaaccgcgacagtgagtacgccgacgacttcactgaagacattcgcgtgaagagccaccagatgctcgagagcgaggacatgcagcagctgctgagggtcttcagcatgggtggagcctccgggagtttgtcagacgacacgttcaacttccagccctacatgccctctcccttgcccaaccccgggttcgaaagcgagcgcagccattcatccggcaaagctgtcgtcggctggctcaagatcaaggcggcaatgaggtgggggatcttcgtcaggaagaaagctgccgagagacgggcgcagctcgtcgagctggaggattagcgtcgtcgtggctttacaacggtcaaggctgcgttgtaaattactagtagt

SEQ ID NO: 2056 - DNA, 420 bp, Zea mays
  Clone ID: LIB3227-031-P1-K1-C12
gaagctgcgttgatgaagtttcgcatgaataggaaagatagatgcttcgagaagggagttaggtatcatagcaggaagaagctcgcagagcaaaggccaagagttaagggacaatttgtaagccaaaagctgaactcagctacaacaacagacgcagaagctgactcgtgaccggcgtcaagtcatcactgtaacttattcttcccttcccaccaggtgtgggcaatcggacttgtaagactgaaggctggcagaagttttttcccttccatggttagcctttctgcacaacgggtgaactcttgtgtcgggtgtttggtgccgttgtggccttatttttgtaaagtgcatcaaattgacaaatgttcagaggggaatgggttgggggtttaggaaaacggtgcagctgccagatttcgc

SEQ ID NO: 2057 - DNA, 373 bp, Zea mays
  Clone ID: LIB3227-031-P1-K1-C2
gtcgcgcccgaggagtctgcccccgccgaggccgaggccgaggccgaggctgctgcgcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgccgaggaggaggctgctgctgctcctcctgctggtgccgaggagcccgccgcggccgagcctgtcgccgaggcagaggctgctgctcccgaggagctcgccgcggacgagccggaggctcctgctcctgctcctgctggtcccc

SEQ ID NO: 2058 - DNA, 152 bp, Zea mays
  unsure (1)..(152): unsure at all n locations; Clone ID: LIB3227-031-P1-K1-C3
atctaaaaaaaagaggtcctccacacattcagattttatcttcagctgtccttggaggggaacatgaacatttttacctaacggaccaagnataccgacacccaattggtaagcaacaacacaagagccggaaatcagatcttttttaaaga

SEQ ID NO: 2059 - DNA, 432 bp, Zea mays
  Clone ID: LIB3227-031-P1-K1-C4
ccacccgtccgaaactataaatgaaggagttcggcgtttccacatcttctttgaagacggcaaaacgtggcttcttccaccagatactagaaaggctgcatatcttgccgtgatgcgaactgttagcacctcaagcagatccggttttgatgctctccttaaaatctacagagaagcatctgaaccacaggagaaatcacgtgtcttaggctccctgtcttcatcaccggatcaggatattgttttggaggcattgaactttatgtttactgatgaggtgcggaatcaagattcattttacatccttggtggcattagcttagaaggacgagaaattgcatggacctggttgaaggaaaactgggatcacgtgttgaagacatggaaatcgagttcactcatatcagacttcattgagtccattgtcccaac

SEQ ID NO: 2060 - DNA, 429 bp, Zea mays
  unsure (1)..(429): unsure at all n locations; Clone ID: LIB3227-031-P1-K1-C5
ccgtatttcccctggcagatccacantttacttgagttgttcacatgtacaggaatgcaggtgggccaacaataatgtgaggattacaaagacacattgggcattggcaggtcaaaaacatccgtgttttctgtctcgttaaaaccttcacgcaaagaatcgaaccattgagtttgaggtgtgcaaccgcagccattcacaacgtcgtagctaggtcatatattcttcagcttggaagttctgaaataggcaattgattgtggaacaccccattcgatagttcatgggtctctaaagggcttttctttgagcgttccaaggaggttgcttcagaaataccgaatcccaaaataacagaacagaccagaaatcctaaaagggagaaattcatttggtacactatttccaacacgatgatgcaacctggtt

SEQ ID NO: 2061 - DNA, 351 bp, Zea mays
  Clone ID: LIB3227-031-P1-K1-C6
cgaaggcctagagccgagcttctgaagaaaccatcacttccacagctcgttgttgaacctacggaagcaagatcaaattcgtttgttgggacccatgaatatcttgccccagagattattcgaggagatggccatggtagttcagttgattggtggactcttggaatcttcctttacgaattactctatggcaagacaccattcaagggacctggcaatgaggaaacactctcaaatgtgatctcacagggcttgaagttccctgataatccagctgtaagcttccacgctcgagatctgatcagagggctgcttgtgaaagagccagagtaccggcttggctcgtcgaga

SEQ ID NO: 2062 - DNA, 193 bp, Zea mays
  Clone ID: LIB3227-031-P1-K1-C7
atcaattaaagcaatttattgaaaatttattgattatgccagtaaacaataggggggggattttaaattttataatacaacaattagtacgaaaagacatcacctgcacaacaattaacatatactaatacttatgtaggtatatactatggatggcctctatgcccatttcaaacaccataagtaccatttc

SEQ ID NO: 2063 - DNA, 397 bp, Zea mays
  Clone ID: LIB3227-031-P1-K1-C8
atgaaacattgtcatttattgaagccatatggccatatggggtttaatttacacgggagaataacgatgtatatcactcagtcctagggctacagaagacacgatttacaattagagctgttactgctagtcaagcttcggccaccaagacgacatacagtgaagtccgttgtaacgatcagcaatgcactgcttggtgattaccttctgcgccgtgaggatcaaataggggctcaatcagataaccacatgttttagtgaagaacacttcctaccactgaaccagcaagacaagaaccccaatggacctggtattgttggttcacgaatatcagtttctcttctttgtatgtcgtcttggtggccgaagcttgactagctgtaacagctctaattg

SEQ ID NO: 2064 - DNA, 122 bp, Zea mays
  unsure (1)..(122): unsure at all n locations; Clone ID: LIB3227-031-P1-K1-C9
gacgctggacgcggtggatttaagaaacataaatagtacaaaaaactgagacggcggggaatcaaaattttttacagcaaacaaacaacanaaaagccaccaaatgctcaagaacaagcaca

SEQ ID NO: 2065 - DNA, 361 bp, Zea mays
  Clone ID: LIB3227-031-P1-K1-D1
gcatcttggataacctgtcacctcgaccatgttcgtcgtggccagttgtagacgtctgggttgtgcaagaaagtttctctcgaggacagttgctcgttttgttagggccatcaatttttttgggcggcttgtaagttatttgagaatcccacctcaggttgaggggttgtattctcgagtcgtcaaagtttagtaccggtgcggtgtagattgtatatggtttcagttgtctagaacgttgtggcttcatggacgggctgtggtataagtttttattattttttaatttttttgtcaacaagacattgtaattggggtttgtttgtttggtaagagcaagaaaggtcggcactgttattta

SEQ ID NO: 2066 - DNA, 407 bp, Zea mays
  Clone ID: LIB3227-031-P1-K1-D10
gcagaaggtgaagaagaccgagggtgagctttttgagacagagaaggaggcgggcgaggtctctgcctgatttcaaaaaggatgaccagaaggccgtggatgctgctctgatcaaggctattgaggctgtcccagagctgaaggcctatcttggcgctcggttctcccttagggatggtgacaagccccacgagatggtcttctaaaccgagttttggagttcggaggaagtcgttttggctgtgctctcttgtgacaagccccacgagatggtctcccagagctgaaggcctaccttgtttcattctgcttgaagtctgtcaaatattatgagaagatctaagaaagttttatcggtattggtggttcagcatggcgttatctgcttttggttctttgtgtaggtc

SEQ ID NO: 2067 - DNA, 421 bp, Zea mays
  Clone ID: LIB3227-031-P1-K1-D11
taacagaacagcagcttatcggttcgtcacactgattgatgttatgtacgagaacaaggcaaggctgttatgtacagccgaggctggaccagtaggactgttcgagaatatcgtgactgttgctgaagcacggaaggtttcaccaagatcttcacgctcacagaaaagcgacgacactgacctatgcgtggacaatgagcttggatttgccaaggatcgtacgattagcaggttgacagagatcaacagcagagaatatttggaggacttcgaaatgagattgaagcaacagcagcagctgcccttgcaaggtctagataaaaagtggtgatgctgtactaaacataagaagcagaaagcttctgcgcctcatcttgaaattcttgtattcacacccacctggcttacataagcaactgag

SEQ ID NO: 2068 - DNA, 423 bp, Zea mays
  Clone ID: LIB3227-031-P1-K1-D12
gcgcgaagaatccgcatttccccttccccgcacccaacccccgtcggagagagagagggcatcggtggcggagatgcagcccctcgcgccggcggggtaccgccgcgcgccggagatgaaggagaaggtggaggcgtcggtggtggacctggaggccggcaccggggagacgctgtacccggggatctcgcgcggggagagcgccctccgatggggcttcgtccgcaaggtctacggcatcctcgctgcgcagctgctcctcaccaccgccgtctccgccctcaccgttctccaccccaccctcaacgccacgctctccgactccccgggcctcgcgctcgtgctcgccgtcctgcccttcatcctgatgatcccattgtatcattatcagcacaagcacccacacaatttcgttttcctggg

SEQ ID NO: 2069 - DNA, 423 bp, Zea mays
  Clone ID: LIB3227-031-P1-K1-D2
caacgccgggttaccttcttcgggcccttctcaccatttcctcatttaagccccgtgtgccttgctcctcggtgtttcctccagatagtagtgtttcctcagtggactagtgtgaagctgtgcttagcgtagcggaagggaggaaggacaaggcaaggcaactgatggcggcgggcggcggaggcggctcggcggcgccgttcgtgtggaagacgtacacgatggtggaggaccccgggacggcaggggtgatcggctggggcagcggcaacaacagcttcgtcgtcgccgaccccttcgtcttctcgcagacgctgctccccgcgcacttcaagcacaacaacttctccagcttcgtccgccagctcaacacctatgtcagttaaatcacacactccagctagctaaattgattgccgtctc

SEQ ID NO: 2070 - DNA, 370 bp, Zea mays
  Clone ID: LIB3227-031-P1-K1-D3
gattatttctatattaagcaccgtaatgagcggcgtgggctaggtggaatattttttgatgaccttaatgattacgatcaagaaatgcttctcaactttgctacagaatgtgcggactctgtacttcctgcgtacataccgatcatagaacggcggaagaacactccgttcaatgaggagcacagggcatggcagcaattgcggagaggtcgttatgtggagttcaaccttgtctacgaccgtggtacaacatttggcctaaagactggaggaaggattgagagcatacttgtgtcccttccgcttacagcacgatggcagtatgatcataaaccggaagaataacggctaatcagatccaatccttcgg

SEQ ID NO: 2071 - DNA, 422 bp, Zea mays
  Clone ID: LIB3227-031-P1-K1-D4
gtcctccagcagaaggatcactccaaattcaaaagaaagggtgaagatctcttctatgagcacaccttgtctctgaccgaagcactttgtgggttccaatttgttcttacacatctggacaacaggcaacttctcatcaaatcagaccctggtgaagttgttaaacctgaccaattcaaggcgattaacgatgaggggatgccaatttaccagaggcctttcatgaaggggaagctgtacatccatttcacggtggagttccctgactcgctggcaccagagcagtgcaaagctctcgagacagtacttccaccaaggccttcatccaagctgacagacatggagatagatgaatgcgaggagacgactatgcatgatgtgaacaacatcgaggaagagatgcgcaggaagcaagctcacgc

SEQ ID NO: 2072 - DNA, 423 bp, Zea mays
  Clone ID: LIB3227-031-P1-K1-D5
tgctcagagtcgcagttcgttttgttgtactagagcgctgagcagatctttccttgtttcttcattccggtacgaaggggaggggtccaagtgaagagaagagaaggcctgcgagcgatgggcatcgtcgacgtcgtctccgagttctgctccttgccgaggactcgccggcatctcaagaagaggaagcagttccagacggtggagatgaaggtgcgcatcgactgcgaagggtgcgagcgcaaggtgaagaaggcggtggagggcatgaagggcgtgagctccgtggaggtggcggccaagcagaacaaggtgacggtcacgggctacgtggacgccaccaaggtcatgcgccgcgtcgcctacaagacaggcaagcgggtggagccctggccctacgtgccctacgagatggtgcagcac

SEQ ID NO: 2073 - DNA, 357 bp, Zea mays
  Clone ID: LIB3227-031-P1-K1-D6
gtgatttctccgacaagaatattatggaaagagggaatgagccaggaagaggcagagaaatttgtggtgaaggtagtttcccttgctatggcccgtgatggtgctagcggaggggttgtccgtacagttacaataaatgcggatggcgtgaataggaacttctaccctggcgacaagctacccctgtggcacgacgagctggagccccagaactcgttgcttgatattcttgctgccgggaaccctgatcccatggtgcagtgaatttgccctccacttccgttgtgaacttttcactgtacctgacttgttcttgatttcaaccgaagaaagaattggaacatttcctgtcgaact

SEQ ID NO: 2074 - DNA, 387 bp, Zea mays
  Clone ID: LIB3227-031-P1-K1-D7
gtttttgttgctactttgtctcctaaagctgctggtgatattggatctgtgctacctgaagaagcttcacttgttgcatatcttattgatgcagtcactggacgcatacttcatcgtgtaactcatcatggtgcacaaggccctgtacatgcagtcttgagcgagaactgggttgtttatcattattttaatctgcgagctcacagatttgaaatggcggtgattgagatatatgatcaatctagggcggacaataaagatgtcatgaagctcatacttgggaagcataatctttcagcaccaattacatcatacgcccgccctgaggtggcagtaaaatcccagtcatactttttcacccattcagtaaaaacaatggcagttaca

SEQ ID NO: 2075 - DNA, 423 bp, Zea mays
  Clone ID: LIB3227-031-P1-K1-D8
ctttgtgaagacactcactggcaagacaatcacccttgaggtggagtcttcggatgaccattgacaatgtcaaggccaagatccaggacaaggagggcatcccaccggaccagcagcgcctcatcttcgccggcaagcagctggaggatggccgcaccctggcggactacaacatccagaaggagagcaccctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgctggcaagcagctggaggatggtcgcaccctcgcggactacaacatccagaaggggagtacccttc

SEQ ID NO: 2076 - DNA, 424 bp, Zea mays
  Clone ID: LIB3227-031-P1-K1-D9
atttgctacatcttgccactaacagtgctagtaagatgtgactgtagtatcattgggacttgcagcaatcttgtggacaacaacaagaacccgcagaagtacgtgcggtacagcccagaagcagtggaccaacttctaggccagttcttcgaagggcagcaatgggcggagcaaaagcgctgagcaacatagagtgagagtgacggcatgagtacagccagatgccagtaagttcaacagcacagatttcttccgaagcaaccaccagttccttctcgcactacatataatatatagtgacataaacgtctgctgtgcaggcactacctagttttcttttctcagaaaaagcgcgcctaagtttcttttctcgccatttgggtggctggaacggaaagctaacggcaaaaaagtgttggtggaa

SEQ ID NO: 2077 - DNA, 421 bp, Zea mays
  Clone ID: LIB3227-031-P1-K1-E1
gaccgaaaatgtaaagacaaaggctcctgtgcctccgcctttgccaccgcgccgaccgtactgcactgagaagaaaccgaatgtcaacagttcacctgttggtggaagaaagacaaaggcctcagctccacactggcactgaccccattatctaggatcctgcagcataactctgaagccgtgaaggtaaaagctatgcgtctgacgtgacctagaaggctgcatccatcaagcaacgattgatgttatctattgtagcttaccagcagtcttgtgacttgtcacctgtgttagaataaccgtagtagttagtgtatgtagcaacgcgtagcatatatatatatatatatatatccactaatgtctaattgaaccgtagtagaactgccctggatttaactagaacattgtatatacctgg

SEQ ID NO: 2078 - DNA, 326 bp, Zea mays
  Clone ID: LIB3227-031-P1-K1-E10
atcaaacacacataaccactcacagtcttcttaatatataactgtaacatcagggcgactattaacattttattcaacttcaacaagaacccccacataacccttcaatacaaactcataatcagccaccaactatatatgccaattcttagaaactacttatttcactaactaaaagccctcttcaccatatatagagattaactatatgagtacaccccaatatcattaagtacaacagcacaaatttcttaccattcaaccaccaaattcttctaccactacatataatatataggtgacataaacatcttattatccttgca

SEQ ID NO: 2079 - DNA, 414 bp, Zea mays
  Clone ID: LIB3227-031-P1-K1-E12
taccggttgggaaatactgggtgggaccaacgcatcgggcccaaggcgcttcaagaatggatcccatctatggccactggcgctgcagaagagagaagaaggacggtgccctcttgagcccggtgagatcgctgtgatcctgcgggcactggggtacacgagcggcacacagatatacgtcgcgtccgggcaagtgtacggcggcaagaaccggatggctcccctcaggaacatgttccccaacctggtgacgaaggaggagctggcgagcgcggaggagctggcgccgttccggcggcacgtgacgagcctggcggcgctggacttactggtgtgcctgcggtcggacgcgttcgtgatgacgcacggtggcaacttcgccaagctcatcatcggggcgcgccgctacgcggg

SEQ ID NO: 2080 - DNA, 418 bp, Zea mays
  Clone ID: LIB3227-031-P1-K1-E2
gggaattttgtttttagagacagggttttaaagactgcattcgtctactactccaagctagttgcaatgatgtcaacgccttcagttacggtttttgtcaggcgcagtttttcctacatgatgaatgggcaagcagagctcgctctacgggacgccatgcaagcccaggtctgcatgcccgagtggcctacggccttctacctccaggccctggctctttcaaagctcggcatggaaaccgatgcccaggacatgctcaacgatggcgccacgtttgaggccaagaagcagaatggctggcgcagttaggagccgacgacgaacaaagtctctcttccaacgactccgtgccgttgccctttgagagaaaaaggtacaatggcgagtctcctccaaatcagttcactgggacacgcct

SEQ ID NO: 2081 - DNA, 229 bp, Zea mays
  unsure (1)..(229): unsure at all n locations; Clone ID: LIB3227-031-P1-K1-E3
ttactgttctgattgcacactaactactcatggtttacttctactntaatttttgaattgcttttcatgtttcagaatgttctcaaattatatctctaaagcattagaataatgctcattgcttcttttttcctctgtataagaaatgatagaatatagtcatggttcaacatccagcgacatgtttcttttactctgtgcatcgtatctatgttgatgcttacaagtc

SEQ ID NO: 2082 - DNA, 357 bp, Zea mays
  Clone ID: LIB3227-031-P1-K1-E4
ggtcatgatggccaagtgggtaaagcctgcggtaacggtatagtaccccgcgggaatggaaggaggaaaccaaaccgcgcatcgcatattagaaaggcagagcaggtcttgattccttccacttccacaggaaaaaaccgtactagctgtaactgctgaacgttagagtcccactgctgccacccttatctacatttgagtcatcgaaactccttgcttaccctgctgtgtgaatctgtacggatatgcgtgctctggacactgattgcaggtgaatccagttaggagttatatctgatcatcgaatctgcccacactcctttggtaccattcaacacgctgctgctttctgtttaa

SEQ ID NO: 2083 - DNA, 416 bp, Zea mays
  Clone ID: LIB3227-031-P1-K1-E7
agcacaaccaccaccaccgccgcctggccgtaacgtcacacgctcgcctcctggggtggcgcccaggaacgctgtccccgccgccagcgccgtggccaacggcatggtgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgtgggcccaaggccaagaccaactttcgcggcgcgttcgccgagcttccgcctacgtcgtccaagaagccggtcgccgtgaccgggagctccagcagcagcagcaccgtggagtgctcctcctgctgctgccgggactcgcccggcacgccgt

SEQ ID NO: 2084 - DNA, 372 bp, Zea mays
  Clone ID: LIB3227-031-P1-K1-E8
atgggcctcaaggagaagtctgagaagcacattgacttttcactgtcaagccgagtcggtggaggccctgcaggaagggtgaagagaaagaatcagaagaaggcaagcggtggcggggatgctggtgatgaggatgaggagtgaggatggacaagtagtgttacaccaatataataatattatctagttttcttgaacttgttcgaatgatgagtgcttagctgtgtgatctgacgcagagtcccctgtgctgactctgtgtcatggatggtccattttatcttgtggtattatcagcctttacataactgctatgtttggatatgttcaattctgttgcaattttatgtggttgcttttttgcgtttaaaa

SEQ ID NO: 2085 - DNA, 416 bp, Zea mays
  Clone ID: LIB3227-031-P1-K1-E9
tgcaaactagcaaaatctgccactggctacttattagatatgggtaacattatacttttcaaagaattgacaaccaaattgtgaaaggtgtaggaatttacctgtgaaagtgaaataaagtttggtgaagttcaataatgtttattcagagaagctagttctgtcaggagctaaaagtcgtcttcacttattctagtgctaagttattagtggtgaccacagggtactggtgggagaagtatttatggtgaatgctttgatgatgaaaattttacactgaagcatgttggtcctggtgtgctaagcatggcaaatgctggccccaacacaaatggaagtcaatttttcatttgcactgtgaagacaccgtggttggacaaccgtcacgtcgtgtttggacatgtattaaaggggat

SEQ ID NO: 2086 - DNA, 423 bp, Zea mays
  Clone ID: LIB3227-031-P1-K1-F1
ggaaaagtaccataatccaatcatcatcatatcggaaaacggaatggatcagcctggaaacctcacgcgcgaggagtacgtgcacgacgccgtgaggatcgacttctacaagaactacctgacggagctaaagagagggatcgacggcggcgcgaacgtgatcggctacttcgcgtggtctctcctggacaacttcgagtggctgtcgggctacacgtccaagttcggcatcgtctacgtcgacttcgcgacgctgaagcggtaccccaaggactcggcgtactggttcagagacatgctttcggggacgggctccaaggctgctaccccgcagactggttcaggcggccggccggctggttcggcttcagccacctcgaacggacctgccttgctggtcttccttttggtctccttgggtgt

SEQ ID NO: 2087 - DNA, 284 bp, Zea mays
  Clone ID: LIB3227-031-P1-K1-F10
cccacgcgtccgcagaatgttcccttccaagaaggccactagtagcgcagccgcagccgctgccgccgtgagctcaaatgatagcaggcagcaggcgatgtgcgtgcaggccgactcggggtcgggcctcgtcctcaccaccgaccccaagccccgccttcgctggaccgtcgagcttcacgagcgctttgtcgacgccgtcacgcagctcggtggccccgacaaggcgacttccaagaccattatgagggtcatgggagtcaaggggcttaccctctaccacc

SEQ ID NO: 2088 - DNA, 423 bp, Zea mays
  Clone ID: LIB3227-031-P1-K1-F11
gccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgctacaacaagaagcccaccatcacctcccgggagatccagacctccgtccgcctcgttctacccggcgagctcgccaagcacgccgtctcggagggcaccaaggccgtcaccaagttcacctcgtcctaagctcctttcgagtaggtccttaagcgccgtggcgccttttgactgtatggaatgtttgtcatctgaaagttgatctgagcagtgcaatatata

SEQ ID NO: 2089 - DNA, 425 bp, Zea mays
  Clone ID: LIB3227-031-P1-K1-F12
acaacctgctagctccagcaatcacactgacgacataacttctccccctcctgcgcaagcgagcaagctgtctcaacctcagaaagcaatgtccagccgggaccgtctcaaaatccagcgtgaatccctggctcacaagcgcaatgccctcaagttgcggagagaaggaaagactgcagaagcagatgcagaatttgaactggccaaggagctagagagccaactggaagagtcagacaaccaaagctcgagctccgggggaaagtcaagtgaaccaaatgacgcaagcgtcgagaatctccttgatcctcagatcatgtctgccctaagatccattggttggagtgacatggatttatccatgcaatcctgtagcgcacaacctctgaaacctgtgcagtcctcaagttctcaacctccgcaaa

SEQ ID NO: 2090 - DNA, 413 bp, Zea mays
  Clone ID: LIB3227-031-P1-K1-F2
acagatccctcgttgagtccaagactggccctgagagaagggacgctgttgagaacacgatggtggcatacaaggttgcccaggacattgttctggctgagcttgctccaactcaccctattaggctgggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtag

SEQ ID NO: 2091 - DNA, 419 bp, Zea mays
  unsure (1)..(419): unsure at all n locations; Clone ID: LIB3227-031-P1-K1-F3
aagggcacgaaacattttggtcctggttgacaccgccgccgacctgttgactaggctgaccatgatggcgcgcctggcagccgacaacaacgatgctactactaccccaagaggagacggaaacggaaacggaaacgaacacaagggggccaccaccgttgcaggcgtcaaaaggaaaaggggctagatcgattatagtggttgctgttgttgttgtattcttgtccctatccatccgtgcatgcatgcatgtatcctctctagctntctagtaggtttcgttcctgcatgcaatctgtggatcctgctgtaaccaagctagtacgtatctcctaagtactaactactagtgaagcctgcatgtgtacctgtcgtgattaattaataataagccatgcagctacatatttatttgatgt

SEQ ID NO: 2092 - DNA, 326 bp, Zea mays
  Clone ID: LIB3227-031-P1-K1-F4
gtgttaaaaaataaaaaaataaatacaataatataaaacaataacactaaaaaaaaaggggagaatgataagttttcttaaaaaccaaacaacaaaaatactaatacgggccggccgttttaaaggatacaagttaccgtccccttcattgcgacgtcataacttttttataggttaacctaaattaaatttactgcccttatttttacaacttctggactggaaaaaccctgcctatacaaaacttaatgcctttgtagaaaatccctttttttctagttggcttaatacctaaaagccctctaccgatcctcttttcaaaaagt

SEQ ID NO: 2093 - DNA, 422 bp, Zea mays
  Clone ID: LIB3227-031-P1-K1-F5
cccacgcgtccgcgcttttggatgagctgcaggcactggatgatcatctcaaaggtcatggcccctacataaatggggagaacgtgtcagcgactgatcttagcctggggccaaagcttttccacctacagatcgcactggagcatttcaaaggctggaagatcccagaaaacctaaccaatgtccatgcctacaccaaggctcttttcagccgtgaatcttttgtcaagactaagccatccgaggagcacgtgattgcgggatgggcgcccaaggtgaatgcataagagccttgtgctttggtgctacctggtggactccatccatttatcttatcagtctttgtcagtggtgtggataggtgtcaagtctgtagcctagatgcatgattcagttggaattatgcagtgccgtgtctcgag

SEQ ID NO: 2094 - DNA, 429 bp, Zea mays
  Clone ID: LIB3227-031-P1-K1-F6
gtccgggggagccggtgttctacgagcggttggaggcactggagggcaaggacgcggtgctcctgcgcgcctacgttggggacaagcccacttggcgcgacccggcgcacccgtggagggtggaccccaggttcgggctcaagggcgtgccaacgctgatccgctgggaggatggcgccgccgccgcccgcctcggggacgacgaggcgcacctcaaggacaaggttgacgccctcctctgcgctggcggcaactgagtactgacagatccggtttcccgttcgggttccatctgcgtagagtggccataataacatgtactgtaattcagttcatctacatgccggaccagaagctggggaatcgtgtgaagcttaataattcagtttatctacatgccgaaccagaagctgggaaattgtgtggaac

SEQ ID NO: 2095 - DNA, 419 bp, Zea mays
  Clone ID: LIB3227-031-P1-K1-F7
cccacgcgtccgccatgctcttttgctcctccgccagcttcatggtggacgacatgcccatcagggactttcgcaacctggagagcaagggggtggcgttccccaagagccagccgatgcggctctactccagcctgtggaacgcggacgactgggcgacgcagggcgggcgcgtcaagacggactggtcccacgcccccttctccgcctcctaccgcgggttcaaggccgacgcttgcgtcgccgtcgcgggcggccggacccgctgcggcgccaccgtcggcaccgagggcaccggcgcccccgcctccgccgacggcgccggggactggtacaaccaggagctggacctcaccctgcagcatcggatgcgctgggtgcagcgcaagtacatgatctacaactactgcaccgacccc

SEQ ID NO: 2096 - DNA, 420 bp, Zea mays
  Clone ID: LIB3227-031-P1-K1-F8
agaggatggtgtcgcatgcgtagaattcattgctggaaaagaaggccatgttgacgatgacacagttcctggtgtggtctatacacatccagaagttgcatctgttggcaagactgaggagcaggtgaaggctctaggaattgcctataatgtggggaagtttccacttttggctaacagtcgtgcgaaggccattgatgacgctgaaggggtagttaaggtgatcgcagagaaggaaacagataagattctgggcgtgcacattatggcacctaatgctggtgagatcatccacgaagctgtcgtcgccttgcagtatggagcatccagtgaggacgttgctcgaacatgccacgcacaccctaccgtgagtgaagccctcaaggaggcttgcttgcaaaccttcgataaagcaatcca

SEQ ID NO: 2097 - DNA, 418 bp, Zea mays
  Clone ID: LIB3227-031-P1-K1-F9
tccggacacactttgcaagaccaaattggaaaaaagtcctatctaaaattgcctcgaagcatccatttgctaagataggtgtattctactgtggagctccagttcttgcacaagaactaaacaaactgtgccatgaattcaatgggaaaagcacaacgaaatttgagttccacaaggaacatttctgaattccagtaatacttggtgcgcagaaatgatatattatgtgtgtgtacagcatttttgtcttggtatgttcatctggagttctggacgaacatgagagcaaagtggagaagctaccatcaaatgcttaacagctgacggcctgcactctttgttaactgctcctaaatgaaccagaccaccaagaagtgggatttttgtgtacatatacatgtgatgtccaaacgtccat

SEQ ID NO: 2098 - DNA, 336 bp, Zea mays
  Clone ID: LIB3227-031-P1-K1-G10
ccaaaaaataaattatcataaaaaaactaaaataaaagaaaatacaaacaaggaggggaggacaataaaattttaaaaaagataactaaacataaaataaaatcattactgtcaaaaaaggcacatatagtggtgagctatatacatattccaactgaccatctttcaaagtcagctattacgtcatttttgaggactacgttaaatctatcatggcctatggtttatacaaactttatggcttgtaaagcctatggatgatacatttttattggccaggcaatcaatacgttttcgattcttgttaactaacgatataaacttggatgttcatgc

SEQ ID NO: 2099 - DNA, 421 bp, Zea mays
  Clone ID: LIB3227-031-P1-K1-G11
ggagagagaggagagagagcgatcgagagatgaggagggagcttgcctcccccttagctactgccgccgctgccacggccggtgcctccttctcggctgccgcctcgctccggggctggtgggacgatgtcaacgagtcgccccagtggcaagacggggccttcttctccctcgccgccgcctacgccctcgtctccgccgtcgcactggttgggaccgtgacagcaatttgtgttacctgctttctgataagatgtgttgtggtcacgctatctgcatttgatgctgatgtatctctcgaggttttggaccatccagtcctagatttcttctattatatgtttgcggagatactcccttctgcgctggttctcttcgtccttcggaagcttcctcccaagcgggtatcggcgcaatacca

SEQ ID NO: 2100 - DNA, 264 bp, Zea mays
  Clone ID: LIB3227-031-P1-K1-G12
gcaaacagagcacataatctttttatttattacctaacaacttccccccgcgcgggctatatcattctttctcaaaaacaaaacctacttaccaacacccacctgcttaccatccatccatcacgatttcaacaaatgcacaacaccaacaaaaacactaacatattcacactcacctcaaactactcccaaatcttcacctacctactaattacaacctcaacagcaaaatacatacaactcctatctcataaaaactcttaa

SEQ ID NO: 2101 - DNA, 193 bp, Zea mays
  Clone ID: LIB3227-031-P1-K1-G3
aaaggggtacccggtggagtacctggtgtcttacaggaagggcgggccgtcgttcggctcgaccgtgagcgagaagatgaggagctcggagatgtagggagcctcgtaccacctccgaagatactgtagattcctatgatcatttggctgcattgttctggccacccgtcgccgtctcgcctgttggagcagc

SEQ ID NO: 2102 - DNA, 435 bp, Zea mays
  unsure (1)..(435): unsure at all n locations; Clone ID: LIB3227-031-P1-K1-G4
acccacgcgtccgaacgcgagcaatccaggaggatagatggaagggctgatcccgttcgtgatcgacgtgagcaggaggagccacgggcgcggcggctaccgctccgtgtcgtcggacggcggcagctcccgcggcgggggcagcagcaggcgccacctcatcgactactcggagctgcccgacgccgccgccgcttccgcggcgagcgtcggcgccgccgactggccgtcgtccggcacggtgcaccgtcgcgcgcggtcggagtacgcggactcgacggtcgtcgggcgtcgcaacgaggagtacgccaggccggcgcccgtggtcgccgccgggccggcttatcggcggaaatgagggggcggcgacacgcatgcagcctcttaactntggaggatacatcgtgagcgtcagcagttcagcatgtttgggtt

SEQ ID NO: 2103 - DNA, 224 bp, Zea mays
  Clone ID: LIB3227-031-P1-K1-G5
caaatttgatgttaatttcaatccacgtatttttcaagaaaattaacgtgtaggggggggaggatcaagttttttagaggatcctccaccatatggagcacgtatagcatatgccgcagggcatggccctccacatggaaatgactttaataatattaatcgacaacttcagcatcacagtgacccgaatctctttcaatagacatgcaaatagcatatgccag

SEQ ID NO: 2104 - DNA, 91 bp, Zea mays
  Clone ID: LIB3227-031-P1-K1-G6
aaaaaaaaaaaaaaaaaaaaaaaaaaaaaaatataaaaaaaaaaaaaaaaaaaaagggggggaaaaaaaatttttttaaaaaaaaaaaaaa

SEQ ID NO: 2105 - DNA, 420 bp, Zea mays
  unsure (1)..(420): unsure at all n locations; Clone ID: LIB3227-031-P1-K1-G8
caaatttgatgatgatgttaatccacgttacactcatggatatcaagggggtggtggaggaggtgcaaggttccgagagggtcctccaccatatggaagaggtagatcatatgggagaggttatggtgctccacatggaaaggatttgattaatattgatggagaatatgttcaccgaaatgacccaaatctgtcgccaagagaaggtgattggatatgccagaaccctaattgtggaaatctcaattttgctcggcgaactcactgtaacaactgcaacaagttccgctattcagcacgtgaagcatatgaacctaggcgcagccctcccttcaggagttaccccagccctccacgagggcctncaaggatggttggtccacctggtgatcgagcccctgcaagagagatggccaggta

SEQ ID NO: 2106 - DNA, 416 bp, Zea mays
  Clone ID: LIB3227-031-P1-K1-G9
cgagctcgatggaaagcgtgtaaaattacaaatttgggacactgctggtcaagaacgtttccgaacaattaccactgcttactacagaggagctatgggcattctgcttgtatacgatgtcacagacgaatcgtccttcgataacattaggaactggattcgcaacatagagcagcacgcatctgataatgtcaacaagatcttggtgggcaacaaggtcgatatggatgcgaagcgggtggtctccacagctcaaggtcagaagctcgcagatgaatacgggatcaagtttttcgagacgagtgcgaaaacgaaccgaaatgtggagcaggtattcttcgccatggcaagggacgtgaagcaaaggctcaccgagaccgttgccgctgcggctgagcccccgaccattcagatta

SEQ ID NO: 2107 - DNA, 426 bp, Zea mays
  Clone ID: LIB3227-031-P1-K1-H1
aaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcaataatcattagtaataacaagttcagag

SEQ ID NO: 2108 - DNA, 426 bp, Zea mays
  Clone ID: LIB3227-031-P1-K1-H10
cccacgcgtgcgcccacgcgtacgtgctattatagaattcaaatgtgggggggcgggagatggaagattcagatttgaaataatattgcgggagtacccaaaaagaacagacctttctagtgtttatctaaaccaagaaatcctccttggtgacgtagaagttatactggcattatttgagagggtgacttgccttaccctacctgcaaaaaagatgcagttcttgttcaagaaatatcttaatttctagaagtcactgtgtaaagacaatgaaagaattcagcttgtgcaacataaagcaatcgaatataattagagttcactgtcgttacaagacaactcttgtactacatggagacttaattagcccactaacaatcattaggaaataccagtagtactgtactactgtggatgtgatctctt

SEQ ID NO: 2109 - DNA, 60 bp, Zea mays
  Clone ID: LIB3227-031-P1-K1-H11
cacatgtacacgtctcctggccatacatgcggccctgcagcggtttggctgcttggttcc

SEQ ID NO: 2110 - DNA, 392 bp, Zea mays
  unsure (1)..(392): unsure at all n locations; Clone ID: LIB3227-031-P1-K1-H12
tttagcagggaaaatacactatatgggagtatattgctgctgcatgtaaacgggccgtggtacaaaaactaatgcgtgatccatccatccatcgatgtcatgtcaaatgaaagagtacaaaggaacacgaagagatgtacaacgagtccagtccactaccagggcttgaggtcgctctggagtccggcgtcccagtcgagcgccttctccccgggctgcaggaacacgccctcgccgtgcggcagcttncgcgccagcccgttgagcacctggtggaaggcgtccccgggcctggcgggctggtggaacagcagcgcctgcttgacggagtcccgcgccagcaggcgctgcctccgcaggatgtcgggcagcgggatggaagtgaggatgga

SEQ ID NO: 2111 - DNA, 408 bp, Zea mays
  unsure (1)..(408): unsure at all n locations; Clone ID: LIB3227-031-P1-K1-H2
ggaaacagcatccaaatgttgttgcctatagcaactgggggaccccgcagatttcccgttttacaaacaaaactcncccccgggataactaacttgtgtccaaatcaatcgcagaaaaagagcatgatacatataattcttccggacatatatgccagtgatcacagtcaccttggaatcatgctgaagctgtaggctgaatcacacacgctatgccaaacattcattctgaagcctgtgaaaccagtgccatatttctcagacagcgatgcttattcctgatggttactggatccagcatatccctggcatgaagactatcattgaaacaaggctctgtaacgcactgaacagaattcactattaatggacaacttacagctaacaaaactgcacctttgtagtgaa

SEQ ID NO: 2112 - DNA, 424 bp, Zea mays
  unsure (1)..(424): unsure at all n locations; Clone ID: LIB3227-031-P1-K1-H3
tgtgaatggatcgccaatgaacactgaaaccgagaggttgcgagtcatccaatgcctggaagcagccatcgaacggagggtatctgagggtgtgaagcttgagctgtgcaccaacgacaaggtcgggctgctatccgaggtcacccgcatcttccgcgagaacagcctgacngttacgagggcggaggtgaccacgcggngcaggatggccgtgaacacgttctacgtgcgcggctccgcgggagaggccgtcgaccagaaggcgatcgactccatcagggaggccataggccacagcctccaggtgaaaagccaggccgagccaccggagccgcagaagaaagagtcccccacgtggttcctcttcgccaacctgtttcgcccgaggtcgctctacagctttgggttcatgcgctgatcgagc

SEQ ID NO: 2113 - DNA, 429 bp, Zea mays
  Clone ID: LIB3227-031-P1-K1-H4
caagaagagcgtggagacgtacaagatctacatcttcaaggtgctgaagcaggtgcgacccggacatcggcatctcctccaaggccatgtccatcatgaactccttcatcaacgacatcttcgagaagctggccggcgaggccgccaagctcgcgcgctacaacaagaagcccaccatcacctcccgcgagatccagacctccgtgcgcctcgtgctccccggcgagctcgccaagcacgccgtctctgagggcaccaaggccgtcaccaagttcacctcctcctaggcttgcacgctcgccctttgtaggcttctcttgtgttgatgttcgccttgtgttgtagttagatgttgctggtttctctgtcggcgctgctctgcttctgtaggaactgcgtcatgtaacccagcaaggacttggttatttg

SEQ ID NO: 2114 - DNA, 418 bp, Zea mays
  Clone ID: LIB3227-031-P1-K1-H5
aaaaaccctaaccgccgccgccgccgccgccgttcttcctcgagatgggaggcaagtgcccgcaccgcaaggtaaagaagcgccgcctatcccacaagacggctcgccgcggcaagttcctcctgaaggccgacgatgccgtctatgacgagctcgtcaagcttgccgaccagggcaaggacgctgaaaccaaggagctccccgtcgatgaggacctcccaggcctgggacagttctactgcctccactgcgatcgctactttgcaagtgaaagcgtgaaggatgatcactatcgttcaaagcgccacaagaaaagggttaaggtaatgtctggaccggccccgcacacgcagcttgatgcagaactcgctgcaaggatgggaaagcctgacaatggcctgaagctcatgtccatgtg

SEQ ID NO: 2115 - DNA, 457 bp, Zea mays
  unsure (1)..(457): unsure at all n locations; Clone ID: LIB3227-031-P1-K1-H6
acggaccggaaaggactgggtgggtcgacgcgatcgcgttttttttgttttttagcttgaagtgncttcatataaaatagcgaaacaaaaatatttcagcgcacgagtactannggcgaggganngaaaaacaaaagggcgagaaccgtgttctatcntttattnnggccggcccaggttggcttgtanttgataccattgtcttnntaatccccagcttaaaccattattccaacctaaatctagnaactacacgccttttggaagtccggtgactgaatcgatcagtgcttgaccttcgtcaacaacaacctttggacctgccccaagcctgctgcagatgaagtagctaacatcgcccttgaatttctgatccggtatcttcgtatctggaggtgctggaagagcctcgacgtctttcatggaatgcaatccggcgtcacctagaattgattta

SEQ ID NO: 2116 - DNA, 163 bp, Zea mays
  Clone ID: LIB3227-031-P1-K1-H7
ggctgctgctcctgtagaaccatcattcatgttctatgctaccccatgggcgggggcgtaacatagatcatgaatgatggtacaaccagagcagctgccctgacgctcttgaagccccgggtataccggaccgctacacacagtcgtaccagcatttaaaata

SEQ ID NO: 2117 - DNA, 252 bp, Zea mays
  Clone ID: LIB3227-031-P1-K1-H8
caaatttgatcattatattaatccactttacactcatggatattaaggtgcgccgccggaatttactattgttcgagattatcccccaccatatgtaagaagtataccatctgggagaggttatggttctccacatgtaaaggattttattaatattaatgtataatttgttcaccgaaatgacccaaatctcttttcaagacaatctgataaaatatgctagaaccctaattgcttaaatatcaattttac

SEQ ID NO: 2118 - DNA, 398 bp, Zea mays
  unsure (1)..(398): unsure at all n locations; Clone ID: LIB3227-031-P1-K1-H9
cgtctcctcgctggctcgctatgctggccgcctccaccgcgcctctccgtcacggggccaacgccatgagtctgtaacggcacacgtaccatgggcaggaccagaggcaacaggggcgtgggcggcgcgaagtcgttcccgtcgccggcgtcgtcctcggcctcgtcgtcggagttcgagttcacggtcacgctgtcgccggcgtccaagcagcggtcggcggagcagctgtgcccggccgacgagctcttctacaagggccagctcctgccgctgcagctatcgccgcgcatcttcatggtgcgcacgctgctgctgtcctcggcgtccacgtcgtccgactccgcgtncgactccaccaactcctcctnccgcgactccaacggcagcacgtcgtc

SEQ ID NO: 2119 - DNA, 383 bp, Zea mays
  Clone ID: LIB3227-032-P1-K1-A1
ctctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcagtggcggtcgtgtttggtcttgggct

SEQ ID NO: 2120 - DNA, 261 bp, Zea mays
  unsure (1)..(261): unsure at all n locations; Clone ID: LIB3227-032-P1-K1-A10
attcatgtgcttgttatgcgcccgtgccctttgcccggcgaggcgagcgcacccttgttgtcccctttcctctcctcaatagcttgaatcatttggaaacaactcaattatttaagttggcctcactctatctagagtcaggggtggacagacagggcggncaaagtgggccctggccccctcacatttttaaacctcttatacctaatgttaaggatagaaaaatagagaaaattggttgggctaaancagtcttgtatg

SEQ ID NO: 2121 - DNA, 399 bp, Zea mays
  unsure (1)..(399): unsure at all n locations; Clone ID: LIB3227-032-P1-K1-A11
ggctgaaaaggtacattgagtactgccgcgccacatgcaaaccacggctttcagaaaaagcagctgagatgctgcagaacaaatatatcgagattagacagaaaatgaggcagcaagctcacgagacagggagggccgcagctatacccatcacagtgaggcagcttgaagccatcatccgtttgagtgaatctcttgcaaagatgagattgacaagtgtggctacaccggagcatgtcgaagaggcattcagactgttcaatgtttccaccgttgatgctgcaagatccggaatcaatgagcatttgaacctgtcaccggagatcgcaaatgaaatcaagcaagcggaggcacaaataaagagnaagaatgggcatcggcagccacatattcgagcga

SEQ ID NO: 2122 - DNA, 399 bp, Zea mays
  Clone ID: LIB3227-032-P1-K1-A12
cggcgcacaaccgcctggccccggtgtcgctgttccagaagcccatcgtgaaggtgaagctcgccgacctgatggccgccacgcaggacttcagcagcagccacatcgtggtcgccgggagctcgcgggcggggacggcctaccgcgccgtgctacgggacgggtccgcgctgacggtcaagcgcctgcactcgtgcccgctctcggagaaggcgttcagggcggagatgtgtcggatcgggcagctgcggcatcccaacatcgtgccgctgctgggcttctgcgtcgtggaggacgagaggctgctggtgtataaacatatggagagcggggctctttcgtcggtgatgaagaagaagccagggggaggaagcgccgccgctgctggactgggcgaca

SEQ ID NO: 2123 - DNA, 409 bp, Zea mays
  Clone ID: LIB3227-032-P1-K1-A2
aaaggatattcaaactgttgactgtagctctctaggaaggcagtgatgaattcagtgaggtcagggccccactcgaacccctgtgcggccgtgttgacaccagcatagtctctgttccagagagctacagacaaaggatattcaaactgttgacttctgcatattcgacaattagcgttgctgatgtggctcatttcatggggatgagtgaggaggatgctacaaactatgctgtgcaaatcggttggagtttgggcgcagcgaccaagatgcttactgtcaaaaagccaaaggctcagatcaaccagaagcttgatgcgagcaaactgcagcgcctgactgagtgtgttttccaccttgagcactgatgctcagtgtcaatcgtgttgcatccccgtcacttctctac

SEQ ID NO: 2124 - DNA, 234 bp, Zea mays
  Clone ID: LIB3227-032-P1-K1-A3
gaaatggccactttcaaggttgctagtttatggctcgctgaactctgacggggaaagccatagaggcacatcgggaaattcaaatgggacttttaaaggtggagttggtggtggttctggaggatcaattcttttatttcttcaatggtttctgctagagaaaaactcatcattatcggcatctggtggcaatggaggtgtatacggtggtggtggaggtggtggtggtagaat

SEQ ID NO: 2125 - DNA, 395 bp, Zea mays
  Clone ID: LIB3227-032-P1-K1-A4
caaacacccaaagttcatcactgataccaaggccgctattgctgaaacttacaaccgcacagattcagaatttctgaaagctgatagcactcaaactcgagatgctggctcaactgcctcaacagctattattgtaggtgatcgtttgcttgttgcaaatgttggagattctagagctgttatttctaaaggagggcaggcgattgcggtttcaagggatcacaaacctgatcagacagatgagaggcaaagaattgaggatgcagggggctttgttatgtgggctgggacatggagagtgggtggcgttctcgctgtctctcgagcatttggtgataaactcttgaagccgtatgttgttgctgaccctgaaatcaaggaggaggtggtcgaca

SEQ ID NO: 2126 - DNA, 223 bp, Zea mays
  unsure (1)..(223): unsure at all n locations; Clone ID: LIB3227-032-P1-K1-A5
ggagacgacccacgcgttcttatacacccaaagttcatcacttgatccaaggccgctattgctgaaacttacaaccgcacagattcagaatttctgaaagctgatagcactcaaactcgagatgctggctcaactgcctcaacagctattattgtaggtgatcgattgcttgttgcaaatgannnanattctagagctgttnnnnctaaaggagggcaggcga

SEQ ID NO: 2127 - DNA, 367 bp, Zea mays
  Clone ID: LIB3227-032-P1-K1-A6
cgtctcgtcccagcaaagcaaaggcagccatgccccacagtctcttcctgctcgtcgtcctcctcgccgccgcgcaagccagcgcggccacgccgcggcagctgttcctcgtgagccggccgcccatcacgctcaccaaccaccacggccagctgctgacgggcaactactccgtcaacctgctctggtacgggcgtttcacgccggcgcagcgcgccgttgtggccgacttcatcctctccctctcggggaccgggcaggggtcggagtccgtggcggcgtggtgggccacgacgtcgcggtaccatcctggcgcaacacggctgtcgctggggcgacaggtgctggacccgtcgcgctccctagg

SEQ ID NO: 2128 - DNA, 238 bp, Zea mays
  unsure (1)..(238): unsure at all n locations; Clone ID: LIB3227-032-P1-K1-A7
tcgctcgaatttgcaggtcttgatccgagatccgtcgatttccatcgggccgcataccgtcggtgtcaccggtcacgctgctggtntttatgcatgtagcaggggagtgctgataccgccgaggcgcccttaggatgatattcagagcggggtctttgttcgggtgaatttggtgttagtgtgctctaacngncacggggccctgaaggtggacgtacctgaggaagagggggacgcg

SEQ ID NO: 2129 - DNA, 409 bp, Zea mays
  unsure (1)..(409): unsure at all n locations; Clone ID: LIB3227-032-P1-K1-A8
gaaggaatggagtcatcgatggggaagctttacattcttatcgatgagatctacaaatacgtcgatgatgttgtggaaggacgcgtggcacccgacaacagaattggaaggttcatctctgattcttttgcttcggtgccgaaattgtccccggctgctttcgataagcttttcaatgacaagattcaggataaccttgcgctggtatacctgtcaagcatcacaaggacacaaatcagcatcgccgagaagttgaacactgctgctcaagtgctgtaggtttggcggtgtggcatctggtttggacgtggatggcttgatgctatctgtgatgcttggcgtaagtgtgattggtgacagaaatgcatttntgtactcattattattattgctaaatgagagacctgat

SEQ ID NO: 2130 - DNA, 227 bp, Zea mays
  Clone ID: LIB3227-032-P1-K1-A9
tctgtgatggcatcctcaagctgcttgagacccatcttgtgccgtcttccactgcccccgagtccaaggtcttctatctcaagatgaagggtgattactacagatacctcgctgagttcaagactggagctgagagaaaggacgctgctgagaacacgatggtggcatacaaggctgcccaggacattgctctggctgagcttgctccaactcaccctattaggctt

SEQ ID NO: 2131 - DNA, 258 bp, Zea mays
  Clone ID: LIB3227-032-P1-K1-B1
cccgtcagcccctctcgtttttcatccgccttcgcctccaaccgcgtgcgctccacgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgca

SEQ ID NO: 2132 - DNA, 409 bp, Zea mays
  Clone ID: LIB3227-032-P1-K1-B10
gttcagagttcctgaagaagcggaagaaagggaagctaccaaaggatgctcggacggtgttactagagtggtggaacacgcactaccgctggccttatcctacggaggaagacaaggtgaggctcgcagcaatgaccggtctcgacccgaagcagatcaacaactggttcatcaaccagaggaagaggcattggaagccatctgaggacatgcggttcgcgctcatggagggtgttgccggtgggtcttctgggacgacactctacttcgatacaggcacaattggaccctgaatcatacaccacttgggatgacaactggccagctcatattagtaataagatctggcatgtggagtgacgatctgctcggtgaaaattgaaaataaatctgctgagctgaggttgat

SEQ ID NO: 2133 - DNA, 400 bp, Zea mays
  Clone ID: LIB3227-032-P1-K1-B11
agggtctttcttccgtgacctcgtcaaagagtactggtcgtacgcatcgaatgggaatatctagaagccacctccaaactacgaccgtttgcatgtttccactcgctgcatcctcttgaaaggagatacaagaacctgggcttgcacatccgaagaactcttgtatctgaaatcttgagaaaaggcgtcaggcattgtcatgaaatgcttgttgtcaatttttcaccactcgtttttcagcaactttttggtagcttctggtttgggtcattgcttcccttccaggcgctgaataaaacgaaacatgtgttcatctctttcccccccacctcacgtttcccttaaaaaaaaagtagaggaaaatcgtcaacatttttttgctcacagtgatactttatgc

SEQ ID NO: 2134 - DNA, 412 bp, Zea mays
  Clone ID: LIB3227-032-P1-K1-B12
cttccaaccccagaatggtttggaggagttgcagaatcgtggttactacccagagattgttaaagaagctgtcaatcttgccctagataaagggaccaattttgttgatcctctcgttaggctactggagcatctgtacacaaagaaaattttcaagactcaagacctggaatccggttgcttgttatacggtgctctgttggatgacattgggattgaccttcctaaagctccaacgcaatttggtgagattattgctcgcctgactttgttaggtgccttgagatttgaagttatggaggagattttaaagaaaatggaggataccatgtaccgcaaagcagtttttgatgctgtcaagaaaaccttggaagcaaacccatcgggccagacaatcttaggctcacatgct

SEQ ID NO: 2135 - DNA, 287 bp, Zea mays
  unsure (1)..(287): unsure at all n locations; Clone ID: LIB3227-032-P1-K1-B2
tttataaatgtaattttttttttatatttaatttggtggaaaattataaaaaaaaaggggaggtatacagttttttgagagataaaagatattgttcttttttgatgaaaaaaattaaaatgttttgttgtttgttggaaaattttttttttttgggggtggtttttttttgggttcccttggtattcttccgccacatcggggcttttgttttttttttttttgtgcccttttttttctttgttggtgtgttttttttttttttttttttttgntttttttttttt

SEQ ID NO: 2136 - DNA, 364 bp, Zea mays
  Clone ID: LIB3227-032-P1-K1-B4
ggggatagaaccgagggctttccattgataatagcagtgaaaatattacaccaaatgggctagaaactggaacacctcgaaacgaagatacagaacaaactacagtagaccggccaactagacacacaaccgaccacggccgtcacatcaaagcatcagaaggggaggcggcctagccgccgaagccgtagagcgtgcggccctggcgcttgagcgcgtagacgacatccatggcggtgacggtcttgcggcgggcgtgctcggtgtaggtgacggcgtcgcggatgacgttctcgaggaagatcttgagcacgccgcgggtctcctcgtagatgagcccagaaatgcgcttggacgccgccct

SEQ ID NO: 2137 - DNA, 399 bp, Zea mays
  Clone ID: LIB3227-032-P1-K1-B5
gcattgtgaggccagcatcagcgaaccacagtcaaggggcagctagtacagatgcggataggcttgtctgggcaatccagcgcacacataactcttatgaagcagcaaggcggcaaaagctagatggcgacaacaaggtgtgtggaaacagtgcagctaagaaggatgggtcctgtgattgcaactccagctttgagtgtaatatctgtcttgacccagctaaagagcctgtgattacaccctgtggtcacctcttctgttggccatgcttgtaccagtggcttcatgcacattcactccactctgagtgccctgtatgcaagggtgaggtgctagaagtgaatgtcactccgatatatggaagaggcggtgaagaaggggattccaccaaccctgact

SEQ ID NO: 2138 - DNA, 387 bp, Zea mays
  Clone ID: LIB3227-032-P1-K1-B6
gcgatccctttggatgtcttcatgcaatgtcacattaaaggggtgccaggtccttgcatcgaagatgccgatgctcaatgtggagatcatgaatgaactagatggaagtagtgaaatggagaaccatggagacctctctaaagtggacaagttatatgtttaccgcacaactgctggagcgagggatgatgcaccaaattttgttaagatcctacagagctagccgcgactacccttatatcttcccaccttgagagatggtcggtggaatccggcatgcctggggccagggcaacagtggtaagttcttgaatcgtctccccttttgcagggtcaggaaaagccacactggcctgcgcccttatcggggagcaacacgaccgggaa

SEQ ID NO: 2139 - DNA, 378 bp, Zea mays
  unsure (1)..(378): unsure at all n locations; Clone ID: LIB3227-032-P1-K1-C1
gcatcaccggcgacgtcggcgcgaagatcctcgtgctcggcttctcctccccaaaagtgcaggtgtcggtggattgcgcaatcgccatcagcccgaggagccagtcgctgaaatacaagcagtgtggcgtggacgggataagcgtgtagtgtaggaaccccaagccgccgccgccgcagaagctgtattgcagtggagaagtgggtggatctgtgcgtcgattctaatttccctaatttgtggggtttgatttccttcttgtgcttaggtggtaaattttgagcacttttttggaggaggccaaaaaaaaaaaaaaaatataaannaaggnaatgatgtatngtgggggtttgtagggtgttgtttggggttggtaat

SEQ ID NO: 2140 - DNA, 408 bp, Zea mays
  Clone ID: LIB3227-032-P1-K1-C10
aacgacctttgtgggataaaggagtctgatacagggctggctccacctagccagtgggatttggtttcagataagcagatgatgcaagaagaacaaccgttacaagtagcaagatgtacaaagattataagccctaatacggatgatgccaaatatgttataaatgtaaaacaaattgcaaagtttgtggttggattgggagataaggtctctccaactgatatcgaggaagggatgagggttggtgttgatcgcaacaagtaccagattcaaatccctcttccaccaaaaattgacccaagtgttaccatgatgactgtggaggaaaagccagatgtgacgtacaatgatgtcggtggctgcaaggagcagattgagaagatgcgtgaagttgttgaacttcctatg

SEQ ID NO: 2141 - DNA, 329 bp, Zea mays
  Clone ID: LIB3227-032-P1-K1-C11
cttcggggccaccttcattcctgggaaggcctgccttccccaagcctgtttttattgggtgaagatagcctgatgcatcaagggcacatgggacctgcacaatggaactcacatgcgttacctgaaggtgctgagcgacatcgtacaggcgcataccaagccgtcaactctgttgctgtcgcaaaaactcagcgttagctggatgccttaactgatgtacgtcacaacacacaactgacgctagatctcactgcagtactttaatctggaccctgaacttcaatgtgaccctcaacaccgtatactcgaaggaacctatgattctgtta

SEQ ID NO: 2142 - DNA, 403 bp, Zea mays
  unsure (1)..(403): unsure at all n locations; Clone ID: LIB3227-032-P1-K1-C12
ttgaagatgctatcagtagacttgatggaattgattttggcagaaaaggaaggaggatcagggttgagtggacaaaggaggatcgcactgttggccgaaaaagcagctcaaggaggtctccaaccaatacaaaaccgaccaaaaccttgtttgtgatcaactttgacccgatcaacacaagaatccgagatctggagaggcacttcgataaatatggcagggtcgcaaatgtaagaatcaaaaagaactttgcctttatccagtttgaggtacaggaggatgctacaagagcattggagggtactaatggaagccatttcatggacagggtgatctctngtgagtatgcacttcgtgatgacgatgaaaaaggtgaaagagggaacgggtacagcccagacag

SEQ ID NO: 2143 - DNA, 409 bp, Zea mays
  Clone ID: LIB3227-032-P1-K1-C2
gaagaaattcatatgcatagcagatctgcggacacaaattgctggatttttgtatgggctgagtccacaggacaatcctcaagtcaaagagattaggtgtatagccatccctccacagcatggaacacaccagatggtgactcttccagcaaatcttcctgagcacgagttccttaatgatctagaacccttgggatggatgcatacacagccaaatgaagctccacagttatcgccacaggacctgccttcacatgcaaagattttgaaaaccaccaaacattgggatggtgagaagtgcatcattctgacatgcagcttcaccccaggatcttgctcgttgactgcatacaagctgacaccaagcggttacgagtggggacgcagcaacaaggacaacggaagcaat

SEQ ID NO: 2144 - DNA, 404 bp, Zea mays
  Clone ID: LIB3227-032-P1-K1-C3
acccaatctcccctacaccagaaaaattcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggacgcaccctctacggctttcgaggctaggctaggcgcctcttcatagtcggggact

SEQ ID NO: 2145 - DNA, 406 bp, Zea mays
  Clone ID: LIB3227-032-P1-K1-C4
cagcgcgcccacctggacgagatggccgagcagatcgacgcggccggcctcctgcccgacgacgaggacctcttctacgacgaccagctcgagcagggccccgtcgccgccgcccttaagacagattcggtgctcaaggcgctgaacatgacctccccgaagggcggcggcgacgccccgcgggggttccgggagaaacccaggaacgccgagaagccgaccaagtacgccggcagccccaagagcagcgccccccgcgtgatccacctaacgaggctggttcgctgggggaactcatcaggaaggctgctgcccctcttgcagccttgctcctggctgccgacgctgtcgaggactcgtggtctgctctttcaagtcgaagtaacggtggttcgagctagtggat

SEQ ID NO: 2146 - DNA, 246 bp, Zea mays
  Clone ID: LIB3227-032-P1-K1-C5
gaacggttttgttttcgtgtctggggagcgctttgtttatggactctggtgttagcggatagcggctccatcatgtaattcatgtcaaaaaaaaaaaagatcgtctgatcgatcttggagaacgaactgtaatttagatcaacatcaatccacatctgtgtacagtctcagtgttgttgctctgaacttgtatatttttctgtttgctcagttgaaggtaaatgcagttcgaggtgaggtctcttt

SEQ ID NO: 2147 - DNA, 137 bp, Zea mays
  unsure (1)..(137): unsure at all n locations; Clone ID: LIB3227-032-P1-K1-C6
gtggttttagacaatcatataagaaaattttattntnggaagcacttncgggggggaaacacaactctttttgcatgctttcatcactcnnngcatgctnncatcannnaggacatttacttggtgcnttcaagtat

SEQ ID NO: 2148 - DNA, 413 bp, Zea mays
  Clone ID: LIB3227-032-P1-K1-C7
gacttcctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaacaggtgcgcccggcgttcgtgccggacgatgtgatcggcagcgccgggagccccgacaggtactggagcccccaccccaagaccggcgtgttcggcccggcggcggtggaccccaagctggcagctggtggcgcgccggacgccggcgcggatgctgcaggaggcacggtgctggaccagaaggtgtggttccgcccgctcgaggacgtcgagaagccgccccccgccgcgtgagc

SEQ ID NO: 2149 - DNA, 418 bp, Zea mays
  Clone ID: LIB3227-032-P1-K1-C9
cccacgcgtccgcccacgcgtccgcccacgcgtccgcccacgcgtccgtgaaaatggggatcagaagactgataaaagctgtccatcacaatctaccaaggcggcaacaagtgcaaacaaaactgaaaatcaagaccaaaagaagaccaagaaaatttcggcaaaacagtcgaccagagcagcaacaccagcaaagaaaaaacagcgaaatacagatgcacaagtttcaagtaagccatcttccgaaaatagaaagaacagcaagacagcggacaaagatgggctccgtaaatcttcaaaagtacctaggtcaactcccaaaatccatgccgtcaatgaagagcaaataaaagagaaagagggtgaaccccctacaaggaaaggagaagcagacaacaaagtggttattcctgggaca

SEQ ID NO: 2150 - DNA, 305 bp, Zea mays
  Clone ID: LIB3227-032-P1-K1-D1
cgctcttgcctcacctcccggtccatcctcgctgctcacgcgtgcctcacctcgacagcagccttccctcgcgacagggataaggacttaaggaggcgtcgctcggtgcaaagaatccatggcatggggaggtctgttcttgtgcatgggccgccccacgcaggagcaacagaagtcctgccttgcagccgctggtggcttcaactacgacacagctctccaaggcgccacacgcccaaagtcagtgtctaccttgacctctgacgaagctggtggcgaaataggtgacaaggatcttcccgagc

SEQ ID NO: 2151 - DNA, 393 bp, Zea mays
  unsure (1)..(393): unsure at all n locations; Clone ID: LIB3227-032-P1-K1-D10
tttgcgagacgcatctatggactgaagggaaggaacatagatgtttttgcagagaatagcagtttagccattaatcctcactatatccggtcctggttggatctgttgtcacggacaccacgggttgcaccttttctgcagaaaaacgaccccttcatagcagcactggaaaaggaactgtctgcacacactactgatgtgcgtgttcaaagtgatgcgcttgatggcatgttcaccttctatgatgcgacgaaagcaactctaaatgtctaccaggttgcaggtgttacttttgatctgctgttccttctggtgctcggctcctacctgattggtctcttctgtttcctagtgattactacacngggtgttgatgatctcattaacatattc

SEQ ID NO: 2152 - DNA, 410 bp, Zea mays
  Clone ID: LIB3227-032-P1-K1-D11
gtccgttctttcttgggtctaatgcttaatcgtttatccacaagtctcccccaaagaccccagaggtggtcattcctgaagatttagttgtcaacattgcggtatccactcgttatgagatcaacagggcctttgctaatctccgccaaattgctcttggccgggacattaagaagttcctaatggttattgctgggctttggttgctttctgtccttggaagttgctgcaacttattgaccttagtctacattgtgtttgtggtgctgcacacagtacctgtcctgtatgagaagtatgaggatcagattgacacctatggcgagaaggggtgggttgagattaagaagcagtacgccgtgttccatgagaaagttctgagcaaagtaccaaggggtcccgcgaaagac

SEQ ID NO: 2153 - DNA, 400 bp, Zea mays
  Clone ID: LIB3227-032-P1-K1-D12
cagagagcttgttccgtccaggcaaccaaaaagcaagttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccgattccagagccacgccgtgctggcgctccaggaggccgccgaggcctaccttgtcggtctcttcgaggacacca

SEQ ID NO: 2154 - DNA, 411 bp, Zea mays
  Clone ID: LIB3227-032-P1-K1-D3
caagagctccacaaaactgaggtcgacaagttcatgacccaatggtgtgaaagtaaggccttcagagaggactacgagaagagaatcctcacatccctaaatagccgacagctgactcgagatggtcggatgaggaatcctgatgagaagcccatatttatcgagtcacaggcgccagctccagctccagctccagagcccatccctgtaaaattgcctgcaaaacaagccaaggaagtgcctgctccccaggcagatgatgctcccaagactgaagctccttcgaaaggacctgtcaagtcgcacaaggcaaaagctgctcttgatgctgatgatgattatgaggctgagcccctgaaggagaaggcaaagcctacggaggctgatgtggctaagttgaaagagatcaag

SEQ ID NO: 2155 - DNA, 406 bp, Zea mays
  Clone ID: LIB3227-032-P1-K1-D4
caactttgatgggcaaccaacacgagttttgctgctccgcaacatggttggtcctggtgaggttgacgatgagctggaagatgaggtggcatcggagtgtgccaagtatgggacggtttctcgggtgctgatatttgagatcacacaggcagacttcccagctgatgaggctgtaaggatattcatacagtttgagcgggcggaagaagcaacaaaggcaatgattgatctgcaagggcggttctttggcgggcgtgtggtgcaggcaaccttctttgacgaggaaaggtttgggaggaacgaactggctccgatgccaggggaagtgccagggtttttcgactaaagaaagaagttttcatgtggtatcagataagtggtgggttgtgaacttgtgattctttct

SEQ ID NO: 2156 - DNA, 381 bp, Zea mays
  unsure (1)..(381): unsure at all n locations; Clone ID: LIB3227-032-P1-K1-D7
aaccagtttgaggtgaagcaaacaacctaaacacctgcccgaagagcagaaataaaaataccaatttggaggatacttcagttgcttgcacttgttttacggtctctgtattgacggtcgcgcaccaaaacttccatggtattttggagtcgtgtcgttagtcattaccctcttggaggacgttgggtctgctgaaaacatggttactcagcaatatctgctactgttcacgactgacattcaaagggttactcancaatatatggataaaatttgtgttaaagataagttgtgtcgtgtgggttgagttgtgtgttgtgttgngctgtaccttcttctatctattaatggaaagatacgcagatctcctacgtgttcgag

SEQ ID NO: 2157 - DNA, 323 bp, Zea mays
  unsure (1)..(323): unsure at all n locations; Clone ID: LIB3227-032-P1-K1-D8
tccgaaaaaaaagggggggaggaaaacaaaaaaaaaaaccagaaaaaaaagaaaaaaaaaggggaaccaaaaaagaaggaaacagggggggcgcgacacaagaaaaacggagggccgccccgacgggcgggcaccaaaacacccctgggaagggggagacaaaacganaggcagtgccctcgtggaagacgangaggggggggaaaacacgggcgctcagcaatatatgctcctgggcacgcctgacatggtcgggggggggcanagctatatggaggcgacgggggtgaaagataagcggccgctcccgggttgtgttgaaa

SEQ ID NO: 2158 - DNA, 405 bp, Zea mays
  Clone ID: LIB3227-032-P1-K1-E1
cgtacctgtttcaggcaaaataagaaacaccctagataatggcttcttaggtgaagttcgaactgggcagccatctgtgctcacagctgctgcgaatggagcaagacatgacaaaggtacaaataatgtcatacagggttatggtggaaagcaacaagggaggtcaactgggatggcttacctttccagaagatgaagtagttttcactcgacgcaattggttttgagggtggtgaagctgttggaaaccatacaagtggcattgttgtggcctccaaacggccgatgctgaagatgacctggattaaagatattctagatttattttttttgttgcaccattgctattcacagcgcctgtttgacggccttgttgcggcgaagcctgctgaaattctgcgacta

SEQ ID NO: 2159 - DNA, 222 bp, Zea mays
  unsure (1)..(222): unsure at all n locations; Clone ID: LIB3227-032-P1-K1-E10
gcatttttcatttgatttatcatgttttggcaatagggatacttgnttcttgaagtctgttacatgtttgaaccatancaattggcggacgtgtgaaaactgcnnttgatgaataatgaagaaagattgggtatggagcataaaagaaaagtaggaagccatgaaaacaangcaagagtacctgatgagatggagatgaaggccataaaaacaatgggagct

SEQ ID NO: 2160 - DNA, 409 bp, Zea mays
  Clone ID: LIB3227-032-P1-K1-E11
gctctgggctatggcctagcctccactgtctcccagtccccaggtcctcatcggcctccggtcttctggtctccccagatctcccaccggggaaccctacccgagcatcagccatggcgatcgcggcgcgcgtcctgcgccgcctcccgctccacctctacccctcgctcgctcgctctttctgcgcagtttccccggccgccgcctcggccgccccggcgtccgcctcggccgccccggcgtccgccaaggtcgccgatcgcatcgtgcgcgtcctcgccatcgatctcgagggggcgcgccgcgaggtcgtcggcctctccgggcagacactcctccgcgcgctcgccaacgcggagctcatcgagccggcctcccaccgcctcgaggatatcgacgcgtgctccgc

SEQ ID NO: 2161 - DNA, 408 bp, Zea mays
  Clone ID: LIB3227-032-P1-K1-E12
gcccctccgaatccgctgaagacggtaccgtcgtagccgagatatcgaagaacaagaaggtgtccgttaggagctggaaaggcagggtcttcgtcgacttacgcgagttctacttcaaggacggcaagactctccccacccgcaaaggtatatcactccaattagatcagtggaagatattgaaggacaacatcaaagccataaatgaggccatcgaggaaaatacatgatggttgccgccaagcagtcacgtgacgggcgagcttttgcttcttctctgtttgaggcctgatgtacggaagtagtttttgttgcccatatgctgccgtgttgcttttgtccatttgaccacctgctgttgtaggtggccgcatggccgaaaggtttggttctgccccgtgctactag

SEQ ID NO: 2162 - DNA, 66 bp, Zea mays; identical to SEQ ID NO: 1092
  Clone ID: LIB3227-032-P1-K1-E2

SEQ ID NO: 2163 - DNA, 262 bp, Zea mays
  unsure (1)..(262): unsure at all n locations; Clone ID: LIB3227-032-P1-K1-E3
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaaaaaaaaaaaaatgggggggggttttttaaaggntnattgttttaaantnnnnntttttgggatttatttttttttttttttgaattatgtataatttattgggtttgttgtttttttatttt

SEQ ID NO: 2164 - DNA, 404 bp, Zea mays
  unsure (1)..(404): unsure at all n locations; Clone ID: LIB3227-032-P1-K1-E4
catcatttgaggatgctaaatctgctctcgagaaagttctccgtcatgaagatctgcatggagcgccaatacttatatttgcaaacaagcaggattcaccagcagctgtcacggaggaagaattggctagacatctgcatcttaaggagttagacgagaggccatgcatgttccaggctggatctgccttcaatgggacggggatcaaacatggcgttgactggttggtggaagaaatggagaggagttaacncaccgaggcactaagggctcgtacagaagcagctgggaagatttaacacctcaattcagggctgtcacctgtgatttgccaaattcaaagcatctgaggaggatggctnctggtaactccatgaatagagacgcttgtccgggtggagcct

SEQ ID NO: 2165 - DNA, 407 bp, Zea mays
  unsure (1)..(407): unsure at all n locations; Clone ID: LIB3227-032-P1-K1-E5
gcctcagcagacagataacgaatttgaagaggcagatggatccttttctccacagctaatgcatggcaatgaagatgaagatgcaattgatcctgaagaggacaaagctgagctggaccgaaaacgtgaagctgtagttttggagcatcaaagaaaagttcaggaagccatgaaaacaaaggcaagagtacctgatgagatggagatgaaggccataaaaacaatgggagctatggaggaaggagatgcagtatttggtgccggtgctgaagtgaaccttgattcacaggtgtactgntggcacgacaaatatcgaccaataaagcccaagtacttcaatcgggtgcacactggatatgaatgggataaatacaaccagactcattatgaccatgataacccaccac

SEQ ID NO: 2166 - DNA, 405 bp, Zea mays
  Clone ID: LIB3227-032-P1-K1-E6
ctttgatgcattgctttccttgatatccatacctttatagatacttctgtgaagtatcaaaatatgatttacaaaaatgcttagccttgcttagatctcgtggatagaggttgtccttaatttaactcgagaaaggatggcttctacctgcaagaatattttcatttggagcaatagtgggatcttactgcaaagttccctgtgatgctctttcatcctaaggaacagacacaatcctaaggatggaaatacttaaatcgagacttgggctaggaacagatgatgctccgcccgggtcaattaaggattggatgcgtatgtaggcctgttgatcaaggactatcttatctagccacatgccctgagaatgggacagggtaagcttgaacccggctattccataca

SEQ ID NO: 2167 - DNA, 411 bp, Zea mays
  Clone ID: LIB3227-032-P1-K1-E7
ggaaactctagggaagatggaccaccatgtgaaaaaggctactataccagatagccttacagtgaagaaacaaactgaagcttccagcaaagctctctctcattgtggaaatgatagaaagattggcaggtacagcagcaggaaatatgatgactggagaagtaagcggacacctgatcacgaagagagcttcccacctgaaaagcaagtggaagttgcatatgaggagacaaaagttattattccaagcaaaaagattactcataacgaacaaagcggtgcttgccgtgaaaatagaaagaattcttgtgtggaggaaaccaagaacgtggagtacaactatgagcagcagactgcagcagggatgaggttcagagagggagaggattctgacatgagtatctcaccccc

SEQ ID NO: 2168 - DNA, 211 bp, Zea mays
  unsure (1)..(211): unsure at all n locations; Clone ID: LIB3227-032-P1-K1-E8
cgtggttcgtggtttccgggagctccatacgagcagtagttgggccttgcacgtaccgtacgtctagctagctatatatatagattgtgtgctactgctttttagtttaattacgtgtctgcattgnanagttggatctgtnncanntggtggtgtttgctttactattaggncagtatgtggttgtggagacttgttgtttaatttattt

SEQ ID NO: 2169 - DNA, 401 bp, Zea mays
  Clone ID: LIB3227-032-P1-K1-E9
ttaatcttttcgggtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcg

SEQ ID NO: 2170 - DNA, 408 bp, Zea mays
  Clone ID: LIB3227-032-P1-K1-F1
ttcagatgaggatggtttcttggaggaggacgatgatggtaacatggttatgggatattcagacagtgaagatgatgattcagagtctgatgatgaagagatggcatacaatcagggtaggggcaaaagttcagttgttattgaggaaattgaagaggatgacaaggctgctgttgctgaagtgcagaagggattgaagaagcaaagccgtgaaaatggtgatgagtctcaactccagcttgctgcaagaaatccacctactgaatccttggaaagtgaagatgaagatggttttcctgtatcattttctgaatcaaagaagagttctgagattgttttaaacaagaatgggggaaaagacaaggagactagcaacaaagacctgaaaagaaaaagtggagccattat

SEQ ID NO: 2171 - DNA, 312 bp, Zea mays
  unsure (1)..(312): unsure at all n locations; Clone ID: LIB3227-032-P1-K1-F10
ggtccgnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacgaaaaaaaaaaaaaaaaaaaataagaaaaacaaagacaggaggatccatgagaaagccaactgtgacccnnggaagctggctgccgcctctagatgatattagcttccataacctagcttattatggtgtgtattgttgccttttgggggtgaatctccttactactgatggagaataaacctaatcgattgggcataatgatcaa

SEQ ID NO: 2172 - DNA, 406 bp, Zea mays
  Clone ID: LIB3227-032-P1-K1-F11
gccaccgatcggcgtgccgcgtgcgtgaggcgatcggagcatcccgtcccgaggaggaagacaaccggcgacgcggggggaacatggggaagacgccggtgcggatgaaggcggtcgtgtacgcgctgtcgcccttccagcagaaggtaatgccggggctgtggaaggacatcaccaccaagatccaccacaaggtcaccgagaactggatctccgccacgctcctcctcacccccgtcgtcggcacctaccaatacgccatgtggtacaaggagcaggagaagctttcccacagatattaaatgcgctgcccttgacagacagcactcggagttttcatgatgggtttcataatcctcccatgatgatttaacatttgtttgatcaatttcagttcaacgccttt

SEQ ID NO: 2173 - DNA, 268 bp, Zea mays
  Clone ID: LIB3227-032-P1-K1-F12
gtctgatgcatgggatgggatgcgacttgggagaagaagccaaaactcttttctttctttctttctttctttcttctgatacgtaattattactactcactcctgctagcgtactactgctactggagtactaagcgcgtgttagggtggtgggtgttatcaatgcctgttttaaggtcacgccttcccgccttaatcccaggtccaggtccaggtcctctctgaaaaaattggagccttttcttctgaacaagaggtgtggatgggt

SEQ ID NO: 2174 - DNA, 404 bp, Zea mays
  Clone ID: LIB3227-032-P1-K1-F2
gtggactgctcttatcaagggcccttctgaaacaccttatgaaggtggtgtgtttcaacttgcgttcgcaattccagagcagtatcctctactgcctcctcaagttcgatttttaaccaaaattttccacccaaatgtgcatttcaagacaggtgaaatttgtcttgatatattgaagaatgcatggagccctgcatggacccttcagtctgtttgtagagcgataattgctctgatggcccatcctgaaccagacagcccacttaactgtgattcaggcaatctcctgcggtcgggtgacatcagaggctatcaatcaatggcccgcatgtatacaaggctggctgccatgccaaagaaaggttagatgtagaacatgtgccaagccaagagcctatgtcagt

SEQ ID NO: 2175 - DNA, 283 bp, Zea mays
  Clone ID: LIB3227-032-P1-K1-F3
aggacgtgcacatgttaggccttgaaagcttagccctttgggtataatttcagcacaaactatgtcagaattctcatgagttgctttgatctattagtaggtctaggaaacgtgcacatgcgttgcaagagaacccaacacgtataggaatcagactatatcttcgaaaaatgctaacttgtatgagcatgggtcatacgctcagcgttactcgtcctacagctccttgtccgtcatgtacacacacacacacacacattttcctgactgcctttgataaaaa

SEQ ID NO: 2176 - DNA, 181 bp, Zea mays
  Clone ID: LIB3227-032-P1-K1-F4
cgcgacactggacatgaagtgcttcttccccggcagcttgcaaatgctggaggcacagaagcgccagaggctggccaccaagctgaacctgggttacaaactggggccgcctgacactgacgtggccaacaaaaaccctaagcagttaaaaactggacccatgagaaagcaaactgacccc

SEQ ID NO: 2177 - DNA, 410 bp, Zea mays
  Clone ID: LIB3227-032-P1-K1-F6
attaatcctcgcgcattacatccttcaagaaggggctcaccaacaataaccaagctacacagtgaacatcatgaggttgttgcggatcttcaccagacaagctttctattttccattcccattgatggccctatgtctttttgtacctcaaaggtcactgtacagtggtctcttcgatttgagttcttcacaactccggaaggaacagacccagctaggtacgagcacccactccttgttgataaaagagagaagggtgaatgggtcctcccggtaactgtttatacacctccattgcgcagacgagctactcatgagaggaatggtagatctgtctcacccggaaatatcttcaactcttgaagtgcactgttgccgaagtatagttactttcagctggaaaggattta

SEQ ID NO: 2178 - DNA, 132 bp, Zea mays
  unsure (1)..(132): unsure at all n locations; Clone ID: LIB3227-032-P1-K1-F8
gaccaacccgtccgttcttaagagagtaacatctggcccacttgacggtgcaaattccagccttgtggacggaataaggttagcatttgcaccgtcaagtgggccagatgtgactcntgatgagcggtcgcg

SEQ ID NO: 2179 - DNA, 293 bp, Zea mays
  Clone ID: LIB3227-032-P1-K1-G1
gcaggacgacggagagctgggccctctcggtgtccagcctggcccggatggtgccggcgtcgcagctcctgggcaccgggaccaccttgaggaagcgcgcccaccggccgccgtcggcccggcgctccccggtgaccttcagcctgggcgcgccgtcgggctggcgcccgccggtggccttcagcttcttccgccgggcgctgtacacgaccttcaaaaacataaggcgcatgcagccgcgcaggcgacgcgctcttttgtgcgacgtgcgggctcgccgtctcggcagtgtt

SEQ ID NO: 2180 - DNA, 400 bp, Zea mays
  Clone ID: LIB3227-032-P1-K1-G10
ggaagccctatcagcagaagaagacggtgaaggcgcggcgggggtcgcagcgtaccccgcttcgtcccggcggtggcgtcgtgttcggccccaagccccgcgactggtccatcaagatcaaccgcaaggagaagcgccttgccatctccactgccatcgtgagcgccgccaaggacgccttcgttgtcgaggagttcgaggaggccttcgcgtcggggcccaagaccagggatttcgtggccgctttgcagcggtgggggcttgacccgaagcagaaagccatgttctttgccacggacttcgacgacaatgtgcggctcagcggcaggaacattggttccctcaagatgctcacacccaggacgctgaacctgtacgacatactcgacgcacgcaagct

SEQ ID NO: 2181 - DNA, 401 bp, Zea mays
  Clone ID: LIB3227-032-P1-K1-G11
cctgtggctgtattatcatggttgcctgggcttcaggaaatgcaaacaaggatcctgttcaatgaagctttcagcaggggacttcacatttctcaaatcattactggcaaaaaggcacatgtgttttgagctaaatacatattccaactgaccattttccaaagtgagctgcttcgtcattctggaggactagtttgtctccatggcctatggtttatacaagctttatggcgtgtagagtagatggatgatagctcttccctgtacaggcaatctatttgtcgccgattcttcttaactttcgatatacacttggatgttcatgctagagatgatagtccatctaatgagatgtcgatgctgtccggattcgtaaaatcgtaactccagatttttggtag

SEQ ID NO: 2182 - DNA, 410 bp, Zea mays
  Clone ID: LIB3227-032-P1-K1-G12
gagtcagagaggtgcagatcaatgcggcggtggtggtgcgccgccggcggcctcgcccgctgcgtcctctcgtcctccacctccgccatagcatcccatgcccgcccgctgccggcacccctgatgcccaaatctccctcctttaccgtccctttctccttgtcctgtcgcaggcaccactctctccagggattcttccacctggtcatcgcttcttccttccgccctccgtcggcgcatcatcagcaagtgcggcactacgccaagaaggagaggtcgcgcgctccgctcacgcccactaaatccaaagtcaagaaatacaagatgaaggccccctcgtccatgaagttcagattcagaaccattgaagacggacaggtccgcaggtggagggccggcaagcgccacaa

SEQ ID NO: 2183 - DNA, 395 bp, Zea mays
  Clone ID: LIB3227-032-P1-K1-G2
gcagcagcagccgatgcacgtgctgcagtttgtgggtggcgtcggcggggttggcatgggtggcggcggggggatggactccagcagcgacggatccgccaatggtcagccgaatcgacggagaaggaacggtttcatccaggggaggagaaggatgatgggtgcccggcctcgtcgagctgacagggaggatagtgtgcggcggacagtctatgtctctgacgttgatcagcatgtaactgaacagaaacttgctgaagttttttcaacctgtggacaggtggtagattgccgtatctgtggtgatcctaactcagtgcttcgttttgcttttatcgagtttgctgatgacgttgctgcacaagcagcactagcacttggtggaaccgtgcttg

SEQ ID NO: 2184 - DNA, 405 bp, Zea mays
  Clone ID: LIB3227-032-P1-K1-G3
gttcatgtgagaaaaataggcaacgatgagcacatccaaaaggccttcacatacttcgaccggaataagagcgggtacatagagatcgaagagcttagggaggcactggctgatgaactggagggaaccgatgaagacatcatcaatggcatcatccgagacgtggacacagataaggacgggaaaataagctacgacgagttcgcggcgatgatgaaggccggcactgactggaggaaggcatcacggcagtactcgaggcagcggttcagcaacctgagcctgaagcttcagaaggacgggtccctcggcgccgagacacggtaggcgggggccggccaccgtctaccgtcacccgacggagaagtgatctgagtgttcgtcgagctgtagtcaggtgaattc

SEQ ID NO: 2185 - DNA, 152 bp, Zea mays
  Clone ID: LIB3227-032-P1-K1-G4
attagaggtgtgtgtgagtgatgtaagtcttgattttgttcattgggttgtggtgatcattttgtaatggtagtggccaatggaattggagagtgggttaagttttcacatatgatactatatataaggcatcatatggagtttagaggtgc

SEQ ID NO: 2186 - DNA, 385 bp, Zea mays
  unsure (1)..(385): unsure at all n locations; Clone ID: LIB3227-032-P1-K1-G5
accgggaagagtgcctggcgtgtggaagctagattggagattccatctggacactgcacttcgtgatttgtgaacacagcattacatacagccggctgatgattggagctcagtaaccagaacgaagtctgtgatgtaggtcgagttggaagttcccataatgggaatagcttgtacctaaataatgctacggcgctacctctggtctgtattgctctaaggtgtttgtgctgctgccattgtactgtaaatatctaccagcgtcaacgttgtcgatgtgctctaagatacagtatgttttaaccgtgctacactctttgcattggatcgaacatgatgtaatgcatcgtcttccataatgatnaanaaaaaaaaaaaaaaaata

SEQ ID NO: 2187 - DNA, 302 bp, Zea mays
  Clone ID: LIB3227-032-P1-K1-G6
tacggtcaggggtgagaaggcaatgcagcttcttgagagtggcctcaaggtgaaggagtatgagcttctgaggaggaacttcagtgatactggctgctttggttttggtattcaggagcacattgatcttggaatcaagtatgacccgtctactggtatttatggcatggacttttacgtcgttctggaacgagctggttatcgtgttgcacgccggcgcaggtgcaagtcccgcgttggcatccagcacagggtgaccaaagaagacgccatgaaatggttccaggtgaaatacgagggtg

SEQ ID NO: 2188 - DNA, 383 bp, Zea mays
  Clone ID: LIB3227-032-P1-K1-G7
atctactataatcctctgaaggcttctgctgaactcgctgctaaagaaggtccctatgaaacttatgaagggagccctgtcagcaagggcattctccaacctgacatgtgggatgtagtgccatctaacagatggaactggccatctctaagggagaccatttcaaaagttgggataagaaattctcttcttgttgctccaatgcccactgcttccactagtcagattcttggcaacaatgagtgttttgaaccctacacgtctaatatatacagtcgacgtgttctaagtggggaatttgttgtggtcaacaagcatcttcttcatgatctgactgaaatgggcatttggactcctaccttgaaaaaccagataatatacca

SEQ ID NO: 2189 - DNA, 205 bp, Zea mays
  unsure (1)..(205): unsure at all n locations; Clone ID: LIB3227-032-P1-K1-G8
cacgaaaccccccgccgcccncaannccccggggcgccgccgccaccaccccncgcnncggnccccgaaganaaggcgnccccaaggcgacgcnnaagcggcgcnnaggcggnaaggcgccccggcgacgaaaggcgnccngnncgacagacaccngcnggcgagagggagaggccacgggnggcgccagcagcagcacggcggc

SEQ ID NO: 2190 - DNA, 344 bp, Zea mays
  Clone ID: LIB3227-032-P1-K1-H1
ggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccc

SEQ ID NO: 2191 - DNA, 257 bp, Zea mays
  Clone ID: LIB3227-032-P1-K1-H11
aaaaaaaaaaaaaaaaaaaaaaaaaaaaaaaaaaaaaaaaaaaaaaaaaaaaggggaaaaaaaaaaaaaaaaaaaaaaagggggggggcggccggctccggtccagccccgccccccctgcacgcctagcttggttcgcgcccaaaaccagccactggccgcatttcaacctggactgccaaaaccctccatccccacttatccctgcacccatccccttcgccgctgcgtatagcgcccggcccccccgatccccc

SEQ ID NO: 2192 - DNA, 225 bp, Zea mays
  Clone ID: LIB3227-032-P1-K1-H12
acagttgcatatttttattgcgatgatgaggaaaacaaaagggaggggaatgtactgtctatttggttaggggagggtatattttgagatcttttgaagtgggtgctagagcagttttggtacttaggagaggactgtctatgctaattactaagagaggtagttagccacttctcgctactagtttgtttgcatattacaaccacaattcttgctatgggtggt

SEQ ID NO: 2193 - DNA, 406 bp, Zea mays
  Clone ID: LIB3227-032-P1-K1-H3
cccacgcgtccggaggaggaaatggcgtctgatagggtgctcgggactgtgaagtggttcaacggaaccaagggcttcggtttcatcacccccgacgacggtagcgaggacctattcgtccaccagtcctccatcaagtccgacggctaccgcagtcttaacgacggcgatgccgtcgaatacaccgtcggcagcggcaacgacggccgcgccaaggccctcgatgtcaccgcgcccggcggcggcccgcttgccggcggggaacgtcccgacggcggcaacggcggtgggcgaggcggatacggcggcggcgaccgcggttactgcggcggcggtgaccgcggctacgggggaggaggcgaccgtggctacggcggcggcgaccgtggttacggtggaggtggcg

SEQ ID NO: 2194 - DNA, 398 bp, Zea mays
  unsure (1)..(398): unsure at all n locations; Clone ID: LIB3227-032-P1-K1-H4
gtcttggaaaggagtgcgccctgctgacagatggtagattttctggagggtcacatggatttgttgtcggtcacatatgccctgaagcacaggaaggtggtccaattggccttgtccagagtggtgatataatcaccatcgatgtaagtaagagggtaatcgatgttgaccttaccgaacagcagctcgaagaaaggcggaggaaatggaccccaccgccatacaagtcgaccagtggagctctttggaagtacatcaagcttgtggctccagcgtccagaggatgcgtcactgatgagtangctgtgttacattctgttaggttgngcacatgatgtgttttcaatcaaaagctgtttgccaggaacaaccatcctgttagagtgattcatgatagt

SEQ ID NO: 2195 - DNA, 59 bp, Zea mays
  Clone ID: LIB3227-032-P1-K1-H5
gattaatgaatatgtattcagtctatgatgtagaaaaaaaaaaaaaaaaaaaaagaagg

SEQ ID NO: 2196 - DNA, 340 bp, Zea mays
  Clone ID: LIB3227-032-P1-K1-H6
ccacacccttccgaaaaggacgtgaatccagttgcagattttgaaggcgatgatgaggaaaacaaaagggagtagaatgtactgtcgatttggttaggggagggtatattttgagatcttttgaagtgggtgctagagcagttttggtacttaggagaggactggccatgctaattactaccagtggagcacgccacttgcggctgtttctttctttggttcattaccaccacagttcttcgcatgggtggttagttgtgttgttatcatcatagtctgaatgatggttatgataggggaaaaaatagtctggggtataatatttatattattgggcacc

SEQ ID NO: 2197 - DNA, 334 bp, Zea mays
  Clone ID: LIB3227-032-P1-K1-H7
agttgctcacccaatgtcttctggcaaccggttcaatatgatcatggagatgatggacacccacatataatgttctttgcactgaaacatattccacccatgacagaactgacttatgactatggtgttgctggagctgaatctagtggttcaggctctcgtagaacgaagaactgcatgtgtggatcacaaaactgccgtggactattttgatgggttaagagccttgctctttgtggttaatcatgcaaaccactttcagctagatcctttcttagtctacggatgatatgagtatgactgatgattccaattgctgccatgtgtactgaag

SEQ ID NO: 2198 - DNA, 400 bp, Zea mays
  Clone ID: LIB3227-032-P1-K1-H9
gggttggcttctaccgccccctctggcttatctctagtgttgtaaattcactgtattccttctacgggatataaagcgagattgggatttgagcatcctaaccaggattttcatgttcaaaaatccaagcatatggactaatcttctttacgggcagaactgggtattctactgggtactgggcagcaacttggttctgcgatgcacatggacatacaagctctcggcgcatctccggcacaactacctgacagtgttcaccatagcagctctggaaatcctgagacggtggcagtgggtgttcttccgggtcgagaacgagtggaacaagatgacggccaaacaaaacttggagatgtcatctgacatgccttccgaaggggacaggctactggattcg

SEQ ID NO: 2199 - DNA, 194 bp, Zea mays
  Clone ID: LIB3227-041-P1-K1-A1
gctaacgctagtagtatagtttggctttaaacctgtggtacttggcatgattgattgcttcaaaaagttcgccttgtctgctctccgcgccgctcaatgtattcgatttgtttgcttcaaaaaaaggaaggcttctttattcttgctcgctgcgaccgaggaaaggaaaagaaaggggtcgagcttttgtttat

SEQ ID NO: 2200 - DNA, 398 bp, Zea mays
  Clone ID: LIB3227-041-P1-K1-A10
ggaccaggtaagcagcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtg

SEQ ID NO: 2201 - DNA, 398 bp, Zea mays
  Clone ID: LIB3227-041-P1-K1-A11
cctgctgaagcctagcatggtcacccctggagctgagcacaaggagaaggcttctccagaagccattgcaaagtacacgctaacaatgctcagaaggagagtacctcccgctgttcctggaatcatgttcctttctggtggacagtccgaggtggaggcaactctgaacctgaatgcaatgaaccagtctctgaacccatggcatgtgtcgttctcctatgcccgggctctgcagaactcggtgctgaagacatggcaagggcgccctgagaacgtggaggcagcgcagaaggccctgctggtgcgcgcaaaggccaactcgctggcccagctcggtcgctacactggtgagggcgagagcgatgatgccaagaaaggcatgttccagaagggctaca

SEQ ID NO: 2202 - DNA, 275 bp, Zea mays
  Clone ID: LIB3227-041-P1-K1-A12
cctgctgaagcctagcatggtcacccctggagctgatcacaaggagaaggcttgtccagaagccattgcaaagtacacgctaacaatgctcagaaggagagttccttccgctgttcctggaatcatgttcctttctggaggacagtccgaggtggaggcaactctgaacctgaatgcattgaaccagtctctgaacccatggcatgtgtcgttctcctatgcccgggctctgcataactcggtgctgtagatcatggccagggctccctgtgaac

SEQ ID NO: 2203 - DNA, 418 bp, Zea mays
  Clone ID: LIB3227-041-P1-K1-A2
cgccggttcgacccacggcgtacgattatatcgtccgtcgcgcagcacaacgcaggtttgctagcggccgattcagcggccacggggcgaaaggggcaacccgcctgaaacaaaggcccccggttgtaaaaatgaaccagcctgaaccaaggagggaggaagcttgagatcctacgttgccatggggagggggccagttgggcttaagccgatcgagaacaatgtctaccttgcggtcaacttttgcaatcgcaccacaggcctgtctaaaaaggtgtactacttttacttgttctgcaaggacagggttcccgccaaccttgtgcacgctcagagagactacttcggtgctcacacgtacgagaggaaagacatgcctggatgtttccacaccgagtggttcaagattgcgcgcaac

SEQ ID NO: 2204 - DNA, 419 bp, Zea mays
  Clone ID: LIB3227-041-P1-K1-A3
gcccgcgggccccggtccggggttcgagccacgcgtccggcgttacacggcgctctctgagcctctctgccaagtcaagatgcagcccatgcccatgcatctgcttctgctgctcttcctcagccttgcgtttccgctgcagcctatggtcgtccgagcttctccggcctcgtcctcgtcctcgtcctcgtcctcgtcctcgccccgccatgactgcccgagcaagtgtggcgacgtgagcatcgagtacccgttcgggatcggccctggctgcgcgatggagaaagggtttgagcttcactgcaacgagtctcggtctcaggacggccgccgaagcagcaccgcgtacttctctgacggcgacctgccggtactggccgacatactgctgctccacgggcaggtccgggtgatgagct

SEQ ID NO: 2205 - DNA, 332 bp, Zea mays
  Clone ID: LIB3227-041-P1-K1-A8
gcccttctttttttttttttttttttttttttttttttttctttttatgttttttttttttgttttatctttcttgccttgggacaacaactgatttcccggggaccgcttaaaaaaacaaattgaactcctgcacgagcatgggaaacacccccccaatatttatgccacccccgcaacccggtacccttcttttaaccatggccccaaatttacagccaccaccagagggtccaatgccgtttttgactgaccataacctttcaaaaccaaccctccccccggtaagtaaccccacccccagtgcatttccttcgcatgccgccctcaaa

SEQ ID NO: 2206 - DNA, 296 bp, Zea mays
  Clone ID: LIB3227-041-P1-K1-A9
cccacgcgtccggatgaatttgtcacaaagcatggtgtaaaattgggtcttatgtcttgctttgtcaaggctgctgtttctgcacttcaaaacccgcccattgtcaatgctgtcattgatggggatgacattatatacagagacctcctagacatcaatggtgctggtggcacttccaaaggccctggggttcctgttatccgagatgctgataccatgaactttgctgacattgagaaagggataaacaaccttgcaaagaaagcaacttgaggggcgctctcaattgatgacat

SEQ ID NO: 2207 - DNA, 371 bp, Zea mays
  unsure (1)..(371): unsure at all n locations; Clone ID: LIB3227-041-P1-K1-B10
gaacaagacgcgctgatggtgattgacaacattggacgcttaacccaggcaaatactgaggtgtctgatcttcttgcacgtatccgatatcctgtggcataccagccaaccctcaacactgatcttgcaggactggaagagcgtataaccacaacaaagaaaggcaatattacgtgtgtgccaggctatatatcgtgcctgctgatgactcagacagaaccagctcctgatatacctttgcccatctacgatgctacacctgtgttgtcacggcagatctgtgagctttgganacatcctgcagagcatacactgtattccacataaagaacgctttctacacacttgctagaagaggatcattacaatac

SEQ ID NO: 2208 - DNA, 367 bp, Zea mays
  Clone ID: LIB3227-041-P1-K1-B11
gagaggagcagcagagagaagaaggggaggcagtccagtgtccacgcacgtacgctccacagaagagagatggcgatgcggatggcggcggcggcggcagtggcgctggtggcggtgatgggcgtgctggcgccccgagcggcggcgcagacgccgaactgcgcggagaagctgatcccgtgctcgccgtacatgaacacgacggggacgccgccggatacctgctgcggcccgctcaaggacgccgtccagaacgacctcaagtgcctctgcgacctctacgcctcgccggagatcttcaaggccttcaacatcagcctcgaccaggccctctgcctctccaagcgttgcggcctcagcgacacca

SEQ ID NO: 2209 - DNA, 265 bp, Zea mays
  Clone ID: LIB3227-041-P1-K1-B12
aaaaaaaaaaaaaaaaaaaaaaaaaaaaaaaaaaaaaaaaaaaaaaaaaaagaaaaaaaaaaaaaaaaaagaaaaaaaaaaaagatgaaaaaagaaagaagaaaaataaataaagagaagtattaggaggggatggcgcccctagtggtttttacagaagtggggcttgttctgagaattttatccattgatcatggtttatgtacatgttttacccttctttttatacctgttatatccggctaaagggctcctttttttaacg

SEQ ID NO: 2210 - DNA, 62 bp, Zea mays
  Clone ID: LIB3227-041-P1-K1-B2
gctaagtgaagagttcaatactctatttcggtagcacacgcaaatgcttcttggtgaagcaa

SEQ ID NO: 2211 - DNA, 118 bp, Zea mays
  Clone ID: LIB3227-041-P1-K1-B3
attagaattagtctcagcaccaggagcttgaagagtggcaagtgacaccgtgtattctttatcttagtttctgttgacataccaggtatttgtagttggcagacaggcagaattttat

SEQ ID NO: 2212 - DNA, 403 bp, Zea mays
  Clone ID: LIB3227-041-P1-K1-B4
agacgctcgtcgccaggaacgtcatcccggccaactggaggcccaacaccttctaccgctccttcgtccagtacagctagctagctggtctgcgcccctagttctttctactactcggggccgctcggtcaccactactaccaccaccacccactagactactgcttctgctaccaaatactacggcggaacggaacggctggttgccgccgccgtcgtccttggaaaggttgaggcgtctcttggtcatccgtatcgttgccgttgtcatggtccttggagtcgttgctaccctgattgcaagccggcaaggggggaaaaaacaacaacaaagccgtgtgggaaaatggaggaggcaggcgtacaatgtacgctctcccgcccactgttgctttataatctc

SEQ ID NO: 2213 - DNA, 273 bp, Zea mays
  Clone ID: LIB3227-041-P1-K1-B5
ctaccatgacaccatcagggagcttgaggagaagaggaaggagaaggctaaggtggcctatgagaggaggaagcagctggccaagctgcgcctaaaggctgaggctacagccgaggagaagttagggtcccagctggacattcttactccgatcaagtactgaatttgtggaacatctgatccatcgttttaaaagttgtgacagtataatcttgagtgctattccgaacacattttttagccggtgaatgtattgtttgttttatcagaaaa

SEQ ID NO: 2214 - DNA, 51 bp, Zea mays
  Clone ID: LIB3227-041-P1-K1-B6
atttccggacgcccacaagtttctttgtggtaaaaacgaataataaaggta

SEQ ID NO: 2215 - DNA, 345 bp, Zea mays
  Clone ID: LIB3227-041-P1-K1-B7
gctaagtgaagagttcaattctggatttggttctcataccccaatgcttcttggtcaagcaaaagttattcgctactatccatattaccaaagagtcttggaaactgcgaaaactataatgcttgacttgaagtatgtcaataatgcagaggaccgtgcaatttttcttacagatattgacaagttgaaaaagatagaaattgcatcgtcatgctcagatttgtaccatgtagttggtgagacctactgggttgctacaagatgtgatagtatggcgtttcgggggaggcgccttgaagggacaagaattaccactcaaaacataggcaagacaggatttgactt

SEQ ID NO: 2216 - DNA, 409 bp, Zea mays
  Clone ID: LIB3227-041-P1-K1-B8
ggcagccaggtcggtcgtcgtcgtcgtcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaggtgacgctggcctcccgcaaccccaacgaccgcgtgggcatcttctacaagcgcctggacgtgttcgtcacctaccgcgacgaggccgtgacggtgcccgtgtctctgccgtcgcagtaccagggccaccgcgacttcaccgtctggtcccccgtgct

SEQ ID NO: 2217 - DNA, 389 bp, Zea mays
  Clone ID: LIB3227-041-P1-K1-B9
gaaggccagcacctgagcgccggcgccatcgtagggcacgacggcagcgtctgggcacagttcgagaacttactcgagttaaagcctgaggaggtcgctgggatgataaaggactttgatgaacctggaactcttgcaccaactggtctttttgttggaggtacgaagtacatggtgatccaaggtgaacctggagttgtcattcgaggaaagaagggcactggaggcattactatcaagaaaactggcatgtccttgattatcggtatctatgatgagccaatgactccagggcaatgcaatatggtggtggagaggctcgtagattacctgatcgaacagggcttctaagattgtcataacgctatattggtcattgggcacttaag

SEQ ID NO: 2218 - DNA, 323 bp, Zea mays
  Clone ID: LIB3227-041-P1-K1-C1
tgaccatagtcgacgatcttgtctctgtcgatactctcattgaggactatctgtgcgctgagccagttaacgagtacgtccagagctgcgacatcgttgccttcaacaagatctaggcgtgactttcgatcagtccttcccctggggtgctggcgatggtggtggctgggcaatgcaccagcctaatttttccatagctatatgtctgctttgtgtggccagtgatattgccgtgagtatttttggatcctattcgagtcgaatgtaccagtaccagagttaatttgctttaattcgaaacaccgttccggttggaattcaac

SEQ ID NO: 2219 - DNA, 331 bp, Zea mays
  Clone ID: LIB3227-041-P1-K1-C10
gttcagtctggaccgtatctgccatgacgacgacacctacacgctgcggatcttccttgcagcttctcaaatgtgcaggttgcaggtgcaagtgaatggggatgcaaggagaggcagggattttacaacgcccgacatgggcgatgacaatgcgatcacacgccatgggatacatggctcacagtggagccttgagtgtgtggtcgggggccacctgctacgccaaggcgataacaccattgacataaaactcatcgcacaacaaggaccgaaaggttctgccatggtcgccggggtcatgtatgactatattcggctagaaaggccacca

SEQ ID NO: 2220 - DNA, 393 bp, Zea mays
  Clone ID: LIB3227-041-P1-K1-C11
caacactcaaataaaatgctttgctgcagtagaagaagagcttgttacctcaggttatgataataagatcttcaggattcctcttaatggaaaccagtgtggagatgctgagtcagttgatgtaggtggtcagccaaatgctttgaaccttgcacttcaaaaacctgaatttgcactggtcactactgattctgggattgtattgctgcacaactcaaaagtcatttctacaaccaaagttaactataccatcacttcatcttcggtgtctcctgatgggacagaagctgttgtgggtgctcaagatgggaaactgagaatctattccatcagtggtgatacacttacagaagaagctctgcttgagaagcaccggggtgctatcacttccat

SEQ ID NO: 2221 - DNA, 346 bp, Zea mays
  Clone ID: LIB3227-041-P1-K1-C12
aagtgacttgtgatcgtgattcgttcagccctcgggattgcatgcttcttgatgccgcagcggtgaccgatttgtcttgcacaacgaagctgccagggttttttttttgtttattttgttctaagaaatgtatgcgagtagtattcagatagggttttagaggttgtgcagcagctcaagcaaaattgtaaaaaaaaaaaccgcattctattaccttaccttgcttgtttaaggaaaccaatccttttccttctttttcttttctttctctcggatggaaacaatgcatttgcataagcctgtagtcaatgtcaattgttatgatctagcatctgattccgagacg

SEQ ID NO: 2222 - DNA, 394 bp, Zea mays
  Clone ID: LIB3227-041-P1-K1-C2
cgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaa

SEQ ID NO: 2223 - DNA, 404 bp, Zea mays
  unsure (1)..(404): unsure at all n locations; Clone ID: LIB3227-041-P1-K1-C3
acgctccggaagtgaatctacggccatgacaagggcatcaaagcacgtggtccccaccgtgacaaatactgttcgatgctcttgtcatggccgtagattctccggaagtgaagaaggctttactgcaaaaaggttacagtaatcttctcattcaaatgggccgaggaacatatgttccatccaaggtctcaggagatgctacccttcaagttgaccatttcacattttcaccaagcatcgctgacaatatgagaacagcttccttagttatcagccatgcaggttcgtgatgctcaaaatgatcagcaagctttaaagccagaccgaccttgcgatcgacaaagtcttttgtttgaaatatcttgngtgtctattctatntattgttttgtttctcaaggtttg

SEQ ID NO: 2224 - DNA, 373 bp, Zea mays
  Clone ID: LIB3227-041-P1-K1-C4
gtttggcaccgaacgttgccatatctgacctccatatcatcggacctcaacattgggatccacaaatattcatgaaacgttttgggctgattttggcgcttggcaattttttttgttgtggattaggaaccatgaagacctgtgaaattttcaggactttgcatcaatcgaagatacagcaaattcagcatgctttcgctgcctgcttcaccattgactttctctgtgggagaacggagaaccatgcagctcagcagctgaagagccccacggttggatgtttgcgcgagctgacccaaacttttccatcttttgagctgctgctggagtggtatgataggtcattcatccgaacactgtttggctcgatgtg

SEQ ID NO: 2225 - DNA, 371 bp, Zea mays
  Clone ID: LIB3227-041-P1-K1-C5
gtttggcaccaaactgggccatatctgacctccatatcatcggacctcaacattgggatccacaaatattcatgaaacgttttgggctgattttggcgcttggcaattttttttgttgtggattaggaaccatgaacacctgtgaaattttcaggactttgcatcaatcgaagatacagcaaattcagcatgctttcgctgtctgcttcaccattgactttctctgtgggagaacggagaaccatgcatctcagcagctgaagagccccacggttggatgtttgcgcgagctgacccaaacttttccatcttttgagctgctgctggagcggtatgataggtcattcatccgaacactgtttggctcgatg

SEQ ID NO: 2226 - DNA, 399 bp, Zea mays
  Clone ID: LIB3227-041-P1-K1-C6
ggctgagctgactcagtttcaaaagcaagttgaggagcaatatctctcaaatgtggagaggcaattggagaggatccagaatgcccggaacgctcggaaggcgaacgggcctggtaacatgcaagaaatggacaaggagctggacacccacagggcggagcatggtccaaagcctcggcgagttcccgaggagggcggcaatgatgacgacgaagatgcagatgacatggctgtggaagacgagctgatggatgaagttttgggcatcaacgatggaatcaatgaggacccatccaagccgtccgaagaagctactactgaaggtcagccagcacccgaggaagcacaataggattctttgttcacacaaggtaggcgtaccattccggcattccgtat

SEQ ID NO: 2227 - DNA, 375 bp, Zea mays
  Clone ID: LIB3227-041-P1-K1-C7
ggaaaaggcggcattcaggaacccggatgagttctattttaaaatgatcaacagtaggactgttggtggaattcatagacctaagcctgaagataataagtatactgaagatgaacttcttctgttgaaaaataaagatatgggatatatccttcagagcgctcaaagtgaaaaaaggttactgaattggaacggggaaaaatccataaagtgctgaagactaagtggatcgagcgcgcgcgagggttgtcgtaaaatgtccaccgttattaagagggctaatgaattcccggtcgattagagctacatgcatggaggagtgcacacacatgcctatgttgtttgaattaatcaaattgttgtttgttagtaatt

SEQ ID NO: 2228 - DNA, 398 bp, Zea mays
  Clone ID: LIB3227-041-P1-K1-C8
ctcacatccttggtggatcaagtgacggaagtgtatacttgtggcaggtggatcaacctgaaagtgctcctatagttctgaaaggccatgaaggtgaagcaacatcggttgactggtgtgcatcagaggttggaaagatagcaacatcttctgatgattccacggtacgtgtgtggagtaccatgaaaatggactgtacaaatgtaagctcgccaacagtgatccgtaagcggataacagcaccaagcaccgagtaccgaaggtccattacccatgagcctgctactacatcaagagacggagttgtctgcactagcggtgatggcgaattgcaaagcggttgccactctccccttcaacctagagcactgcacttcggcactcctgaatcttcaaag

SEQ ID NO: 2229 - DNA, 318 bp, Zea mays
  unsure (1)..(318): unsure at all n locations; Clone ID: LIB3227-041-P1-K1-C9
gcaggtctgttcatatggtacgcttgttgggcccgtcctttttcccgaccggggattacaaactcatgcacggtaagcctggagcatcaaacgtgtctactgtggtagctaatatatcctatcaagtatgttgcctttaaaacatgctccgagtcggtgtttgcccactgttatcaaggttgtactacttaataacatgtgactttaggcattgtgccactatcttaacagtgaacgtgtgtgctgcttgtattgtgtatatactggagaattttaagattgcatcatgcgagcgtgttgtgtnnnatananantaaa

SEQ ID NO: 2230 - DNA, 152 bp, Zea mays
  Clone ID: LIB3227-041-P1-K1-D10
tcgaaaatctcctgtctttccccctccattttttcctttatatcacctactagggaagtccttcaatatccgactcttacctacctcatgatgctctttcattctctgacctccactccaatctctatgttttcttagatgaatacatatac

SEQ ID NO: 2231 - DNA, 308 bp, Zea mays
  Clone ID: LIB3227-041-P1-K1-D12
cacttccctcttcccgcccactcgccaagacaaacgcggcggcgatggccgtccaggcgcagcacctgttcgcaccagccttcctgccccacgacgtcggccacgccttgagggcgttggagggtgccgcggcagtcggtggctccgcgctcctggacgagctcggcctcggcgggtgcgcgccggcgccggcgccggcccccctcggtgacgcagcgatcggcggcgcccagccgcgcagcgagctcacttgcaacgccgtcggtgacaacagcgtgttccttccgaggaagcggtcacgctttgtg

SEQ ID NO: 2232 - DNA, 395 bp, Zea mays
  Clone ID: LIB3227-041-P1-K1-D2
aagacgtggtcgatataggggtggttcctctcattcatctcctgatcaaccatcctcgcctcagcctcgtcggtagttgagtcttcgtatgatggcttgatcacttcgtatgaaaccttgcgatagcaatattttggtccaccccttgtgatcacatcctgcatgggtgaagatggttgggccttcagcagccacaaaaaaagtatatgccctagctggcttgttggtgctctgtgattctcagaagcactgaattgtgaataccatcaaaagaggcatcaatttaccggcaggttattttaccagtcacaatgatgcttcctggaatcaaaataactatcttccgaacaaatcatggaaccttcaatcctataatatcttcatacagaaatcag

SEQ ID NO: 2233 - DNA, 388 bp, Zea mays
  Clone ID: LIB3227-041-P1-K1-D3
ccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctggtggcgagtgcctcacatttgacca

SEQ ID NO: 2234 - DNA, 398 bp, Zea mays
  Clone ID: LIB3227-041-P1-K1-D4
agccgtagaaacgcctgcctcgcccccgcagtcctccccgatgagcacgcgctcgcgaagtccgtcaagtgccgcctcgggccgccccgatgatgcgctctcattcgctgacctccactccaagctctctgttttcttcgaggaatccatatgcggcggcgcaatcatcttcgactacatcccggcatggcgccgggtgtcgactgccgactgccgacttctggcctggttttgaagcagacggcgaggacattcatgcctcgcactcctctgacccacagagagataagccctgcttccgtcttgctctgctctcccggcgacaacacgccatccaggcagcaagctgcaaacggtcaatggtgtcacgccgtgctgccgactgttcccatgcagcg

SEQ ID NO: 2235 - DNA, 377 bp, Zea mays
  Clone ID: LIB3227-041-P1-K1-D5
gaagactatggaagagtgttatagtgtaatgcttgatgaggcaaaacacgacataactggcctacgggaaactgtggagaagctagaagctgaagtgagcaagtgcagagaagaatgtgaatgtaaggagcttgaccttatcacggctagcaagcagtctgaacaagaaattgctgctcttaaagaagaagcccagcatttatctgcatcactgcaagttgcagagcacgagcttgaagcagtcaatgaagagagagaaaggtttcaggagaaactggcgtgcacagaatcagcagttgctgaagccaaccacgctgtgcaggaggcaaaggccgagaaggagaggcttcaagagaagcttgcacacacggaatcag

SEQ ID NO: 2236 - DNA, 259 bp, Zea mays
  Clone ID: LIB3227-041-P1-K1-D6
gtttttcattctaggcatacttccttcgtcccagtatataaggcataaaccacctttgttttaaagcccaagaaatgtatttaactctctttatcaatactagtactaccgcatcgatgtatgtgtatctagaaagaacatgctttatgttatgggacaaaaacaaaaaatagttatatgtaaaaaaaaaaaaaaaaaaaaaaaaaaaaaaaaaggaaaaaaaaaaaaaaaaaaaaaaaaaaaaaaaaaaaaaataaaa

SEQ ID NO: 2237 - DNA, 382 bp, Zea mays
  Clone ID: LIB3227-041-P1-K1-D7
gaggaaggcccgcttggtcttgacaaggtcactgggaaacccaagggatttgctctttttgtctacaagaccattgaaagtgccaagaaggctcttgaggagccacataagcattttgagggagtgatgctgcactgccagaaggcgattgatggaccaaagccgaacaaattaggaggagctggaggttttttcggtgctggagcttcaagtgggggcaaggggtttgctggttatggagctactagtcattctctgcccggaactgttggtattgtccagccaatgtcacctctggcacctggattggcttcattgcctggtggtatttctgctgccccaggtgtggatcctgctctggggcaggccttgacagctttgc

SEQ ID NO: 2238 - DNA, 391 bp, Zea mays
  Clone ID: LIB3227-041-P1-K1-D8
gtcgatcttcgagtacaacgggagcgccgtggtggcgatggtggggaagaactgcttcgcgatcgccagcgaccgccgcctcggcgtgcagctgcagacgatcgccaccgacttccgacgggtgttcaaggtccacgacaagctctacatcgggctctcggggctcgccaccgacgcccagacgctgtatcagcggctggtgttcaggcacaagttgtaccagctgatggaggagagggacatgaagcccgaaacctttgccagccttgtttcagccctcctctatgagaaaaggtttggaccatacttctgccaaccagttattgctggcctaggagacaacgatgagccgtttatatgtaccatggactgcattggtgccaaggaacta

SEQ ID NO: 2239 - DNA, 391 bp, Zea mays
  Clone ID: LIB3227-041-P1-K1-D9
gtccttggcaacattcactcctgatgggcagcatatagtttgtgcaagcgaagactccaatatttatgtatggaaccatgaaaaccaagacgaggcttcactgaaacatgcgaaaaccatatggtcctcagagcgcttctactccaacaatgcagccatcgcaataccctggaatggcccgagacccagaaacccggtctctctggcctcccaaatcttgtcaccacaaggagataacttgtggtgcatgagtaaggctgtgaagtgcagttcgagtcagagcgaagattctgctatcaacagttttgtgtcaaggtttgctcctggtattttcaatttgaatcaggagttctcctctgagtccacttgcagaagttcagcgacctggcca

SEQ ID NO: 2240 - DNA, 386 bp, Zea mays
  Clone ID: LIB3227-041-P1-K1-E10
tccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaa

SEQ ID NO: 2241 - DNA, 357 bp, Zea mays
  unsure (1)..(357): unsure at all n locations; Clone ID: LIB3227-041-P1-K1-E11
tccaactcctgagcactttctcctcgttctttacaagccaatcnaagccgagatgcgaccattgactctaccgacaccgcagcagggggtaaggggaagaagggagcggccgggcgcaaggtcggcgggccaaggaagaagtcggtgtcgaggtccgtgaaggcgggtctccagttccccgtcggccgcatcgggcgctacttgaagaagggccgctacgcgcagcgtgtcggcaccggcgcccccgactacctagccgctgtcctcgaataccttgccgctgaggttctggagctcgccggtaatgctgccagggacaacaagattactcgattattccgcgccacgtgcttctgg

SEQ ID NO: 2242 - DNA, 300 bp, Zea mays
  Clone ID: LIB3227-041-P1-K1-E12
ctacagtcattaccatgaaaaaataatttcccaccggaccatcctctggggtagggtgccttctgccagtgccgaaccgcacgcgcttgattttccgcaccctctatagcctatagcgtacatgtagcccgccgacgtctccacaaccttagtctcaatatccattgtcgtccacaaccctaccgctacatcccgcggtcgtgtgcgcctttcgctaggcggggtcccatctgcattcactccttactcttacctctatggtaaagttcgctcccaggtccggtgccgtcacctcttttc

SEQ ID NO: 2243 - DNA, 389 bp, Zea mays
  Clone ID: LIB3227-041-P1-K1-E2
gagagatgcagctgtgtattatttgctgcagcttcgcgatgttgcagtcattttattgtagttagtttatatgatacgtcgttgtcaccgcatgaaaatctactgctgtgccatatgaagacctgcctcatcacggtgtttgtacataagatcaactactgtgcctacacagtggacggagtatttatatgatgaaatggctatggtcttcaaataagagcttttgttcagcagattctcaagctcacaattagatactagacataactcagataagagcttttgttcaacttgcactatagttcatttgagtacttacctattattggtctctcttgagttgaagctaggtttcaagtatctcctaaggtttcgtataggtgaaaatc

SEQ ID NO: 2244 - DNA, 350 bp, Zea mays
  Clone ID: LIB3227-041-P1-K1-E3
ctcccgcaaaaaccctagctttaccttcccacaagcgcctccaagatgaagctcgtcaggttcttgatgaagctgaacaacgaaacggtgaccatcgagcttaagaacggcaccgtcgtacacggaaccattaccggcgttgacatcagcatgaatactcatctgaagactgtgaagctgacactaaaagggaaaaatcctgttacccttgatcaccttagtgtgaggggaaacaacattcgctattatattcttcctgacagcctaaacctggagactttgctggttgaggaaacaccaagggtcaagcctaagaagcctacttctgggaagcccttgggacgtgggcg

SEQ ID NO: 2245 - DNA, 397 bp, Zea mays
  unsure (1)..(397): unsure at all n locations; Clone ID: LIB3227-041-P1-K1-E4
aaacttggtgttggcggctttagtatgggtgctgctactgctctgtactctgcaacttgctttgcccatggaaaatatgggaatggcaaaccattccctgtgaacctaagtcttgccgttggtcttagtggctggcttccatgtgccaggaccttgaagaacagaattgaagcctcaccagagtgtgcacaaaaggcttcatcaatacctcttttgctctgtcatggaaaagctgatgatgtagttgcctacaagcacggggagagatctgctggtgccttgaaggcaaatggcttttccaatgtgctcttcaaggcatacaatagtcttgggcactacactgttccagaggagatggatgaagtttgcaaatggatcacagcanatttggggcttg

SEQ ID NO: 2246 - DNA, 396 bp, Zea mays
  Clone ID: LIB3227-041-P1-K1-E5
gagacggcgacgacggtggcttcggctgcgggtacgggtacggggctgcggagcagctggacggaggtggagctccccacgtcgccgccgcgggcgccgactccttcttccgcgccggcgccggctgcggcgcctgctaccagttgaggtgcagagaccggagggtgtgcggcaccggcgccgtcaaggtcgtcgtggtagccggcttggccaaccggacggggttcgtgctcaccagggaggccttcgctgcgatgatggcccggccgcgcgtgtcgtccgatgaccaactgctgcccggcttggatgccaatgttgttgaggtcgacttcaggagaataccttgcgagtaccagaacaggaacctgtctgtacgcatcgacgaggaagggagcc

SEQ ID NO: 2247 - DNA, 275 bp, Zea mays
  Clone ID: LIB3227-041-P1-K1-E6
tctgggttttttttgggttggtttgtttttgtgcttcttacgttttctttttttttttttttttttttttcgtgccttttccggaagaagagaggataccggcccaagagctgaaaaccccaaaaaaagggacccccgccaacaggggcggggggccaaccagggggggggggcccatttagttggcgtgcaacccagaggcccactttcaaaatatttaacccccgggcgggacggacccccctttaccggtgaaaaaaaggggcgccgggggg

SEQ ID NO: 2248 - DNA, 78 bp, Zea mays
  Clone ID: LIB3227-041-P1-K1-E7
aaaaaaaaaaaatataaaaaaaaaaaaaataacaaacacaatacatacaaggaaatacaaaaatatatagggccgcct

SEQ ID NO: 2249 - DNA, 372 bp, Zea mays
  Clone ID: LIB3227-041-P1-K1-E8
cagagccaccagctcgtgtgggcgcgcgcgcaccacctcgtctacgactactgcgtcgacaccgaccgcttccccgtgcagccgcccgagtgcgccggccgctgagctcctgaccgacctacgtcgatccgtgcatggcatggcaatggatctcgtcgggcggggtggaaatggaactgcttgtttctctcgctggaccgtgggggtttgtgttcgtgcgtctgcagcaatggtgtctgtctgtctgtagctctgtttccgcttattgaaggtcgcattgttggcgacccatgcgtgggtgaaccggcggtggtgtctcttgtagaaacaagtgaatgggagggattatgggaacgaagaacgatgctgcgc

SEQ ID NO: 2250 - DNA, 296 bp, Zea mays
  Clone ID: LIB3227-041-P1-K1-E9
ctcttctgtcaactttgaaatcaaagcagaacaataagcttcgagaggaactggaccttacgaggagggaagccagcaagcagaatggtggattctcctttgtggtcgtggtggccattgctctcctgggaatgctactgggatatatcatgaagagatagatgggctcataatgactcggcctcatgttagaccgttttcctcacagtattgaatattgtctaatgcacttatcacatgcacactgctactccatagcatattcatctggtgtcttacgtgatctgtttcgtgct

SEQ ID NO: 2251 - DNA, 285 bp, Zea mays
  Clone ID: LIB3227-041-P1-K1-F1
gttgagcgtagatggtgaaactaatgtagcagctcagctgtactcctcccgaccacctggtgaatcctacacaattgtagagtggctgcagcaaaatcacggccatggcaccggagctcctcaaaggaacgctagtacagcagctgctgctgatgctggccatagcggtcgcgcggattgatattgctcatgttccacacgctgttgattgctgagaagcatgttgcggtgggggctgctgacatgcacactggatatggcgtgtgaatgatactggtggtggta

SEQ ID NO: 2252 - DNA, 374 bp, Zea mays
  Clone ID: LIB3227-041-P1-K1-F10
cagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttttctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaactttcttacggaccgtccttcgaccaaggtccacgc

SEQ ID NO: 2253 - DNA, 329 bp, Zea mays
  Clone ID: LIB3227-041-P1-K1-F11
aaaaaaaaaaaaaaaaaaaaaaaaaaaaaaaaaaaaaaaaaaaaaaaaaaggaaaaagtaatcctaaaaaaaaaaataaattaaaaaaataaaaaaaaaaataaaaataaaaagggggggccgttttaggggtcccaggtttgctttccggtttatccaacttaatactttttttttggggccacttaatttaatttcattggccgttgtttaacatctttgtgcttgggaaaccctttggttttacccaatttatttgcttggtagaaattccctttttatccggttttctttttattaaaagggcccttcctttttccttttccaaa

SEQ ID NO: 2254 - DNA, 398 bp, Zea mays
  Clone ID: LIB3227-041-P1-K1-F12
ccacacacctgaccgaccttgcctcctctccctcctatgccaccaaaatgcctagccccaatcaccactactgccgcttcctcccggtctgctgcctaagcctctcgtctgccagcgatccgtcgtcgtccccgccggctgccgcagactccacggggtgcctctactggacgacctgctggaagaagaggaagcggttaaagcctcgtcccggctgcgagcgctgctgccgtgcggctgctatgtgacggcgctatccttaccgagctttcatgcatgtaccacgccctctttcctattcgcagtctttgtttcatcactcagcagaattcacgatgtatgtcttcttgaccttgcaagactattcgctagaggatgaatcccaacttcttgtgcct

SEQ ID NO: 2255 - DNA, 382 bp, Zea mays
  unsure (1)..(382): unsure at all n locations; Clone ID: LIB3227-041-P1-K1-F2
ctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgtcatatttactgttgcttcaagtatggcccgtacggctgcggttgaacggcggcggcnnntgctgagccacagtaccttgctgttgctgagactgcacccagccacagtgcgccgacgccgtcgcagcttgtatctggacttgatttattaaggtgccggaagaggttttggttgcgggtagctattaaggccatctcgagtagatgtcctattacattccttattt

SEQ ID NO: 2256 - DNA, 391 bp, Zea mays
  Clone ID: LIB3227-041-P1-K1-F3
ctgaattcattatctgctgtggatgtcccagtcttgtattcaccccagccatttcaaaatggctgtctacacatcccagaggtgaagtgtagggagatgaggagagcagacatgtcatccggcgggttcgacacagaacagggatccgcatttgcgtcgacggcaggcaacatatgctacagcatggaagtaaaggacgcggttctgccgccatgggtggtctctgggctgtgcgccgccatgagcttggacgcgaccagctttgatctgacgatcgccacggagccgtcgtcgatgggcttgaacgtggctctcgactccatgggcaccaccaccacggatgtccagcctgaagaatccaccccctccagctgctctgcgcccacgacgc

SEQ ID NO: 2257 - DNA, 296 bp, Zea mays
  Clone ID: LIB3227-041-P1-K1-F4
aagcaagtatgttatattaggagaaaaagatctggtcctagaaaaagatctggtcttagatgatgttgatgccgatgatgccatgagagactagcttcgcctgtttgtttgttactaaatagacagaacttgagagtttcacaacttaattgtcaaaaacatattgccttataatttacactttattttcctcaaaaaaaaaaaatgaaaaaaaaaataaaaaaaaaaataaaaataaattaaaaaactaacatgtgtaaagcctggttgcaccagatcagattggtgctgggggt

SEQ ID NO: 2258 - DNA, 254 bp, Zea mays
  Clone ID: LIB3227-041-P1-K1-F5
aaaatgatcttttcttatatgttttttttccttttatgccacattacactaacaaatcttttaggaaaattctaagtttttaaaaatatttagttcaacttcccttttttcaggcacataacccttttttattttccctctattttttttttaataagggattctattaaagcttatgcctgggaaaaacctgctgttaaaaaacttattggctttgaggatatatcccctttttataggtgtggggtttttac

SEQ ID NO: 2259 - DNA, 392 bp, Zea mays
  Clone ID: LIB3227-041-P1-K1-F6
aaaaaaaaaaaaaaaaaaaaaaaaaaaaaaaaaaaaaaaaaaaaaaaaaaaaaaaagagaaagaaaaaaaaaccactactgggggttccttccggtctgctgcctatgcctctcgtctgcctgcgacgcgtttgcttttctttcgggtgccgtatactcaacggggtgcctctactgtacgacctgctggaagaagaggaagcggttaaagcctcgtcccggctgcgagcgctgctgccgtgcggctgctatgtgacggcgctatccttaccgagctttcatgcatgtaccacgccctctttcctcttcgcaggctttagttcatcactcagcagaattcactatgtatgtcttcttgaccttgcaagacttttcgctagaggatgaatccc

SEQ ID NO: 2260 - DNA, 383 bp, Zea mays
  Clone ID: LIB3227-041-P1-K1-F7
ctacgaccagatcaaagtcctgaggatttgcaacgttggaagccggctcccggacgcgcaactgcgcggacttttcctgcaagcttcttctgcaaccgaagcaactcttcaatccagaagtggctgctccagggcggcatggcgccaaaagtctccagcccgttcctcctccgcctaccctgggtcgtcgcgcacgttggatccatcaaatcttccaatgcacgctgcgccggcccgggtcgtcacgcaagagagctcccttcttgctagcgagtagcgactagcgagaggtcgccggcgcggcaaaaatccgaaaggcgagccgagatggcggggtcgcagtcgcaggcgatgctggagaagatggagctgcggcagagcta

SEQ ID NO: 2261 - DNA, 385 bp, Zea mays
  Clone ID: LIB3227-041-P1-K1-F8
aattctgttacttgcaacatcatgatgaagtcatatattaaacatggaatgcttgaagacgcgaaagacctgctccatgatattctgaattgcaggataaggagtaaagcggattctaatcaagtggcaaccgctgacaagtttactttcaatactttcatggaggcctgtgctgcagcaaaaaggtggaatgacttcgagtatgcgtttcgtgagatgttattgaatgggtaccatttcgatgagcgaagacaccttcggatggtacttgacgcttttaggcatgggaaggaacagctgttggatgatctatggcactacctgtgccgtcacagccgtgtcccgccctcccctgtcataatggaaagattctgcctaaaactga

SEQ ID NO: 2262 - DNA, 388 bp, Zea mays
  Clone ID: LIB3227-041-P1-K1-F9
attgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttatctagtggaaatgtggaatcactgtactggctgttttgccgagacaatgctccttatatttggtttatgct

SEQ ID NO: 2263 - DNA, 412 bp, Zea mays
  Clone ID: LIB3227-041-P1-K1-G1
cgaggaacctactgcattgctcaaagatgcagggcagccacaagcaaatgtggttcctattccaatccccggtgatggcgttgggcactgttccgaagaaaaacatgagggtgcctgctccgagagcaaacgggaggacacacatgctggagccatcagaacggctgatctgttggcctcagaagtcgctgggagctgggcagtggaaacagctccgtctgtcaatggggagaacgaatctccaaggagcttgggcgatgctacagagcacgatgaagctggaggcagcgtggcaggcgatgctttggtaactctggtgaactcagagggccaggcggctgggagccagaacaatgttgagcgtggcagctccaaaataacccatcatcatcatcatcatcgtcatcaccat

SEQ ID NO: 2264 - DNA, 164 bp, Zea mays
  Clone ID: LIB3227-041-P1-K1-G10
caagatcaaacttagggcaggtttgacggtattcatgctcctaacacaaggggaggttatctcggtggcgcgtaaccaaaacgctcatgacaaacaccaggcccttcctccgcaaatgcttaaacagattggagccgtgggctgtctgcactctctgattaaac

SEQ ID NO: 2265 - DNA, 400 bp, Zea mays
  Clone ID: LIB3227-041-P1-K1-G11
cagttacgcgcaacggccacgcgagaccgtatccatgtcgctaaaggagattatgcatagcactgaccggtctggggaaaggactgtggagagaccacgcacgtcctcacgcacaggcagcgcatcccgcagagccgttgcgtcaagcagcaggccagcaacctcgtccatggaaccaagcgagcagcagtatagccgggcgagcagactgttctctagcaacagtggcagccggccatccagcgcccagagagtcaaccctgcgccgggcgagtctagggccacctccctttcgcgggcagcggtcgcgagaggctcccgcgacgagccactccaccgcagcctggagctcctttcccttggcagcggcaagaggaaatagcgggaaggaagccgatct

SEQ ID NO: 2266 - DNA, 398 bp, Zea mays
  Clone ID: LIB3227-041-P1-K1-G12
ccggcaagcagctggaggatggccgcaccctggcggactacaacatccagaaggagagcaccctccacctggtgctccgcctcaggggtggcatgcagatttttgtgaagacattgactggcaagaccatcaccttggaggtggagagctctgacaccattgacaatgtgaaggccaagatccaggacaaggagggcattcccccagaccagcagcgtctgatctttgctggcaagcagctggaggatggtcgcaccctcgcggactacaacatccagaaggagagtacccttcaccttgttctccgcctcaggggtggtatgcagatctttgtgaagaccctgactggaaaaaccataaccctggaggttgagagctcggacaccatcgacaatgtg

SEQ ID NO: 2267 - DNA, 245 bp, Zea mays
  Clone ID: LIB3227-041-P1-K1-G2
aaaaaaaaaaaaaaaaaaaaaaaaaaaaaaaaaaaaaaaaaggggtgaacaaaactaaagggaaggaaaattttatgtgctcgcatatacaaacctcaaattttctatatggtgacctatatttagttcactcttgctggggttacacacttcgggtctttgaaaacccttaggtgtcacaactttatattctcttgactcatatccctttttccaaatctcgtaataacctttagggccccacc

SEQ ID NO: 2268 - DNA, 132 bp, Zea mays
  Clone ID: LIB3227-041-P1-K1-G3
ttaaaaaaaaaatacaataataaacacatttaaatttttttttttttcccaaaaccggggaaggtgaccaaaaccaagttgtgggagtctcacttctatcataaaaaaataatcatgctctaataaaaacca

SEQ ID NO: 2269 - DNA, 393 bp, Zea mays
  Clone ID: LIB3227-041-P1-K1-G4
caagcgacttgctaaaatctggggcaagatgaagggtctcaagctccaaaagaaaggggacatgagtgcactgacccgcaacatgaatgttcagcagatgagcaaggcccttcctccgcagatgcttaaacagattggtggcatgggcggtctgcagtctctgatgaaacagatgggatcgaaggagatgagcggaatgtttggaggcatgggtggttgacttgtttttggtggatcgtcgctgtgatgctaaattgagagcgtttaatgctgcggtctgatcaccatcagagcattccctgaagatcagcctgcgctatgttttggatcaggcttagcgtagctccccatgcctgcaaatttaacctatatgaacagtacgtttgtcctctt

SEQ ID NO: 2270 - DNA, 351 bp, Zea mays
  Clone ID: LIB3227-041-P1-K1-G5
aaacaacaaacttattcatgatttgtcatagttctgggtagtacgcacacacaacacaaccggtccattattaaaccaacactgacacgactcatgacacgaacagcagatactttgacaacctccatatggagagggcaccagacgacgcaggcacatcggcaaaaaaaaaaaaaaaaaaaaaaaaaaaaaaaaaaaaaaaaaaaagaaaaaaaaaaaaaaaatgaaaaaagaaaaaaagggggtgtgacgctaaaaaagagagcagtttaatgctggggggggggccactatatgattattatatgaagaccaatatatactatgttttgctttttttttagcgtatct

SEQ ID NO: 2271 - DNA, 425 bp, Zea mays
  unsure (1)..(425): unsure at all n locations; Clone ID: LIB3227-041-P1-K1-G6
tacgccccangtaccattcctttaggcgacggacgcgcacgctcgatcgcaaatatccaaccagtcactcgagaccgcttgcgtgctcccataaggggggagggggcctcttagcaggcgacgtacttatacgagttatatggcaagttcgctgtaaacacaaacgcagtaggacatcagcgctgcaaggactagcctaacgccattgacgatgtgactgacaccatccacaacaatgatgtcgataccccaaaccacacgcttctgatctttgctgacaagcctctagcctctatatcgctctctctcggactacagcatcctgtaggagcgtccctttcgcggtcagctgtcgctagaggctcccgcgactagccactccatcgcatgctgtagctcctttacctaggagccgcaagaggaaa

SEQ ID NO: 2272 - DNA, 233 bp, Zea mays
  Clone ID: LIB3227-041-P1-K1-G7
aaaaaaaaaaaaaaaaaaaaaaaaaaaacaataacaaaatacaaaaataagggggtgggagaacaactcctggtgaggcggacagcttctgtcgtcctacctgattcaggttaccgtacggcccccttcctcggtcttttttttatgtggggtgatctaacctcagtggccgtgtggaggcttgccatcgtaacaacttcctatctcttggggagaacaaattttagcgttct

SEQ ID NO: 2273 - DNA, 390 bp, Zea mays
  Clone ID: LIB3227-041-P1-K1-G9
cccacgcgtccgttcacggcgagtatccttagttcgttatcctaaacctgaggaatttacaaaaccaagttttgggagtcttactcctagcataaagaaatctgcaggttctaagaagaccatgtctcggttcaccggtgcatcaaagaatcccagtagccaaggttcggcgctttcactgggccaaaggagcgcagagccaacacccaaacacaaggggaagagaaaggatgaaagcagcctggggcactcaaatgtgtcgggcaaggccacagaaggatctgaggctcgaggcgcggggagcaacacggcttcagagatgccacagtcgccaccggaaaaatcaaagaagaggaggaagaaagataagatcgttgagtagtagtgtca

SEQ ID NO: 2274 - DNA, 115 bp, Zea mays
  Clone ID: LIB3227-041-P1-K1-H1
aaaaaaaaaaaaaaaaaaaaaaaaaaaaaaaaaaataaaaaaaaaaaaaaaaaaaaaaaaaaaaaaaaaaaaaaaaaaaaaaaaaaaaaaaaatgggagaaataaaaaaaaaaaa

SEQ ID NO: 2275 - DNA, 403 bp, Zea mays
  Clone ID: LIB3227-041-P1-K1-H10
acggagtcgtacacccttatcgacaaaatgcttgaaaagattggaacacctgaggcacttgccttgagagggaaggctgccgtcgcacaggccaaactagcaaatcggctctaccagaagaaattctctggcccgaggtgggaggcgttggccaagaaaggtgccaagaaacagaggttgttgtgggcatccaccggtgtcaagaacccagcttatcccgacactctttacatcgacagtctcattggacctgacacggtcaacacgatgcccgaccaagctttgcacgcattcatagaccacggcactgtctcgaggacagttgatgcgaatgtgtccgaggcggaaggtgtatacagcgccttggagaagcttggcattgactggggcgaggtcggaaagc

SEQ ID NO: 2276 - DNA, 452 bp, Zea mays
  Clone ID: LIB3227-041-P1-K1-H11
tgcggtaccggtccgcgagtccggggttccgagcgctacgcctcacgcgtacggtaagtatgctgctgagacaaatccacatgatgctcctgtacctccttgcatcacacaactggaaggtggagttgtccaagtagccattgaagtggaagaccgggcacaacgttcagcagtaacaagagtgaatgctgatgacgttcgagtaacggtagctgcccttgctgctcgaggggaagctaacagtgagttgctagaatttatgggcaaggttcttggcctaagattgactcagatgacccttcaaagaggatggaataacaaatcgaagcttctaattgttgaggatttgtctgcacggcaagtgtatgagaagctcctagaagctgtacaaccttaggcatcgaagcaatggagcaatgtggtatgcagtatgcgtctggatattctctttc

SEQ ID NO: 2277 - DNA, 410 bp, Zea mays
  Clone ID: LIB3227-041-P1-K1-H12
gcctcgtgggctccctagcctcccccagtccacggcgctagctccgttcacactcggacgtggcgaccttcgaggcgacgagacgatgctgcggctctcccgcttactcccctccgcctgcaggcaagcgtctaagactaaaatagacatctctggacgctgtcattgacattccaacaagctgcctccactgcagcaacaaatgccgatgggaacttgtctggcaaaaaggctgcacgttataccgtgttcaagggaaaggctgcactttatatacatactatactgccgagcctcaggatattagaatccggaggatctcgagtgagcaaaaatggatcagtaatgctgaccttctttcctgctgttggacaaaggaagtatgactatacaaagaaacagctctttgc

SEQ ID NO: 2278 - DNA, 318 bp, Zea mays
  Clone ID: LIB3227-041-P1-K1-H2
gagatcaatcagaccaatatttcataagtgtgataatgtgatgaataacgatgggcgcaataacaacactgacgatgccaccttggtcggatctgaatgccgagggatgagaaagcattggtcagacacataattgtggaaatcggtatacaaagctctggttctgccgaccttcgtatcaaactgaagctccacttttatgtcagctggactgatatggagttaatttcaccactggtacctatatcaatcggattgcttgacgggtcggcagcctgagttctcttgtgttaacattttaggcttacacacacatcg

SEQ ID NO: 2279 - DNA, 379 bp, Zea mays
  Clone ID: LIB3227-041-P1-K1-H3
gcctcctatccttgcacgcacacgcaaacgcatcccatcctgtgctcgcgttactactagttagttagagagacagagaggatcgatctgctggccgcatctaagctggagaaaggcggcgccaccgacgagggcgacgagataggcatcgacccagcggcggagactccggagcagcgcaacaagttcctggtcctccgcctgtacgaggcgctcaacgcccgggaccacgccgccgtgcagtcgctgctggcgcccgacctggagtggtggttccatggcccgcccaagcaccagcagcacatgatgcgcctgctgacaaccaccaccaccaccaccaccggcagctttcgcttcgtgccccggtccgtggacgccc

SEQ ID NO: 2280 - DNA, 446 bp, Zea mays
  Clone ID: LIB3227-041-P1-K1-H4
ggcgcccgcggtaccggtccggggttcgcggcgcacgcgtcacggccaagagcaactacaactttgagaaacctttcctgtacctcgcaaggaagctggctggtgatccgaaccttcactttgttgaagctgttgctcttaagcctccggaagttaccatcgacatggctatgcagcagcagcatgaagctgagcttgctgcagcagctgcacaacctcttcctgatgacgatgatgatctgattgagtagaaaggatcatgagtcttgaacttgagcaggagttgtgccttgcgtgttttaagttgttctagggtgaactcttgagttctcattgtctggatcatctttttctccttggatgtgttgcatcttttgagtgtggaaatggatggtactcctcgccatgaatttgctggctactttatacattgctttgtaactctg

SEQ ID NO: 2281 - DNA, 400 bp, Zea mays
  Clone ID: LIB3227-041-P1-K1-H6
ctggctccctctcctcccccagtccgcggcgctagctcaattctactcggtcttggttaccttctcagggaagaaaagaagctgaaccatggggaagagaaagtcagctgctaagccacctgctaagaagcggatggacaagcttgacactgtcttttcctgcccattctgcaaccacgggagtagtgtcgagtgccgaattgacatgaagaatctgattggcgaagcatcttgtagaatctgtcaggaaaacttcagcacaactgttaatgcactcactgagcctattgatatatatagtgaatggattgatgagtgtgagcgtgtcaacactgttgaaggcgacgatgatgcgtgagcttgccccatgcgatgaaactgttacctacaatcgtaatgt

SEQ ID NO: 2282 - DNA, 308 bp, Zea mays
  Clone ID: LIB3227-041-P1-K1-H7
ctcactcgatcttttacgacaagtctccttactccgttatactaaaccgggggagggtacattgtcaagtggtagtagaattacttctaacatatataaatctgcattctctaataatactaattattttttgaccggtgcatcaaaaacttctattatccttatttccgtgcttttactggtctaaaatatcacatagccaacacccatacacaatgagatgctaaaggattaaatctgtcttgtgcattcaaatgatgtttacattgactcaatacgatctaagtctcgtagcgcggtcagcaaca

SEQ ID NO: 2283 - DNA, 325 bp, Zea mays
  Clone ID: LIB3227-041-P1-K1-H8
gaacaggaaggacctcaaggttgaggaccttgggattgcgactttatttggagttgagctctatgcatggttctgcgtaggcgagattgttggcagaggtttcaccttaaccggctataaggtctagttgatttccagtgatttaagacctgctttataaatcgacactttagctgatgcttgtcgaaacgacgatgatacctgccttccttcacaattttgtttcttgtaagagtctacctagtgctgaatgccagcaaagacgggcacatggttgcaacattgcctcaataatttgcccgcgcaattcttgattttgatgcaa

SEQ ID NO: 2284 - DNA, 87 bp, Zea mays; identical to SEQ ID NO: 1371
  Clone ID: LIB3227-042-P1-K1-A1

SEQ ID NO: 2285 - DNA, 415 bp, Zea mays
  Clone ID: LIB3227-042-P1-K1-A10
catgcttgcatcttatgggtttaattatcatggaaacgaggtcctttatagtggagtttttggcactgagatggactgtgagattttcatcggacctgtttattaccaacgtcttcgtcatatggtctcagacaaattccaggtccgcactaccggtcgtatagaccagataacaagacaacccataggaggaaggaagcatggtggagggatccgatttggtgagatggagcgtgatgccctcctcgcccatggttcgtcctacctcttgcatgacaggctccactcctgctcggattaccacatcgcagatgtgtgctccttctgtgggagcctgctgactgcgacaatgatcaaatccgatacccagaagaaagtcaagcacgagatgcttgggctccccactgtgagacca

SEQ ID NO: 2286 - DNA, 417 bp, Zea mays
  Clone ID: LIB3227-042-P1-K1-A11
agatcagccggcagcccggcacactgactttggtcacggctgccttcatggcgtaggtttttgcgtgtgttccgcagggaatccgcatgaaaatccgtctgaaattgcgagcggagcggttccagaatccaaacttgcaagttccgcctccgcctccgccggctggggcgaagattccgccgagtgggcctgggggtcgcttgggtagtttggatttaagcgactgctccgcactaggccaaaaggctcaactttccttctcggcccatgcccattctaaaccgtactacctactccgctcctaggagattcaggtagggatgtaatatggttcggaaaatatccgtccggatccggattcgaaaatggtgaacactggttcggatggaattttcggatatccggactttttttcgg

SEQ ID NO: 2287 - DNA, 277 bp, Zea mays
  Clone ID: LIB3227-042-P1-K1-A12
cccacgcgtccgctttccggttcgttcccctacgcccgtttctctctcgtcgcgcaacatcagagcacaagcgaggaacccagtccagtcccgggaatggagtgcgtattgggcgtggttggccgcgacttcgcgctggtggcggccgacacttccgccgtgcagagtattctcgtccacaagaccgacgaggacaaggtgatggtgctcgactcgcaaaagctgatgggcgcttaaggggagcctggtgatcggttgcaatttacggagttcatac

SEQ ID NO: 2288 - DNA, 70 bp, Zea mays
  Clone ID: LIB3227-042-P1-K1-A2
gcccggcagcggcagcatgcccctcttcggcggcggctccccgggcttcagcggcttcggcggcatgccc

SEQ ID NO: 2289 - DNA, 376 bp, Zea mays
  Clone ID: LIB3227-042-P1-K1-A3
cttcccacgcctgcactttttcatggttggctttgcaccgctgacctcgcgtggctcccagcagtaccgctccctgacggtccctgagctgacccagcagatgtgggactccaagaacatgatgtgtgccgcagacccacgacatggccgctacctgacggcctctgccatgttccggggcaagatgagcaccaaggaggtagacgagcaaatgataaatgtgcagaacaagaactcgtcctactttgtggagtggattcctaacaacgtcaaatcgagcgtttgtgacatcccccctcgtggcctctccatgtcttccaccttcgtgggtaactccacctcgattcaagagatgttccggcgtgtgagtgagcag

SEQ ID NO: 2290 - DNA, 337 bp, Zea mays
  Clone ID: LIB3227-042-P1-K1-A4
gaagaaatgtggagccccaaggccaactccgggaggtaacacgagctcatctcgcagggacaacagcaataaggaagcccctgaaggaagctggacctgcccagagtgcaacaacctgaactacccattccgcacggtgtgtaacaggaaaggatgctcgtacagcaagccagccccggcgaacaactgaacccaaccttcgcgcatcgtccagctattgttgtacccgtagattgtatcctagtcgtgtgcaatctttgaactgcacgaagatgtttgtgcctggagacgagagattcgattcgttacgcttaatttactattatacatttttatt

SEQ ID NO: 2291 - DNA, 419 bp, Zea mays
  Clone ID: LIB3227-042-P1-K1-A5
cacgaaaccgaaccccggcggccgtggaggcggcggcggcggcgggtacggtggtggccgtggaggcggcggctacggcggtggcgggcgccgtgatggcggcggcggctacagcggtggcggcggctacggtggtggcggcggcggctacggtggtggtggcggcggctacggcggtggcaaccgtggcggcggctacggcaactccgacgggaactggaggaactgagcggtggggcccgcgcggccaagttattctgttcgctaccgagttgtttaccctagtccagagtgtttatctttcgtcgtatcgtgtttgttgttgcccatctgtgtttttgaatgaaggtcgctctgcgtcaattgatagtgctgagtacatcctcggttccagcagacccatgcataaatcagcatgg

SEQ ID NO: 2292 - DNA, 421 bp, Zea mays
  Clone ID: LIB3227-042-P1-K1-A6
gtgactgacaagttaaactttggagccatgaacatgtggtttctgctgaacccacctggcaaggccaccatccatgttgagaatgtggacgaatttaagtggttgaactcatcatactgtcctgtgttgcggcaacttgagtctgctgccatgaaagagtactatttcaaagctgatcgtcccaccactctctcagcaggttcttcaaacctaaagtatcggaaccccaagtacctctctatgctgaaccatttgaggttctatctcccagaggtctatccaaagttggataagatactcttcctcgacgatgacatagttgtgcagaaagatttgacagggctgtgggatgttaatcttaatggaaaggtcaatggtgctgtggaaacctgtggggagagttttcaccgttttgacaaat

SEQ ID NO: 2293 - DNA, 335 bp, Zea mays
  Clone ID: LIB3227-042-P1-K1-A7
acctgctccccgcgacggcgtcggggggcgaagctggaggtgtggctagaggtggagtctaacaattttaaccggaacccgtggccgttgtggtccaacttcttgggagggcgcttctgggcggggcccccgacgcggcggtggtggacaagcacgcggagcaactcgccaaggtgctcgacgtgtacgaggcgcaccttgcccgcaacaagtacctcgccggggacgagttcacgctcgccgacgccaaccacgcgtgctacctgctctacctaagcaagagacccaaggccgggctcgttgccgcccgcccccacgtgaaggactggtgggag

SEQ ID NO: 2294 - DNA, 422 bp, Zea mays
  Clone ID: LIB3227-042-P1-K1-A8
catggatgagagttggcatatggctgctgctgggtgttcttgtgtacgctttctacggacgaacccacagctccctaatagatgttgtctacgttccggcagagcaagctgatgagatatacaggagttcatcaggatatgtatcatagaaaagaacagctgcagtcatgtgatacgatagagccacagaaagaccgagcggatgacagttacttaaaaggtggttgtccatcagctgtagaaaattggttatcagccggggaagacggaactgactgttatttctttcatgctcggctagcatgatctcgtggatgcaactttgcaagatatatatgctgctcacgagccaggtcaatttatacattgttggagtgtgtgtagatgtggtgtatataaaaccaactgggtggagtatgtga

SEQ ID NO: 2295 - DNA, 215 bp, Zea mays
  Clone ID: LIB3227-042-P1-K1-A9
attttgtcggttggatttggaaaaaaaaaataaaaaaaaaaaaaaaaaaataaataaaaaaaaaaacaaaaaataattaaatataagagatttactttccgtacatagcaagctcgttgggatgtgttggagttctttagggtttgtttcttttcagtggacatattctgtcatgtgtttgtttagcgctacattttttttttttcgtctgactt

SEQ ID NO: 2296 - DNA, 423 bp, Zea mays
  Clone ID: LIB3227-042-P1-K1-B1
atgtaaccaaacacccctaaactttagtcgctagactaaagaaaccaaacatggccttagtagtactgctgtcagttaagtataagagagcccccggatgtggcatgctatgcacggatcatgcatgaaaataggactgggtgcagtaccatgtgtagccaacaggccatcatgtctcaccacctgcatgggaaaacacatccgcagataccagtattggataccccgtagatactccgcagatacatatacactcttgaggatatgtatcccggggtgtattgaaggtttacttaatttctaaatactgataagaatagcctagaaactttagagcacgtgtttttttttggtttggaaaacggatttaaatgattgttaaatgctaatagttccgcctgcccttactgaatggtcaggact

SEQ ID NO: 2297 - DNA, 417 bp, Zea mays
  unsure (1)..(417): unsure at all n locations; Clone ID: LIB3227-042-P1-K1-B10
cgttcccaagccagccattggttggtagcaagccaagctaatcaagttagctttagatacccgctcccgctcttcttccctccgacgaaggcagctgacgacacagcaggctagcttcggagttcggagcactcagccatggccattgccggcgctctcctcctcctgctcggactcctcgcgcgggaggccgctgccggcgggtggcagagcgcgcacgccacgttctacggcggcggggacgcgtccggcacaatgggcggcgcttgcgggtacggcaacctgtacagcacggggtacggcacgagcacggcggcgctgagcacggcgctgttcaacgacggcgcggcgtgcgggtcctgctacgagctgcggtgcgacaacgacngggcggggtgcctgccgggcaccatcacc

SEQ ID NO: 2298 - DNA, 87 bp, Zea mays
  Clone ID: LIB3227-042-P1-K1-B11
gcaactgcctcaagagcatgacgggccggctcggcggcggcgtcagcatggccaacgccgccaacatccccggcaagtgcggcgtct

SEQ ID NO: 2299 - DNA, 299 bp, Zea mays
  Clone ID: LIB3227-042-P1-K1-B12
aaaaaaaaaaaaaaaaatatgaaaagaaaaaaaaaaaaagaaaaaaaaaaaaaaaaaaaaaaaaaaaggatggcctgttatgaggggagaaaggggtcgtaggtttgcttgtatacgatctctttttttgtgtggggtcactctaatttgtggggccgtggtttttggttttcaactttttgtttcgggtcgttcggggggtttcctttttttgggggccttgccgttcatccctttttgggcggctgttgacattcctgatggggggggcccggtggttgcccctagtgttttccctt

SEQ ID NO: 2300 - DNA, 380 bp, Zea mays
  Clone ID: LIB3227-042-P1-K1-B2
gaggcgaggaacctcgtgttttgcgtggagaaggcaagccgctcaacgctcgtcgacgtgcggagctatgcacaaatcgaatcgccaacgttcttacaaacaccgattgggtttgtttatggaccgagaggtgacgaccgtgcaagtgatgtggtgccaaccacaagatgcagtcggtggacgacccaaggaaggatggactcaaccagtatttgctcgccaagcgagtacctcccccagcaaacactatctaagtgtcaaactaaaggtactccttaggatgattggttgatggtgtgacttggcctccatccctgccaccgggatagatggtcgagtgggttactgcttccgccagagaggaccaggaggagtagcgt

SEQ ID NO: 2301 - DNA, 408 bp, Zea mays
  Clone ID: LIB3227-042-P1-K1-B3
gaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgc

SEQ ID NO: 2302 - DNA, 422 bp, Zea mays
  Clone ID: LIB3227-042-P1-K1-B4
atctcctcgcattttccttgcaaccgattgcctatccccctcccaaccaaagaccgatggcgcccaaggccgagaagaagcccgcggcgaagaagccggtggaggaggagcccgcggccgagaagacgaccgccgggaagaagcccaaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagcccaccatcacctcccgcgagatccagacc

SEQ ID NO: 2303 - DNA, 394 bp, Zea mays
  Clone ID: LIB3227-042-P1-K1-B5
gcaactagcgctggaagtacaggtaatgaaacacaagattagcgagatggagcggcagtactcgaagtggacccttcccgggcttcgcggcttcggcactgcccaggcggcggcacagcctgctggtactcagcacccaacagctgcgtgattgctctacttctgcaactgtcgacagctcgcgatctggatggccgactgcagactgcctctgtttagcttacattactcagttacataattgattcgacttcagtagctgacgaaaggctgagggttacgttgtggtacaactgaatcgaagttgttatcgccttatgggttgatcggatcggcgacatgacattcagaccatgtttgtcctagcttaacttatttcacagcttctttatag

SEQ ID NO: 2304 - DNA, 383 bp, Zea mays
  Clone ID: LIB3227-042-P1-K1-B6
gcaactagcgctggaagtacaggtaatgaaacacaagattagcgagatggagcggcagtactcgaagtggacccttcccgggcttcgcggcttcggcactgcccaggcggcggcacagcctgctggtactcagcacccaacagctgcgtgattgctctacttctgcaactgtcgacagctcgcgatctggatggccgactgcagactgcctctgtttagcttacattactcagttacataattgattcgacttcagtagctgacgaaaggctgagggttacgttgtggtacaactgaatcgaagttgttatcgccttatgggttgatcggatcggcgacatgacattcagaccatgtttgtcctagcttaacttatttcacag

SEQ ID NO: 2305 - DNA, 79 bp, Zea mays
  Clone ID: LIB3227-042-P1-K1-B7
aaaaaaaaataaaaaaaataaaaaaactaaaaaataaaccaaaatatgcaggtagaagatacaaaaaaatttcttttac

SEQ ID NO: 2306 - DNA, 427 bp, Zea mays
  Clone ID: LIB3227-042-P1-K1-B8
caaggaggccgaggagaggaagaggcggaaagccgagaaggacaaggagaaagccgagttcaaagcgcgcaaggaagctgaggagagggagaaggtaacgatacgttctacgtgttctctgctttgaaattcgagttacattactataaatcatgcactcggcaacaggtctccaattctaattctgaccctgatcaaaacatctgcagaagaaagccaagaaagacaaaaggagaggcacggcaccagcagattctagcctcactggtgacgggcacgccgcggccttggccacagcagacactgacagcaacgcatcggacaacccgagggaagctgaggctcctcaaccggcggcggctcccaagaggctgtctaggcccgcagcggcaatcaagcagctgaacagggtgcagcccatgccggc

SEQ ID NO: 2307 - DNA, 419 bp, Zea mays
  Clone ID: LIB3227-042-P1-K1-B9
tcgaggagatgcaaaggcctggtaccccgctctacaacatcaaggctttcctccctgtcatcgagtcctttgggttctcaagccagctgagggctgcaacctctggtcaggcgttcccccagtgtgtgtttgaccactgggacatgatgggctcggatcctttggaggctggctcccaggctgcccagctggtgctggatatccgcaagaggaagggtctgaaagaacagatgactcctctttctgagtttgaggacaagctctaatcttttcgtttttgctactgttactggttttaattgtcacccggaggatgggaaccctcgtcgcatcattcgtcgccctttttctgctggtttactacttgaccaggtagaagacatgacatgctggaaatggtcatctcatcatctgcgtac

SEQ ID NO: 2308 - DNA, 82 bp, Zea mays
  Clone ID: LIB3227-042-P1-K1-C1
gaaaagttgcacctgtgtacgattatttatttgtacctgtaatatttatggagaactagcctcgccgcaaatagccctgatg

SEQ ID NO: 2309 - DNA, 420 bp, Zea mays
  Clone ID: LIB3227-042-P1-K1-C10
gtcttcctctctggtggacagagcgaggaggaggccacccgcaacctcaatgccatgaacaagctcagcaccaagaagccgtggtccctgtctttctccttcggccgtgccctccaggcgagcaccctcaaggcctgggctggcaaggtggagaacttggagaaggctagagctgccttcctcgccaggtgcaaggccaactctgaggctaccctcggcacctacaagggtgatgctgccgccgacaccgagagcctccacgtcaaggactacaagtactgagttgcttctctttgcgtgcccgttttggaactcctgcctacgagctaggttgcggagtgtggtttgctcgttagagcttattttcggacatccaaaaaacatgcttcctatgtgggatgatggttatctttatatttg

SEQ ID NO: 2310 - DNA, 416 bp, Zea mays
  Clone ID: LIB3227-042-P1-K1-C11
ttatgatatcacgtctaaggtgaagacaaagttcttgggaaattcattggaaatctatccagttggaaggttaattgttagaattgtatttctttcttggagatctgtatggcttaaaaatattttattggaataaaatggaaacctttttgaaggctgaattgggaccagttattctaatccctgctgtaatataatttccatgtcacaggactagagtgacacttaaaaaatctggtgtcgtgttggatttggtgccaccactaacaaaggttaacaacctgatatttgggcgtacttgggttgattctcctggagagatggttatgacaaacctgacaaccggagacaaagctgtgttatatttccagccatgtggctggttcggggctggccggtatgaggtagatgggtat

SEQ ID NO: 2311 - DNA, 420 bp, Zea mays
  Clone ID: LIB3227-042-P1-K1-C12
cccacgcgtgcgagcacgcgtccgtgttattaggataatgacacaacttcaaggaaagcatgctaatggtgaaaatgcgtgggttggcattgatggaaggactggtgatattgtcgatatgaaagagcgaaagatctgggattcctacagtgttaaagcacaaacgttcaagacagcaattgaggctgcttgcatgcttttgagaatcgatgacattgtcagcggtatcaagaagaagcaggctcctggagcctcagctccaaagcaaccccaaattgaaactgagggcgatgctgacaatgagcagatgattccagagtagaggctgtggcgaacctgcactggcaaagttatttactagtgtcaaggtagcacttcgagcagagttcattttggtggttagccttagcttaaagatgc

SEQ ID NO: 2312 - DNA, 421 bp, Zea mays
  Clone ID: LIB3227-042-P1-K1-C2
actttatcgggtccggatagattttacacatgacgatgcgttacaccggggcggggcggggcggcgagactctcatttacacaggtctgctggaagaactgatctcggatcggagcactgcttaagctagctactactcactgataattttaactaaagacaccgctaatccaggacaagcccatggttcttggtctcacacggaggaagggggtgccaaggcgcggcggcggcggcaaaccggcgaagcgagcgagttcacatgacggagcaggcgttggggttctcgtcgctgaacatctggggcgcgtggaggtgggtggggccgtacgcgtaggctggcgcgggcgggtaatggacgccgccgccgttggggtagaagccggcgtggtggtttggcggtggggcggcaccgtagtag

SEQ ID NO: 2313 - DNA, 424 bp, Zea mays
  Clone ID: LIB3227-042-P1-K1-C3
cgccacaaactattacaggttaaatttgcagagagctcactctcatgtttgtggttttcccccagtgtgggttttgttgagtgtgtgcttttcatctgagctcgaatttctgcataaggactagcccggcctccgcctgcagcttgagcgcgagttatccagactggtcatcgtcggagttggggcactgcaagagcagcaaggagaaggagcttgcccctgcctacctcaccttgagcgcgcagcctcctgcgccacgcgggaagcagcagcctcctgcgctcccctcgatcaaactcccggagttgggtcacttcggcttcatgcagcctcctcagcacgggagcgcttcggcgtcgtcgtccgcgtcggcgtcgcggccgttctacagcttcatgccggctggtccggttcgcatcgagag

SEQ ID NO: 2314 - DNA, 422 bp, Zea mays
  Clone ID: LIB3227-042-P1-K1-C4
cgcttgctcccaatatgggtgactggaatattctttggtgctgcgatctcgcaaatgcacaccacttttattcagcagggaactgtgatggacaccaagatcggttccctgtccattccaccagcatccttatactcatttgaagtgatatgtgtcacgctttgggtacttgctgtcaacaaagtgcttgtgccggcaatccgaacgtattttgcaaatggggtagagctcacacagttacagaggattgggatcggtcgtttcctgatgatctttgccatggcaatggcagcacttctagaaaccaagaggctgcatattgttcaggagggggaactgctaagcattgtatggcagcttccacagtacttcgtcattgctggggctgagtgcttcggtatcatcactcagctggagttctt

SEQ ID NO: 2315 - DNA, 383 bp, Zea mays
  Clone ID: LIB3227-042-P1-K1-C5
gtccgaaacgccatagcggccaatcacttggcggcggcggcggcgatggggcggctgaccgaggagcaggcggcgcgcgaggcgggctcggcggggaccaacgccacgtccctcaagctcacacaccgcgctctctccgacgtgtcgtgcctgagcagcttcaagaacctggagcacctcgacctcggcttcaactgcctcgtcaccctcgagggtttgtcctcctgtgccaatttgaagtggctttcggttaaggaaaacaagcttgtgagcttaaaaggtgttgaggggctctcaaagctgcaggtactgaatgctggcaagaacgaacttacaaaaatggacgaggtcacatctttaacaagcctgggagcattgattct

SEQ ID NO: 2316 - DNA, 420 bp, Zea mays
  Clone ID: LIB3227-042-P1-K1-C6
caagcagcaggcctcctgcagtggaaaatgacaatcagcatgaggctagggccatggctcaacatgggaatgggaatgctacttcagtcgagaggttattgcctaagcttccacgtgcagattacttcacagagcctagtatagaggagcttgcggccaaagaacgtgcggaggcaggctactgcggtcgagtgagggactttgttgtggggcgacatggctacggcagcatcatttttcttggggagacggacgtgaggtgcctggatctggagtcaatagtggagtttaacaaccgggaggtggttgtttacaaggacgacagcaagaagccccctgtgggtgaggggctgaacaaggctgcggaggtgactctactgaacatcaagtgcgtaaataagaagactggggaggagtact

SEQ ID NO: 2317 - DNA, 100 bp, Zea mays
  Clone ID: LIB3227-042-P1-K1-C8
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2318 - DNA, 421 bp, Zea mays
  Clone ID: LIB3227-042-P1-K1-C9
cgcaacattccgaatcacagttcgcatcggagatgaagacacttggccaggtgaggcaccggaacttggttccgctcttgggattctgcgtcgccaagaaggagaggttgctggtgtacaagcacatgcccttgggctcgctctacgaccagctaaacaaagaggaaggtagcaagatggactgggcgctgaggctacggatcggcatcggtgcagcgaaagggcttgcgtatctccaccatacctgcaaccctcgagttctccaccgcaacatcagctccaagtgcatcctcctggacgaggactacgaaccaaagatatcggacttcggtctcgctaggctcatgaacccaatagacacccatctcagcacctttgtcaacggggagttcggagacctcggctacgtggcgccggagta

SEQ ID NO: 2319 - DNA, 425 bp, Zea mays
  Clone ID: LIB3227-042-P1-K1-D1
gctctgcaacattgtccatggcatatgctggtgctgtttttgcagatgcatgcttgaagggtctgaatggagttccggacattgtagagtgctcttttgtgcaatcaactgtgacagagttgccgttctttgcctccaaggttcggctcggcaagaatggagtggaggaagtgcttggtctgggtgagctcaacgacttcgagaagaaggggctggaaagcctcaaggtcgagctcaagtcttccattgacaagggtatcaagttcgcccacgggagctaggcaactcgcccggcttctaacagttgatatcccttgcaaaattttttttttttgactgccttttcccccccgccccgttatggttggcgcaacgaggctttgtggtccataataaaacacagcggagtgtagaaaatgtgcacc

SEQ ID NO: 2320 - DNA, 416 bp, Zea mays
  Clone ID: LIB3227-042-P1-K1-D10
attgactgtatccttatgatcaaaataatgataactgtgccatttatgatttatcttggtgcatgggactttcttgacacctgttttcctaccataatttttgctaccttatggttgtcattctcatactgatgttttaggtttctaagctttgtcttgtttgtttgttccacaaccaatgactaactgaactttgcaaaagtatggctgtcagtttattctattatgtatcttcttttttgaaaaaaattagagatctcggatggcaacagagatatgctcgtttttgtggaagaataattgtcctctcagttcttgtgctacttctctaccccttcctctgggtttggactgtgattggaacattgtggtttagcactgcaagaggctgcttgccagaggaaggacaaaagtgg

SEQ ID NO: 2321 - DNA, 409 bp, Zea mays
  Clone ID: LIB3227-042-P1-K1-D11
gacagtacagagctttgctacattgacagtacaaacaagccaccgcccaccacccaagaggtgcagaggcgctctctggtcgggctacaaggcaccgacgacagtggaggcacgcatccatgacggcaggagactctacaactctgatcgtatctcgcagaggcggttctcctgttcaaggcgctccagatcacacggaggatctctaatacacgcctgacggcatacagaatcctgaacaacccaagagcgcagagttcttgtttacaatgttacatgctatttcttattacacattaaattcagatctaagttatatctccaatctgaagtacaaatgcaacaatgcaaatgctcatcatgatgtgcatcactatatactattcatttcctgcttcttcaaggactt

SEQ ID NO: 2322 - DNA, 411 bp, Zea mays
  Clone ID: LIB3227-042-P1-K1-D12
tctgaatccacaggtttttatgaggaagctaccacggattcttttggtagatttcgtcttagaggacttgtgcctggatcgacttactctataagagtggctgcaaaagataatcttcagtttgcagcagttgagcgtgcttcacctgaatatttgtcagttaatgttggtcatgaagacatgactggtattgattttgtggtttttgaacgccctgaagtaacaatcttgagtggccatgtggaaggagatggcattgatacgttacatccgcatctctctgttgaaatcagatcagcaacagactcttctagagtagaagctgtacttcctcttcctctttcatactactttgaagtccgagatttgcccaagggcaagcatcttgttcagcttcgatctggccttcca

SEQ ID NO: 2323 - DNA, 424 bp, Zea mays
  Clone ID: LIB3227-042-P1-K1-D2
cggcggatctggtggtggtggaagcggtggcggcggcggatctggcggcgggccgacgagcggtcgttgccccgtggacgcgctgaagctgggcgtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgatcacgcccatcgatccatctgcaggctaaataatttgtccaagctagtatatatacgtacgtacgttgatatatatgatgtagtattatatatatgtccatg

SEQ ID NO: 2324 - DNA, 144 bp, Zea mays
  Clone ID: LIB3227-042-P1-K1-D3
cggcggaactggtggtgatggaagcggctgcggctgcggatctggctgcatgccgacaagcggtcatggccccttggaccctcttaaactgctcttgtgcgccaactagcttacagactgatcagcttccctgaaaaacctcta

SEQ ID NO: 2325 - DNA, 419 bp, Zea mays
  Clone ID: LIB3227-042-P1-K1-D4
acaggaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacagaggaagaagggcaagagcgctgtagcttagagcattctcatggattgtcttgcaccgaaatgtgtgtcctgatgagtacactttttttggttaatcgtctcaagttcagagcgttatgccatgttttcagacctgattagtacactgttttctaaaagcgattgagctctagtccaatgtattgataatatctgct

SEQ ID NO: 2326 - DNA, 424 bp, Zea mays
  Clone ID: LIB3227-042-P1-K1-D5
gaagagccatggcgagcgagcacgcggcggggggcgatgctaagcatcaccagaagcagagcctgatggacaaggcgaaggggttcgtcgcggagaagatcgcgcacatccccaagcccgaggccacgctggacggcgtgacgttcaagggcctgagccgggagtgcatcacgctgcacagcagcgtgaacgtgtccaacccctacgaccaccgcctccccatctgcgaggtgacctacacgctccggtgcgccggcaaggaggtggcgtccggcaccatgccggaccccggctggatcgccgccagcggctccaccgcgctggagatccccgccaaggtgccctacgacttcctcgtctccctcgtcagggacgtcggccgggactgggacatcgactacgagctccaggtcgggctcaccgt

SEQ ID NO: 2327 - DNA, 428 bp, Zea mays
  unsure (1)..(428): unsure at all n locations; Clone ID: LIB3227-042-P1-K1-D6
gttgattctgccaaggaacaagagcgtaaggagagaagagagaaggcaaaagcaagagaagaggaagacccaagaagccgacgcagcaaggccagggcctaagcctctcactcgccaacggcagtggcaggtctggaatgttgccgatgtcaaacatgtcagctaatccttcgcagcttacaattttctatggcggatcagtatgtgtgtatgactcagtgccaccggaaaaggctcaagcaatcatgcttatagctgcagctgcagcggcagcggcagctaccaaaagcagtgctgcccctactgttaagccttcaatggtgcctgcagccactgttgccccagcagctgtcgattctcctgtgcttacacggtctncatcactgcagagcacttctgtagcaactgggcaacctcatgttgttgct

SEQ ID NO: 2328 - DNA, 422 bp, Zea mays
  Clone ID: LIB3227-042-P1-K1-D7
gaatgaacgaggacatgtactctgcgttcaaagagattgctggtgaataccgtcgaggtaccatggatgcttttgagtatctttcatatgtcgagcagttcggactgtcgcaccttgttcctgagatggctaggctattgcctgattctcgaaaacagagggaacttgctgatgcgcactatacaaatacacggttgaaaaacctccaagaaaatggaaataataggaaggggggattcttcttatcaaagaagaaaagcctccaagaaaatggaggtggaactagcaaatggaggtggaactagcagaaaattcatattacagaaagcactgccgacggatgatgtgaacagggcacaagcagataatatttaggacactgttagaaggcttcaatcaaaccatcttacttagaaaggaga

SEQ ID NO: 2329 - DNA, 413 bp, Zea mays
  Clone ID: LIB3227-042-P1-K1-D8
attagttcgacaaatttgtagcaactagcacatgtccaagggatacacgtcccggtgccccctccccccaccacctgccgttcattatccttggtcttcaccttcacctatacctacatctccatctactgaacattagacccctccagctaccttgctgacacatgaacaagaagacgggttagactttctcgaaaccctcttcactagtggaggcatcgaccatcactcatcactgtaacccgatggtgatcagcgaccgtgagcttccatgttattgcgttttgatacttgagacttttattatgactatgtatgagatattgtctcttattagtactggatgatgagatgagtcttactatgactatggatgagacttttgtgatgtaattgatgagactatggatgag

SEQ ID NO: 2330 - DNA, 314 bp, Zea mays
  Clone ID: LIB3227-042-P1-K1-D9
aatgcccaaagacatccagatcgcgcgccttatatgctgagagcgtgcataggcggtacgaatgagacgcctactaactactgctggaggtgcttacttaagaaggacatggctactaaataggtgtgcatgtctgtcaatagtacccttgttgctataagctgaagctaacggaggattatgattagcagctctgggagatccgcaagtaccagaagagcgcgcggctgctgtacaggatgcaagcttaccaacgcgtgcatccgaagatatagcactactataagaccaacttaatctaacagagttgccgt

SEQ ID NO: 2331 - DNA, 422 bp, Zea mays
  unsure (1)..(422): unsure at all n locations; Clone ID: LIB3227-042-P1-K1-E1
gcgagatgcagatccagcgatagcgcgcggcggcgggagccttggcgctcagttcctcaccctccgtgcctccgttcactcgccgccgtccggccgggacgatgaacaggccgaggagtgggagtggccagaagaaggggaagcgcgggggaggaggaggcggtgggctcggcgcggcgctgaggaagcaggtggccaggctctgcatcatccgggagtgcgtcatcatgctcctcttctaccacgactgatcccactgacgatgccctttgcggttcttcctggccattgactacctttatctttttttttttctcgatgtgcctcgtgtatgtacatacagggtggtggtggtggtggnggtgttcttgttcttgttcttgctcacgtgtgtgtctgtatctccatcattttttgacact

SEQ ID NO: 2332 - DNA, 418 bp, Zea mays
  Clone ID: LIB3227-042-P1-K1-E10
caccatgctgcggcagacgctctactccaccacgcggatggggctgtacgacatcctcaagaccaggtgggcccgggagaacggcggcgtcctcccgctgcaccgcaagatcttggccggcctcgtcgccggcggcgtcggcgccgccgtgggcaacccggccgacgtggccatggtgcggatgcaggcggacgggcgcctgcccctcgcggagcgccggaactaccgcggcgtcggcgacgccatcggccggatggcgcgcgacgagggcgtgcgcagcctctggcgcgggtcctcgctcaccgtcaaccgcgccatgatcgtcacggcgtcgcagctggccacgtacgaccaggccaaggaggccatcctggcgcgccgcggcccgggcgcagacgggctcgccacgcacgtggcc

SEQ ID NO: 2333 - DNA, 173 bp, Zea mays
  Clone ID: LIB3227-042-P1-K1-E11
aaaaaaaaaaaaaaaaaaaaaaaaaaaattaaaaacaaaaaaaaaaaaaacaaaataaaaaaaaaaaaaaaaaaaaacaaaagaacaaaggggcggccgctcttgaggttccaggcttacgtccgcgtgcttgcgccgtcttacttgttctatcgtgtcccctaaattcaatt

SEQ ID NO: 2334 - DNA, 384 bp, Zea mays
  Clone ID: LIB3227-042-P1-K1-E12
gaagtataatgctgcacatccgtagctattgaagagcctttttaagttacaaactatatcagtgaaccctgataacaatgctagaaggccatttcctgatatagtttgtaacataagaagtataatgctgcacatccgtagctattgaagagcctttttaagtggtcacatatctttttgttgagaagtggagtggaagaaacgataatgggttatctaaagccatagatcactcaggggaagaatgttgccacgttgtgcagtccagaagtaacttacaggcttggaattgatatgaccatgtggttgcccttgccaattgactaattttaagtactagactcagtaacatatttgaggcgtaatatcattattattgacatt

SEQ ID NO: 2335 - DNA, 338 bp, Zea mays
  Clone ID: LIB3227-042-P1-K1-E2
gagctcgctcgagacaatggacggtgcttcatccaacaatggagcggctacacaaggccccgtggcgatcaaaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagctagcagaggcgcctgcttgtacctagattactgtttccattgtcgtcgtcatcggctaacattgtcataatgtcagtttgggtaatgttagattaagt

SEQ ID NO: 2336 - DNA, 423 bp, Zea mays
  Clone ID: LIB3227-042-P1-K1-E4
acggagctcgatcgagacaatgaacactctctactcaacacgcggatgggcaaacacgggatcgaatacaacaaatatgctggagtcaaaggcggcgtcctcccgctgcaccgcaagatcttggccggcctcgtcgccggcggcgtcggcgccgccgtgggcaacccggccgacgtggccatggtgcggatgcaggcggacgggcgcctgcccctcgcggagcgccggaactactgcggcgtcggcgacgccatcggccggatggcgcgcgacgagggcgtgcgcagcctctggcgcgggtcctcgctcaccgtcaaccgcgccatgatcatcacggcgtcgcagctggccacgtacgaccaggccaaggaagccatcctggcgcgccgcggtccgggcgcagacggactcgccacgcacgtg

SEQ ID NO: 2337 - DNA, 420 bp, Zea mays
  Clone ID: LIB3227-042-P1-K1-E5
gtggttataacactgttgagtgggttcgctacatcacaagggctggatcatatgagataaggtgttagcaacaaatccatacaagatcaagatattattgacaaatgatattcattggtctccattgagcagctatccacagagatcaatctgtggcatcatgcatgatcataaagcgcatatattgtgacacaagtatctgaaactttgtacttcaacagagggtggggcagggcagatcagacaattttctgtgtttcttatttccattgtagtctgggatctctgttcttccctccatgccctgtttgtagtagggattattttttgctcgtatatttggctgtagctttccttgtttgttgatcaatacacctgttcagtttgtattgttttctccctcaaatggatgtatggatt

SEQ ID NO: 2338 - DNA, 422 bp, Zea mays
  Clone ID: LIB3227-042-P1-K1-E6
atgaagaccattctttttaccaatctttggaagcatttcaggtcgaggaaaactgggacttctcatatcttctcgacatacttatatgctctggtatcatagttgttgactggcagctcatctgcaagtcatggtacttgcctggttaccctgttggccctcatgtctttgataggcttgaaaggaaatacaataaaatcgcaacatgggcaaagcctgagaggaggcttctttttgacctcgtgaattcaattctttccgaggtccttgcaccatgtgttgatgtgcacccatgggtgcagcctagtagacactgtgtggcattttggggccctgaagggcctgttgagaaggtttggcagacaattgttaggctgcaggaagactgtgtcacaaggcatcctgatgagatggttcttgat

SEQ ID NO: 2339 - DNA, 420 bp, Zea mays
  Clone ID: LIB3227-042-P1-K1-E8
agcacggtgactcgtctgcccctgctcccccttcccccgctcccgcggtctcctcccccagggtggccgagaggaggtttaggatttcgctgccctggcctctcagggccgcctttggcgctgctcaggcagagagcagcaatcccaccgatgatgacgtgcctccgtctggcagcgatgcagctggtggccctcagtctcagactggatatgatgatctcgactgaggcctcaatagccgttcttggaaacaaataggtatgaacaacaaattgcagttattactactagggttcatcgcttgctgttatctgtttggcgtcacctacctatagttcaggaatcaggtagcaccatgcatttactatcgcatttgattacggttactgtattgactgccaaagaaaaagaaaaaggctc

SEQ ID NO: 2340 - DNA, 104 bp, Zea mays
  Clone ID: LIB3227-042-P1-K1-E9
gaccaagccttccggttccgtccaacagaagccttgcttgtccccggcgaatttttggttccttgtcccacataaaataaacaacaatggggtgttgttcgtgc

SEQ ID NO: 2341 - DNA, 425 bp, Zea mays
  Clone ID: LIB3227-042-P1-K1-F1
ccacgagcgttctgcccgagagaagatctacacaaacagcgtcgcccacatcatgaatgacgagaccactcgcaagtaccttcagtcaatcaagaggctcatgacgctttgccagcggcgttaccctgcactgccctcaaaatcagtggagttcaacagcctggcaaatgggagtgacctgcaggcgcttctatcggaagagaatggttcgggtaaagcttccgaggaaaggctccggttgatgccagcatcgaaagagtgatgccttcgcagactagattggattacaagtagagcttgagatgcttgtgtaatatattcaatcaattctgcctgtttttttttcttttctgtttgtgctgaagagaaaagcaacagaattgtgtatgctaattaaatcgctttaccgctacatgtggtcgggc

SEQ ID NO: 2342 - DNA, 420 bp, Zea mays
  Clone ID: LIB3227-042-P1-K1-F10
atgaacttgctctagtcaaaatggtcttttcaatgttcccaaatgtctccacggacttcattgatgagttaatcaaggcaaatgattttgacatgaatctgactgttgatatgctttatgagctgaactcacaagatatggttcatgatgattctgaggttatcaatcattttcatgatgattctgaggctaccaatgaccttcatgatggcaagggcgtacctggtgctgattaccacaagactgtggtgcccgagagtagcagcaacatgaatcaagacctgcagaacgaggagtcagcaacaacttctgatgtgaaatctgtgctgccaaagttctcacagatcaatttgcttcacaatgacctgggcctgcctgatgatgataagtcagcggggacttctattgcaaattgatctt

SEQ ID NO: 2343 - DNA, 424 bp, Zea mays
  Clone ID: LIB3227-042-P1-K1-F11
cgcggggggagcaggaaggagaggggaagaacagaaggggaaggcgggcggggccgcgatgtcggtgcggatcaaggcggttgtagaccggttcgtgaaggagctgcaggaggcgctggacgcggacatccaagaccgcgtcatgaaggagcgcgagatgcagagctacatcgaggagcgcgagcgcgaggtcgccgagcgggaggccgcctggaaggccgagctatcccgccgcgaggccgagatcgcacggcaagaagccaggctgaagatggaaaaggagaatttagagaaggaaaaaagcgtcctcatgggaacagcatcgagccaagacaaccaagatggagcccttgagatcactgtcagtggtgagaagtacaggtgcctccgcttctccaaggcgaagaaatgagaaatggactgg

SEQ ID NO: 2344 - DNA, 419 bp, Zea mays
  Clone ID: LIB3227-042-P1-K1-F12
cttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcggc

SEQ ID NO: 2345 - DNA, 216 bp, Zea mays
  unsure (1)..(216): unsure at all n locations; Clone ID: LIB3227-042-P1-K1-F2
cgagaaggcagccgaggagaagttggggtctcagttggagattcttgcccctatcaagtactgaggagctgtgctttgtcatcagttttggggaacatctagtctttgttttaagtgttcggtaacagtttgtgacagtataatctggtaaaccgtgttatttttctgccactcctatntgaacacattttctagctggtgaatgaactgtttggt

SEQ ID NO: 2346 - DNA, 266 bp, Zea mays
  Clone ID: LIB3227-042-P1-K1-F3
cttccgtcaacggcccttgcttttttaaccacttgcaaaggccggccacaaaggatgcttgggtgattggtggccttaatgtgctgggtattattaatgagccaaccggtgctggtattggctatgggcttgacaaggaggcaaccaatgttggtgagaagaatggtcttatttttgaccctggaggggggacctttgatggcttccttcttaccattgggggagggatttttgaagtcaagggcacaacttgcgacacccatttt

SEQ ID NO: 2347 - DNA, 304 bp, Zea mays
  Clone ID: LIB3227-042-P1-K1-F4
accatgcttgcggtcctactaggtggtgaaaaattaaaagaaacaaaagaatgctggagtgataggtggcctcaatgtagatgcgggctggattaatgtagcggatccatgctgggttgcctactattcggaccagaccttccgtcattgtgctagctaaaattattctactggtcgacgttatacaacgtagtgtctgggaataccaactcacaaaccaggatagtcgctttgcagaaaatcccacaattagaggcagccatcttaatgttgaggactgaagaaatggcattaacaaacagtt

SEQ ID NO: 2348 - DNA, 426 bp, Zea mays
  unsure (1)..(426): unsure at all n locations; Clone ID: LIB3227-042-P1-K1-F5
gaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggcaccaggcggcactaaattcacaagaaacccccctccacctcaagggatcgagatcatctacaattatggcaaggaggaccagtaaacaagagtcctgcaagcggngggcagaacttccacagttccaaatcacttcctgtttaat

SEQ ID NO: 2349 - DNA, 426 bp, Zea mays
  Clone ID: LIB3227-042-P1-K1-F6
ggcttggctctgtcatccacggctgttgtcttgcaagtattgcaagagcgtggtgaaagtacgtcgcgtcatggacgtgccacattttctgtgttattgttccaggatttggctgtggtggtcctgttgatattaatacctctcatatcacctaattcttcaaaaggaggggttggtttccaagcaatagcagaagccatgggaatggctgcagtcaaagcagtagctgctataactgccataattgctggaggtcgtctgttgcttcggcctatttacaagcaaattgctgaaaatcagaatgctgagatattttcagcaaatacactccttgttatttttggcacaagtcttcttacagcccgggctgggttatcgatggcacttggagcttttttggctggtctgttactagcagaaacagag

SEQ ID NO: 2350 - DNA, 247 bp, Zea mays
  Clone ID: LIB3227-042-P1-K1-F8
gtcattttcctttggccgttgaataacgcaagagcaatatgctcaggcggaagaattttgtatcttccgtaacttggtgaacatccagatacttgatctgcggcaacaatgggcagaagagattaggacatgctgattgatctttatacgccaacacttgcttttctttaacattacttgttcgctgcagctttaatccagctgtttgtaactgcaatttatagcaatttatagagatttgggctaa

SEQ ID NO: 2351 - DNA, 416 bp, Zea mays
  Clone ID: LIB3227-042-P1-K1-F9
ctattctgatacattgtcaagcgacgagttcgataatatgaacatctcaatatatcgaaccatggaagagcagttgtctatgtttaaggatggggaggacagagatttctcttatgtacaggacatgcttgctagcgcgtgcgacttgccagagcacctagaagattggcaagtgagctcagatgtgttcctttgtcttgaaaacaagtacagcaagctggttctgtggtcaaaatccgacaggaaacttctgtttgatcttgtgaactcaattttggctgacatgaccattccagacattggcttgtgttcaaagctcatgatgaagcgctggcctgaaatagatcacggacagttaactgaaatcgtcaggcaaatggtgcagaagcgaagtaactgtgggcactttttcttgg

SEQ ID NO: 2352 - DNA, 421 bp, Zea mays
  Clone ID: LIB3227-042-P1-K1-G1
ccgacgcaaaagtcgacgacgcgtgcgccttgctcgctcgctcgccgtctgccgtcgttctaggtttagagccaggtcaccagcgctaggagggcgcgaagtcgagtagacggtcgggcctctcccgttctccacggacggctagcgctactggaggcgacgcctggacggcgaccccgcacactcacagccacaccctccacctgtgtgactattcaagggcttaggccgagccgcccggccaatcgccgtccgccggaccgctgaggaatttttctttctcgtcaaaagttactgcattcattttacagtaatggctatggggttgattaatgctaatcctataatccatgagaaaaaagagaggcgtgccagacaggcaccagagaccacagatgaaaatgcagcagagcccatagat

SEQ ID NO: 2353 - DNA, 216 bp, Zea mays
  Clone ID: LIB3227-042-P1-K1-G10
gtaaggacatatgagtagggtttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcaatgctgtggccgatttgttcgttaatgtcaagaattgtgttacagtgcgtgt

SEQ ID NO: 2354 - DNA, 217 bp, Zea mays
  Clone ID: LIB3227-042-P1-K1-G11
gtgataaacaaatgcgtacctctgcagggctagttttctgcaaatcgcttcagggtgcaagagtgtcataaatctttatggccaacatctttcttgtatcatggaatcgtgtgtcatgtatcttccctgcaaataataactaactatatgaggagagcagcagggaaagaattttctttccaactactgagataatcactgtactggaaccattcac

SEQ ID NO: 2355 - DNA, 168 bp, Zea mays
  Clone ID: LIB3227-042-P1-K1-G12
gttacaatcacacttagtgaagcgcaacagtggtacctcttgtgttctgtgttccgcgatgttgcagttggttgcttgatcgaaagatgtttcaacctcccatctgctagctatgatacagatggtcccctgataataatgatgacatattctgtgatggatgccaca

SEQ ID NO: 2356 - DNA, 324 bp, Zea mays
  Clone ID: LIB3227-042-P1-K1-G2
gcagtcttttcggcccgaggtcttggaccgattggatgaaatgaatggatttccgccgctgacttaattggaggggaaggggaatgctggccttatgcttaaagaagtgtttgaccggcttaaggccaacgggattaatctccaagtcaccgagaagttcccagatagagttgttgaccaaaggtattaccccagctattgtgcccgacctttgcggcgtgctattatgagggttctggaggatagtctggccaaaaaaatgcttgctggtgaggtgaaagaaggggactcttccctcgttgatgtggattcaaaaggcaaggg

SEQ ID NO: 2357 - DNA, 424 bp, Zea mays
  Clone ID: LIB3227-042-P1-K1-G3
gcgacatttaagtccagagctcgtgcacattgttcgttagatcatcgtatgccggcagttgagtaatagagacgggacacgagatcttggaattctccaaaaagaagtgacggacaggcctatggcgaactacaataacggctagcgctactggaggcgacgcgtggacggtgaccccgaacactatcacccacactatgcacctgtatgacttattcaagggctataaggagagcctctccaggcaatggccgtccgacaaaccgctggataatgaggctttatagggagacgttactgtatttattttacattcatgtctatgggggtgagtaatgcttatcctataatgcatgagaaaaacgataggcgttccagacaggcactagagaccacagatgacaatgctggatagcccatagat

SEQ ID NO: 2358 - DNA, 261 bp, Zea mays
  Clone ID: LIB3227-042-P1-K1-G4
accacgcgtccgtaaaaaaaaaaaaaaaaaaagataaaaaaaataataatataaaagagaaataacgaataaaaaaatggggggcggcctcttcgagggtgtcccctttctttagcttgcctggccgttatctttctggggggggcgtttttaaaaccctaaagtttcgcccccggtgttccccaggaaaatattttttttaacggggctaaaaaaatattataggggggctgaatttaaaaccctttttcgggagaaccc

SEQ ID NO: 2359 - DNA, 419 bp, Zea mays
  Clone ID: LIB3227-042-P1-K1-G5
tcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaggctttggctttgtgaactactccgacagtgatgctgccaaggaagctatttctgcaatggatggcaaggaaattgatgggcggcaggtacgtgtcaacatggctaatgagagacctgctgggaaccgtggtggtggtggcta

SEQ ID NO: 2360 - DNA, 426 bp, Zea mays
  Clone ID: LIB3227-042-P1-K1-G6
gttgggcatatggtgtacatctccggtttgacttgtgccttgagttcaacaaatatccttgaagtctcatggcgtgaaaaggagccagggtctctgtttgttaacttaagcttgctgccagcactcctaaactcatcgtgcctgcataatttatcacccttgtcagatcttccccgttcgacaaacagaacacatatatcccatgttcggttagatggcatcgattgtgacagtttaaaggtgtcgctgttccacaacatttgcggcagtgttgtgaatgaacattcaggtgtactccagtgttcattctgtaagtgtgcctgcgaaagtgtatgtgcgcgtggctttcagctgcacttgaccatcgcagacgacagtgcggatttcttggcttggtgcgttgggcaaacggctgtcgagttcctt

SEQ ID NO: 2361 - DNA, 387 bp, Zea mays
  Clone ID: LIB3227-042-P1-K1-G7
aagagaacccttgaaattagggagtgatgctagtagaacccttacaagatcccaagtcgatgctgaattggtccgtatggcaactatgactgttgaggcggcggcggcagctgctgctcatgcagttgcagaggcagaggctatcatggcagaagctggagcagctgctagggaagccaaagcttgggaagccggggccccagcttgacaagcctttggttgaacaaccgtttttgcccttgaaaaccaaaatgctgggaaaatggtatagcttgaggtcatgaatcttaaatatgcccttttggtctttcacaccttgaattcaatttcgtagctctgtatgcaactaattggttactaaaagaacctggaatcagaagttttcac

SEQ ID NO: 2362 - DNA, 418 bp, Zea mays
  Clone ID: LIB3227-042-P1-K1-G8
cattcttgatggcttccctagaactgtcactcaagcacagaagcttgatgagatgttggcaaagcaaggtgctaatgttgacaaggtcctaaactttgcaattgatgatgctatattggaagaacggattactggccgttggatccacccacccagtggtaggacttaccatacaaaatttgcacctccaaagtctccaggagttgatgatgtaactggagagccattgattcaaaggagggatgacactgccgaggttttgaagtcaaggcttgaagccttccacaaacaaactgagcctgtgattgattattactctaagaagggcttggtggtaaatctgcctgcggagaaaccaccaaaggaagtgactgctgaggtgctgaaagccctctcatgatgaaatgcccctttgtct

SEQ ID NO: 2363 - DNA, 415 bp, Zea mays
  Clone ID: LIB3227-042-P1-K1-G9
cattcttgatggcttccctagaactgtcactcaagcacagaagcttgatgagatgttggcaaagcaaggtgctaatgttgacaaggtcctaaactttgcaattgatgatgctatattggaagaacggattactggccgttggatccacccacccagtggtaggacttaccatacaaaatttgcacctccaaagtctccaggagttgatgatgtaactggagagccattgattcaaaggagggatgacactgccgaggttttgaagtcaaggcttgaagccttccacaaacaaactgagcctgtgattgattattactctaagaagggcttggtggtaaatctgcctgcggagaaaccaccaaaggaagtgactgctgaggtgctgaaagccctctcatgatgaaatgcccctttg

SEQ ID NO: 2364 - DNA, 422 bp, Zea mays
  Clone ID: LIB3227-042-P1-K1-H10
gggacatctatgacccggccacggactcgtggtgcacccacaagaacccgttgctcacccctgacatagtgaaattcgtcgcattgggcgaggagctggtgaccattcaccgagcggcgtggcacaggatgtactttgccggcgtatacgacccgctggaacgcacctggaggggcagagggaacgagatcgctctctgctactcgagcccgacggtggtcgtggacgggacgctgtacatgctggagcagtccatgggcacgaagctgatggtgtggcgggaggacgccaaggagtgggccatgctcggcaggctctccgacaaggtcactagacccccctgcgcgctcgtggccatcggcaggaagattcatgtggtcggaagagggctgagcatggtcaccgtggatgtggacacggcg

SEQ ID NO: 2365 - DNA, 422 bp, Zea mays
  Clone ID: LIB3227-042-P1-K1-H11
gaaaaatccattgaagatgagctatgtggttgggttcggaaaccattaccccaagcatgttcaccaccggggcgcctcgatccctaagaacggtgttcactatggatgcaaaggagggtggaagtggagggacaccaagaagccaaaccccaatatcatagtaggggccatggttgctggccccgatcgccatgacgggttcaaagatgtccgcaagaattataactacactgaagcaacgctggcgggcaatgctggtctagtcgcagcgttggtagctttgtcgggtgaaggccatggggtggacaagaacaccatgttctctgcagtgccacccatgttcccttcgcctccgccgccaccagccccatggaaaccgtaatgcctgtgggtgtctgattcttctgtatactgcgtattta

SEQ ID NO: 2366 - DNA, 315 bp, Zea mays
  Clone ID: LIB3227-042-P1-K1-H12
gcggcccctgcacgctgttggctacggcacagtggttctcccggcaccatctagattccatctcctgaagacatggcttccttatatccaaacgacaaaacgttcgctggatggaaatagcaagggcgaaatgtctctgcagatggattcagacatgtggcagaatgtggagagcgcaatagtctcgatggtgctagcgctgccgtctgatgaccaggccgatatcctgtcggagtggatgaagaacgcagagcagttcaagtatcctgatctcaccgaggcattcgaggtgtggtgctatcgcagcaaaacaac

SEQ ID NO: 2367 - DNA, 412 bp, Zea mays
  Clone ID: LIB3227-042-P1-K1-H2
ggatggtcattttcatacccatagccatttgctcgtggtttccattcatatccactttccagacgcgacttctgttcaaccaggcgttcagcagaggtttggagatatctctgatccttgctggcaacaatccaaatgctgggatctgatggtggcagttccggccttgcttcattaatctgtggacctttcgtacttgaattaatcctcacttctcagttaacagtagcgatgtacatatctgatatctctatgttcaccggagttgtttgccgtgggtataaatatcaacggctatatttctagagtttactggcttgtacctgtattttttaacgggtgaactttgtatggcccttcttttgacattgacatatgtgctgattacgtggaaaatttgcttttttaggtc

SEQ ID NO: 2368 - DNA, 377 bp, Zea mays
  Clone ID: LIB3227-042-P1-K1-H3
aaaaaaaaaaaaaaaatacaaaaaaaaaaaaaaaaaaaaaaaggcattaaaaaagggcggtccatacgcaacttaattttcaactcagcaaatcaaaaaaagtgggcgacatttctataattccttactctcaacaactcaaatgctgggatcttatgttttcaatttccggccttacttcattaatctgtgaacctttcttacttgaattaatccttactattcatttaacagtaacgattaacatatctgatatctttatgttcaccgaatttgttttccttgagtataaatatcaacgcctatatttttaaatttactgcctttgcctgtatttttaacggtgaacttttattgccctttttttaattacatat

SEQ ID NO: 2369 - DNA, 309 bp, Zea mays
  Clone ID: LIB3227-042-P1-K1-H6
gcggcccctgcacgctgttgtctacggcacagtgcttcaacaagaactgctcaaccggtttcaagataatgcttggtaagcttctgccgaagctcgttactgccttctgtgaggccggtatcaccagcgacccgtaaaaccagcgcaagcctgctctctgctgcatcagcaatggaattgggacccttctttatattgcgcgtgtatattcgatgcttgtgtattccaaataaaatggcgcctggtttgtgtgttacttgtgcctgtcttgtaaatgtgaaacagtatatacagatgattgctgaactg

SEQ ID NO: 2370 - DNA, 418 bp, Zea mays
  Clone ID: LIB3227-042-P1-K1-H7
gagtgggccaagggcgacaaccagagctggaagatcctgccctggggcgacgaggcctacgccgcgggaggcagcagcgccgccaacgcgccccgcttcggcggcggcggcgagcccaccgtccgcatctactgcaaggccgacgaggggttcagcgccacggtccgcaacggcgccgtgtgcctcgcgcccaccaacccgcgcgacgagtaccagcactggatcaaggacatgcgccacagcaacagcgtcaaggacgaggaagggtacccggccttcgcgctcgtcaacagggtcaccggcgaggccatcaagcactcccagggcgagggccacccggtcaagctggtgccctacaaccccggctaccaggactagtcggtgctgtggacggagagccgcgacgtcggccacggct

SEQ ID NO: 2371 - DNA, 366 bp, Zea mays
  Clone ID: LIB3227-042-P1-K1-H8
aaaaaaaaaaaaaaaaaaaaaaaaaaaaaaaaaaaaaaaaaaaaaaaggaaaaaaagatataaaaaacaagaaaaaaaaaaaaataaaataaaaaataaaaaaagggggggtcgttttacgtgatcgtggttttcttccgcgtggtttgggaaaatcctttttttttagggcttgttatttttaattttttggccctttttttacattggcgtttttggaaaaacctttgtttccgcccagtttattccctttggggccattccccttttggcctgttggacttatctttggggggccctttctgttggccttttcaaagagttgccccgtttgattggctattgttaggcccctttattgggccc

SEQ ID NO: 2372 - DNA, 81 bp, Zea mays
  Clone ID: LIB3227-042-P1-K1-H9
aaaaaaaaaaaaaaaaaaaaaaaaaaaaaaaaaaaaaaaaaaaaaaaaaaaaaaaaaaaaaaaaaaaaaaaaaaaaattaa

SEQ ID NO: 2373 - DNA, 202 bp, Zea mays
  Clone ID: LIB3227-043-P1-K1-A1
gaacctgcgatgcgattagctgcgcgagactgcaacctgttgaatctaatgttcttactattgctgctgtcgatgattttatagatgtacaggcagagttgaatataaagccggctgaggcataacctggttactctcgtgtttgtactatgttccgactcgaacaggattgactcaagtctaatgtattgggcatggacag

SEQ ID NO: 2374 - DNA, 231 bp, Zea mays
  Clone ID: LIB3227-043-P1-K1-A11
cctgcttaaacctaacatggtcacccttggagcagatcacatggagaaggcttctacataagccattgcaataaacacgctaacagtgctcacacggagagttccttccactgatactgggattatgttactttctggttgacactcctaggtggaggagacctatgaactttatgcaatgaaccataatctttactcacggcatgtgactgtcttctatgcccggactat

SEQ ID NO: 2375 - DNA, 403 bp, Zea mays
  Clone ID: LIB3227-043-P1-K1-A12
ctcctgcatctctgttctgaagaggtacagcgaaggcgacatggcggcgtacaagatgttttcacgggcaaagctggatgatggtttgctggatcagatcttcagggctcggatagagacgatccggatcaactgggctgcttacccgcactaccaagccccagaggagtttgctccgatagtgttggacgggaagcagctgtactacgtgaacacctttgagagcgccgcgagcgccatagagacgggtgctgtagcagcagagaacgtggcgcggctcatcatctccaggctctctctactaccgcaggcacagcagcagcagcctcatatcatcaagtcattcgccgaacaagaatcccagcgtcgccatgtagacctgtgaaatgttgtaatggcattg

SEQ ID NO: 2376 - DNA, 400 bp, Zea mays
  Clone ID: LIB3227-043-P1-K1-A2
gactggtcttcgcgttgagttcgaccggaaagggaaatttcgtggatggaagaaattctattgcttctcaccttcaacatctgaaaactactctccgcaggaagcaagggacccagctggtgttacccagttgcgaccactgaacaacttaccaccagcagcgttatatgatagcttgctcctgatgcttatctagctccacctgcctgtaaattagtttggctaataaaatagatactgtggagcttgactcgaggtacaccatatacaacaatattcgttagtggttatacgtattgtaataggcatacttgtgatgccgattttttatgggttattgtacaaccatttcctatatttgttttaactcaaaaataaaaaaattgggaggccgttttag

SEQ ID NO: 2377 - DNA, 72 bp, Zea mays
  Clone ID: LIB3227-043-P1-K1-A3
tctagacgatccaagcttacgtgcgccagcatcgcgccgaagcagttctttatggtgctatccaaaagcaat

SEQ ID NO: 2378 - DNA, 404 bp, Zea mays
  Clone ID: LIB3227-043-P1-K1-A4
gaactggatcacacaccgactgtaaaaaccgatgccgccgccgcattcttggcttctcttgaggatccaaagctcacaagcttgggggaaactgagaaaaagcctcccattgaaatacttcctcctgggatgcctcccctatctgcacctccgatcgtgattaaaaaggctggagcaaaacctggtctccctaatgcagcaaaggcgtcaaatgggcctataggtgctcctatggctcaaggtgctcccatggctcatggtactcctgggggcacaaggggtccccatgaatcaagttcctccatcacagggcagtcatgacgaggcaaggccatcagatgctacagtggctgatgcagctgccacggttgcagaaggtacagcagctcccccggctgcagaag

SEQ ID NO: 2379 - DNA, 225 bp, Zea mays
  Clone ID: LIB3227-043-P1-K1-A5
gaactgtagcacacaccgactgtaaaaaccgatgccgtcgccgcattcttgactcgtatagaggatccaaaggtgacaagctacgcgaaaacagaaaaaaacccttgcaaggaaatacaagactctggtatgcgcaaggtatgcggacctatgatgagagataaaaaggctgtagtcaaggccggtcttcataatgcagcaaaggcgatcaaatgggattataag

SEQ ID NO: 2380 - DNA, 400 bp, Zea mays
  Clone ID: LIB3227-043-P1-K1-A9
atcgcccgcgcgtgcggatgaatatgcaacataacatgctctagcatgcggaccttatgtcttgcttagacaaggatgcagattcagcacattaaaaccagccaaacgacaatgctgctattgaagccgaggacatcctatacagagactacgtgcacatcatcgtcgttgttggcactgtcaaggtccttaagagtcctgtaatgctagatgttgataccatgaactcagctgacatggagaaagggatacacaaccttgcaaagaaagcaactgagggggcgctctgaattgacgacatgggacgaggaacattcaccatgtccaacggtggtgtctatggaagccttctatcacacctatcatcaaccctccacagtcgcctattctggggatgcat

SEQ ID NO: 2381 - DNA, 248 bp, Zea mays
  Clone ID: LIB3227-043-P1-K1-B1
gcacaacgtgcacgattctcctcctccgtccgcgtagctctcggtttcggcgatgtcggtgcgcgttaagggcgtcaaggggctgtgcaagggcggcgccaagcgccaccgtaaggtgctgcgctacaacatccagtgcatcacgaagacttctatcctttgctgtaccagtaggggcggtgtcaagcgcatttttgtgctcatctacgaggagacccgcgttttgcttaatatctttttcaatatct

SEQ ID NO: 2382 - DNA, 400 bp, Zea mays
  Clone ID: LIB3227-043-P1-K1-B10
ccaggagcgagcagccaaggaaacgagtcaagcaatggagaaggccgtcgacaggcagcgggtcctgctgcggcacctcaaccccgccgcggcggggagccccgccccgcccgccatctccgcaagcgcgtgcgcggcgggggacagcgcggcgtaccaccggaggccggccttcgccgacgacgtcgtcatcgtcgctgcttacaggacggcaatctgcaaggccaagagagggggtttcaaggatacctttgctgaggacctcttggttcctgtcttcaaggctttggtagacaagacgaagctggacccaagtgaagttggcgacattgttgttggtactgtcttagctcctggttcccagagggcaatcgaatgcagaatggctgcactgtatgct

SEQ ID NO: 2383 - DNA, 283 bp, Zea mays
  Clone ID: LIB3227-043-P1-K1-B11
gagaggagcagcagacagaagaaggggaggcgcaacggtgtacacgcacgtacggtagacagaagagagatggcgatgcagctggcggcggcggcggcagtggcgctggtcgcggatatgggcgtgctggcgccccgagcggcagagcacacgctcaactgcgcggagaagcttatcccatgatctccgtatatgaacacgatagagaacccgacggatacctgctgcagaccgttcaaggacgctgcccagaacgaccgtcagtgcctttgctacctttacg

SEQ ID NO: 2384 - DNA, 132 bp, Zea mays
  Clone ID: LIB3227-043-P1-K1-B12
ccaggagcgagcagccaaggaaacgagtcaagcaatggagaaggccgacgacaggcagtggttcctgttgcggcacctcaaccccgccgtggctgtgagccccgtcccgccctacatctccgtaagcgcgtg

SEQ ID NO: 2385 - DNA, 402 bp, Zea mays
  Clone ID: LIB3227-043-P1-K1-B4
ggcagtggagaactcccccttccttgagaagctgaagaagaggggctatgaggttctgtacatggttgatgccattgacgagtatgctgttggtcagctcaaggagtttgagggcaagaagcttgtctctgccaccaaggagggtctgaagcttgatgagactgaggacgagaagaagaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaggccctgagggactcgagcatggcgggctacatgtcgagcaaaaagacaat

SEQ ID NO: 2386 - DNA, 253 bp, Zea mays
  Clone ID: LIB3227-043-P1-K1-B5
gttcattttctttttaaaaaatagaaattccttagaaaaatataggtaccaaaccggcactaattgcattattttctcaactcattttccttctggcacgtgcactggggaattgcatttctaccttggatcgaggcgcctggtaacaaaagaacaatggccacttccgctggaaaaaaaaaaaaaaaaaaaaaaaaaaaaaaaaaaaaaaaaaaaaaaaaataaaaaaaaaaaaaaaaaatatttaataatt

SEQ ID NO: 2387 - DNA, 92 bp, Zea mays
  unsure (1)..(92): unsure at all n locations; Clone ID: LIB3227-043-P1-K1-B6
aaaaaaaaaaaaaaaaaaanaaaaaaaanaaaaaagaaaaaaaanaaaaaanaaaaaaaaaaggggggaagaaaaaaaagaaaaaaaacaaa

SEQ ID NO: 2388 - DNA, 268 bp, Zea mays
  Clone ID: LIB3227-043-P1-K1-B7
ggctatgcagctccagagtacgtagcaaccggccatttgtacgtgaagagcgacgtgtacggcttcggcgtggtgatgctggagatgctgaccgggcagcgcgcgctggacccgaaccggccgaacgggcagctgagcctggccgactgggcgaagccgttcctggccgaccgacggaggctggcccggctcatggacccgcggttcgaggggcagtacaactcgaatcaggcgtttcaggcagtacagctgactgctcaactgtctg

SEQ ID NO: 2389 - DNA, 404 bp, Zea mays
  Clone ID: LIB3227-043-P1-K1-B8
tccgacaaagcaaaagctttggacgagaagcaccagctcacgtcaactgccacagctagagtgtcttcctttgacaagagaataggcctaagtgagaagatcagtgttggcacttcagttgtaaatgataaagtgaaggaaatggatcagaaataccaagtctctgagaagacaaagtcagcgctggcagctgctgaacagagtgtctcgaccgctggatctgctatcatgaagaacaggtatgttctcaccggagcagcatgggtaaccggtgctttcagcaaggtcaccagtgctgccaacgatgttggtgcaaaggctgaggagaaaatagcagtcgagcaggaggacaagaatgccgagggtgggcctggacaagcaaacatctcagatatccctgcagc

SEQ ID NO: 2390 - DNA, 270 bp, Zea mays
  Clone ID: LIB3227-043-P1-K1-B9
gacagagcaaaagctttggacgagaagcaccagctcacgtcaactgccacagctagagtgtcttcctttgacaagagaataggcctaagtgagaagatcagtgttggcacttcagttgtaaatgataaagcgaaggaaatggatcataaataccaagtctctgagaagacaaagtcagcgctgacagctgctgaacagagtgtctcgaccgctgaatctgctatcatgaataacaggtatgttctcaccggagcagcatgggttaccggt

SEQ ID NO: 2391 - DNA, 374 bp, Zea mays
  Clone ID: LIB3227-043-P1-K1-C10
cagcagcaggcctgctgcagtggaaaatgacaatcagcatgaggctagggccatggctcaacatgggaatgggaatgctacttcagtcgagaggttattgcctaagctttcacgtgcagattacttcacagagcctagtatagaggagcttgcggacaaagaacgtgcggaggcaggctactgcggtcgagtgagggactttgttgtggggcgacatggctaccgcagcatcatttttctcggggagacggacgtgaggtgcctggatctggagtcaatagtggagtttaacaaccgtgaggtggttgtttacaaggacgacatcaagaagccccctgtgggtgaggggctgaacatggctgcaggggtgactc

SEQ ID NO: 2392 - DNA, 129 bp, Zea mays
  Clone ID: LIB3227-043-P1-K1-C11
caacattcacgtctactgcagagtataacttttacaagaacgaggttagggacattaagaatcatttaaatataaaagatactatagtagagaggatattaggagaaactttaacgtgcggatcaattc

SEQ ID NO: 2393 - DNA, 346 bp, Zea mays
  Clone ID: LIB3227-043-P1-K1-C12
aaaaatgtggaggacttcataccaaaagcaattatgcatttcctggttaatcacacaaaaagggcactgcataattacctcataacaaaactttatagagatgatcttttggaagacttgctcaaagaacctgatgagctaaccataaagaggaagcagatacgtgaaaatcttaaggtccttcaacaagcttacaaaactttggatgagataccacttgacgcaaaggcagtaaaaaggggtggtggatacttccttgattcttatgccattggtctaccaagggcccatgggctttcttcattccttcacggattcaatgatggaagcttattatattcaaacc

SEQ ID NO: 2394 - DNA, 179 bp, Zea mays
  Clone ID: LIB3227-043-P1-K1-C2
tggagccgttcgtgatcgccaccaaccggcagctcagcgtgacgcaccccgtgcacaggctgctgctgccgcactaccgcgacaccatgaacatcaacgccctcgcgcgccagaagctcatcaacgccggcggcatcttcgagatgaccgtcttcccgcgcaagtacgccatcgagatc

SEQ ID NO: 2395 - DNA, 314 bp, Zea mays
  Clone ID: LIB3227-043-P1-K1-C3
ctccggaagtgaatctacggacatgacaagggcttaaaagcacgtgctccccaccgagacaagatactgtccgatgctctcgtcatggccgacaataatcccgaagtgaacaaggctctactgaacaaaggttacagtaatcttatgacccaaatgggccgcaggacatatattccattcaaggtctaaggatatgctacccttcacgtcgaccattacacattttcacacaacatcattgaccatatgataacagcttcctttactatcagccattccaattcgcggttcttaaactgatactaaagctttaa

SEQ ID NO: 2396 - DNA, 73 bp, Zea mays
  Clone ID: LIB3227-043-P1-K1-C5
gtgatttcatgttcgattcggtgtataattaatatttttcaatgtacataatgcaaactttagaactttattt

SEQ ID NO: 2397 - DNA, 232 bp, Zea mays
  Clone ID: LIB3227-043-P1-K1-C6
gtgatttcatgctcgatgccatgtgtaattaatatttctcaatgtacataatgcagacagtagaacggtattgataaaaaatgcaaaaagggcctttattgtaaaggatccaagcatacttacgcatacgtacaaggtgatagttcttctatggggtcacctaaacccaatgcactggccggtgttttacaaggtctttactgtttaaaaccctttacgtcacttaacttaa

SEQ ID NO: 2398 - DNA, 103 bp, Zea mays
  Clone ID: LIB3227-043-P1-K1-C8
gggctattgtgcgtacaacgaccagcagcagtttgtactgatctaacctggctgaacgaaggtgtactagtttgattttctatgcgcagctctgttgaccagc

SEQ ID NO: 2399 - DNA, 168 bp, Zea mays
  Clone ID: LIB3227-043-P1-K1-D11
ggaaagccattcttttcattcttgagttcctttttaggaaacggagcttttaaaatttgtatagaatgcatattttgacattaaaattattatttgattgttttctacacacagcagttccagctgatgttttacataaaatattacaaataaaaaataataataaaa

SEQ ID NO: 2400 - DNA, 180 bp, Zea mays
  Clone ID: LIB3227-043-P1-K1-D3
acgccgtacccgtaaaaatggtaatcgaccttgccgccggggggaggattaagaagaccaagcacactgcgcccaagtctgacgatgtctactctcaagctccttgttaaagctctaccgattcttgatcaggaggacctagagcaatttctaaaatgttattctctagaggcttttcat

SEQ ID NO: 2401 - DNA, 265 bp, Zea mays
  Clone ID: LIB3227-043-P1-K1-D4
ccccctcgtacttctagtctcctcctggacagcaaagcacagtacaacacactgtgaaagaacaagcagccttcactggtgctcaataccaccatcagctgcagctgtacacccggacaacctgtctcacacacccgctcacacacatcatgatgggggaacatgctccatttaagttgtagtggccgttaaggagctttccaacgtttgcttcgaggaccacctggcgctgatggcgaatcgattgggtgaggactttctgact

SEQ ID NO: 2402 - DNA, 388 bp, Zea mays
  Clone ID: LIB3227-043-P1-K1-D5
ctcgtcctacaaatgaggagccagcacgtccatccgtgaagcagcaagagagcctacctgacgacgacttcataaacccaactgctcttcctggtttctcgtcgtcttcagctactaaggagtctggcgaggaccttccgaaggctccatgggaagcacaagctgccgcaggttccctaccgccgcctccggcgaggtatggtcagagacagcagtacttctagcagaacgtgtattctggcgggagcaacgaaggcgggtacaatggactgacgacacagaccgaaggcctctcgctgaacccgcggagcagcgagtacgagaggagcacggtacggccgtcagcgtcccgccctgccaaacctgaggactcgctctttaaggacct

SEQ ID NO: 2403 - DNA, 347 bp, Zea mays
  Clone ID: LIB3227-043-P1-K1-D7
gatgaaaacactagatcaaactcaatgtgtggtgctgttgaatacatggccccagaaattgtttacggccgaggtcatgataaggctgcagactggtggagtgtgggagtccttctttttgaaatgcttacaggaaagccaccgtttgttggtggaaacagagacaagattcaacagaagatagtaaaggagaagataaagctgccaacatatttatctagtgaagttcactcaatgtttgaaaggattattgcacatagaagcttgcagacggttgggaagcggaccaggcggctgtgacgaaatcaagaaccacaaggggttcaagtctgtaaactggaagaggc

SEQ ID NO: 2404 - DNA, 162 bp, Zea mays
  Clone ID: LIB3227-043-P1-K1-D8
tcggtcgatcttcgagtacaacgggagcgccgtggtggcgatggaggggaagaactgcttctcgatcgccagtgaccgccgcctaagcgtgcagttgcagacgatcgccaccgactttcgacgggtgttcaaggtcctatgacaagctctacatctggctca

SEQ ID NO: 2405 - DNA, 309 bp, Zea mays
  Clone ID: LIB3227-043-P1-K1-D9
gaccttgtcaacattcactcctgatgggcagcatatagttagcgcaaggggagacttctatatttatttatggaaccatgaaaacctagatgaggcttaactgaaacaagctaaaaccatatggtcctcatagcgcttctactccaacaatgcatacatcgcaatacacctggaatgtctagtgacccataaacactttctatgtgtactctcataatctgacatcacaatgagataacttgaggtgcatgagtaaagctgagatatgcagtttaagacagttctaaaattctgctattaacatgtttt

SEQ ID NO: 2406 - DNA, 404 bp, Zea mays
  Clone ID: LIB3227-043-P1-K1-E1
atagccttgaggttggtgcaaatggcaggaagatgatatgggagggaactccccgcagcatccgggacagccaccggaaggttagggacagccatgatggtctaataattcagcgcaacatggctctcttcttctcaggtggagaaaggaaagagctgaaactgcgagtcacaggccgtatctggaaggagcagcagaatcctgactcaggagcctgcattcccaatttgttcagctgagctcagtaacaagaggatggatccaggtgtatattgatacggccgatgtgtttgtgtgagcgtgtgcctgtgctttgcgttttgtcctgccaagctgccattgcagcccgtcctaaattagtcagggcgtatttactgttggcaggataatgaaaatactggctt

SEQ ID NO: 2407 - DNA, 389 bp, Zea mays
  Clone ID: LIB3227-043-P1-K1-E10
atgaagaccattctttttaccaatctttgtacgcatttcaggtcgaggaaaactgggacttgtgatatcttctcgacatacttatatgctctggtatcatagttgttgactggcatgtcatctgcaagtcatggtacttgcctggttaccctgttggccctgatgtatttgataggcttgaaaggaaatacaatgaatttgcaacatgggcaaagcctgagaggaggcttctttctgacctcgcgaattcaattctttccgaggtccttgcaccatgtgttgatgtgcacccatgggtgcagcctattagacactgtgtggcattttggggcccagaagggcctgttgagaaggttgggcagtcatttgttaggctgcacgaagactgt

SEQ ID NO: 2408 - DNA, 326 bp, Zea mays
  Clone ID: LIB3227-043-P1-K1-E11
atgaagaccatactttttaccaatctttttacgcattacaggccgaggaaaactgggacttttcatatcttctagacatacttatatgctctggtttcatagttagtagacttggtagctcatttgtcggtcatgtaactagcctggttaccctggtggtcttgatgtatttgatagggtagaaaggaaatactataaaatcgtaacatggtcttatgctgaaaggaggtttgtttctgacctaatgaatttaattttttcctaggtccttgctccatggggtgcagtgcactcttgtgtgcagcctatttgacactgtttgtttt

SEQ ID NO: 2409 - DNA, 85 bp, Zea mays
  Clone ID: LIB3227-043-P1-K1-E12
cacaaaaccattcatatcaccaatctttgtaagaaacaaagcacgcttaagaacacgatttgtcatatcttctaaacataattat

SEQ ID NO: 2410 - DNA, 160 bp, Zea mays
  Clone ID: LIB3227-043-P1-K1-E2
cccacgcgtccgaagagatcatgtggtttaatttgctgcatcttcattatgttgcaaccattcgagggtgggtagttcatatgattcgtcgatgtcaccccacgaaaatttactgctgcgccatatgaatacctgccttatcacggtgtttgaacataat

SEQ ID NO: 2411 - DNA, 240 bp, Zea mays
  Clone ID: LIB3227-043-P1-K1-E6
aaaaaaaaaaaaacaaaaaaaaaaaaaaaaaaaaaaaaaaaaaaaaaaaaaaaaaaaaaaaaaacaaaaaaaaaaagaaaaaaaaaaaaaaaaaaaaaaaaaaaaaaaaaaaaaaaaaaaaaaaaaaaaaaaaaaaaaaagaaaaaaaaaaaaaaaacaaaaacaaaaaaaaaaaaaaaaaaaaaaaaaaaaaaaaaaaaaaaaaaaaaaaaaaaacaaaaaaaaaaaaaaaaaaaaaaa

SEQ ID NO: 2412 - DNA, 156 bp, Zea mays
  Clone ID: LIB3227-043-P1-K1-E8
cagagccaccagctcgtgtgggcgcgcgcgcaccacctcgtctacgactactgcggggacaccgaccgttttcccgtgcagtcatccgagtgcgccggccgctgagctcctgaccgacctacttagatccttgcatggaatgacaatggatctcgt

SEQ ID NO: 2413 - DNA, 231 bp, Zea mays
  Clone ID: LIB3227-043-P1-K1-E9
ctcatctgtcaacaatgaaatcaaagttgttcaaaaagcttcgagaggtactgggccttactaggagggttgccagcacgcagaatggtggattcttcttagtggacgtggtggccattgctctcctgggaatgctactgggatatatcatgaagagatagattgggctcataatgacttgtccttatgttagaccgatttcctaacagttttgaatattagtctaatgca

SEQ ID NO: 2414 - DNA, 385 bp, Zea mays
  unsure (1)..(385): unsure at all n locations; Clone ID: LIB3227-043-P1-K1-F1
acccacgcgtccgggcttgagaagtctgccacctatgatgagatcatggctgcggtcaaggccgaggcagagggtagcctcaagggcattctgggttatgtcgaggaggaccttgtttccaccgatttccagggtgacagcaggtctagcatctttgatgcgaaggctggcattgccttgaacggcaactttgtgaagcttgtgttctggtacgacaacgagtggggatacagcacccgagtggtcgacctgatccgccacatgaacagcaccaagtaaatgaacaaactgatgaaagcatgcaaagagtgatgaaagcatgcaaagagaggtgtgtttcttncccggaagtgctttcgagaaataattttttttatttgattgg

SEQ ID NO: 2415 - DNA, 229 bp, Zea mays
  Clone ID: LIB3227-043-P1-K1-F10
gtcttggctttgtcgaacagtaatgttttttaggcagaattgtaagagcgtggtgtaggcacggtatttaatacgcacacgccattacttaataagtgttgcaaaatcatcacaggggctacccaagtgactttgattactgtaatactgcctaatttttaaaaaacactaagttctttcaaagctttacaacaacgcaggccaatttgttggcccttaaacccttctg

SEQ ID NO: 2416 - DNA, 167 bp, Zea mays
  Clone ID: LIB3227-043-P1-K1-F11
gacttggctctgtcatacactattgttgtcttgcaagtattgcaagagcgtggtgaaagacgtagtgtcatggacgtgccacattttctgtgttattgatccacgatcttgacttgggtggtccatgggtttttaatatctctgatatcacctaattcttaaaaagg

SEQ ID NO: 2417 - DNA, 117 bp, Zea mays
  Clone ID: LIB3227-043-P1-K1-F2
acgaccctcctaagtggatccattccactggtgccggccgaggcatacaggtccagatcaggtacctgctgttagctgtcgaccgtatctatgccaacgcctactctagccgttgta

SEQ ID NO: 2418 - DNA, 280 bp, Zea mays
  unsure (1)..(280): unsure at all n locations; Clone ID: LIB3227-043-P1-K1-F3
cagaanaaaagaacggcagaggacgccccagccaagaagccaccccagccatcggaaaagggcgggccacacaaacaagaggcgaagaggaaggagaagaggagagcagacatgtcattcggcggatacgacacagaacagggatccctatttgctgcgacggcaggcaacatatgctacagcatggaagttaaggactcggttctgccgacatgggtggtctcttggctgtgcgccgacatgagctaggacgcgaccatcttagatctgacaatcgtca

SEQ ID NO: 2419 - DNA, 118 bp, Zea mays
  Clone ID: LIB3227-043-P1-K1-F4
aagcaagtatgttatattaggagaaaaatatctggtcctagataaaagatctgttcttagatgatgttttatgccgatgatgccattagagactagcttcgtctgtttgtttgttaca

SEQ ID NO: 2420 - DNA, 398 bp, Zea mays
  Clone ID: LIB3227-043-P1-K1-F7
agctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgtaagtacatctatggtggccatgttgttgactacatgaggaacctcgctgaagaggagccagagaagtaccagtctcacttcattgagtacattaagaagggaattgaggctgatgacatggaagcttctgtacaagaaggtccatgctgccatccgtgctgatccttttgtggttaagttaaccaatcagccaccaaaggagcacatgatgtac

SEQ ID NO: 2421 - DNA, 325 bp, Zea mays
  Clone ID: LIB3227-043-P1-K1-F8
atttctgtttcttgcaacatcatgatgtattcatatattaaacatggattgcttgaatactcgaaatacctgctccatgatattttgaattgcatgattaggattaaagcggtttctaatcaagtggcaaccgctgacatgtttactttcaatactttcatggatgcctgtgctgcagcaaaaaggaggaatgacttcgattatgcgttttttgagatgttatagactgggttccaatatcttttagcgaagtactccttcttattggtactttgactcttttaggcatgtgtaaggaactgctgttgtatgatctatggcacta

SEQ ID NO: 2422 - DNA, 401 bp, Zea mays
  Clone ID: LIB3227-043-P1-K1-F9
gtcccccagcacgggagttaattgtatcaagagaagtggagaccaagggcagagtagaactacagaggatatctttgtatatggaggctacatgtgaacaagaaaggagaggaggaagactgtatagatctgaagaacctaaggagaaacaatcagagtacttgctggaacacatatatattccatgataaatgttagatttcttgtttggtgctaatgcatgggttccatatgttcttcccgtcttattagaacatatttattggactaccatgcattaaaagccgtcgatttataaactattgtgactatacggcaccaaagaagctattgatgctggtcggctagctgacagcgaggtgaaagcttttctaaacgatatttctgagtggaagagaaaa

SEQ ID NO: 2423 - DNA, 266 bp, Zea mays
  Clone ID: LIB3227-043-P1-K1-G1
cgaggaatctactgcattgctcaaagatgcagggcagccacaagcaaatgtggttcctattccaatcccggggggtggcgttgggttctgttccgaagaaaaacatgtgggtgcctgctccgagagcaaacgggatgacacacatgctggagccatcagaacggctgatctgatggccttagaagtcgctgggagctgggcagtggaaacagctccatctgtcaatggtgagaactaatctccaaggagcttgtgcgatgctacat

SEQ ID NO: 2424 - DNA, 392 bp, Zea mays
  Clone ID: LIB3227-043-P1-K1-G10
gttgggcatatggtgtacatctccggtttgacttgtgccttgagttcaacaaatatccttgaagtctcatggcgtgaaaaggagccagggtctctgtttgttaacttaagcttgctgccagcactcctaaactcatcgtgcctgcataatttatcacccttgtcagatcttccccgttcgacaaacagaacacatatatcccatgttcggttagatggcatcgattgtgacagtttaaaggtgtcgctgttccacaacatttgcggcagtgttgtgaatgaacattcaggtgtactccagtgttcattctgtaagtgtgcctgcgaaagtgtatgtgcccgtggctttcagctgcacttgaccatcgcagacgacagtgcggatttcttggc

SEQ ID NO: 2425 - DNA, 237 bp, Zea mays
  Clone ID: LIB3227-043-P1-K1-G11
gatgggcatatggtgttcattttttttttgacttgtgcctcgagttcaacggatgtcctcgaagtctcatgtcgtgaaaaggatccagggtctatgactgttaactttaagctcgcttccagcactcctaaacatcatcttgcctgcatagtatatcacccttttcagatcttcctcgttcgacaaactatacacatatatcctatgttctgctagatatgcatctattgtgccagt

SEQ ID NO: 2426 - DNA, 396 bp, Zea mays
  Clone ID: LIB3227-043-P1-K1-G12
ccggcaagcagctggaggatggccgcaccctggcggactacaacatccagaaggagagcacccttcacctggtgctccgcctcaggggtggcatgcatatttttgtgaagacattgactggcaagaccattaccttggaggtggagagctctgacaccattgacaatgtgaaggccaagatccaggacaaggagggcattcccccagaccagcagcgtctgatctttgctggcaagcagctggaggatggtcgcaccctttcggactacaacatccagaaggagagtacccttcaccttgttctccgccttaagggtggtatgccaaatctttgttatgacccttactggtaaaaccataaccctggaggttgagagctcggacaccatctacaat

SEQ ID NO: 2427 - DNA, 266 bp, Zea mays
  Clone ID: LIB3227-043-P1-K1-G2
acgcaaaccatatatgctaccacagtttcctagatttttctccatcggacgctgggttaattggtgctgtaaaatgctgagcagggcgcggcaactacatgctatttggtactccacccgcatgtgaagggcgagtccgtgaagtacttttgcgactgttacctgtacgagccaagcgcgaacaccaaggacatgtattttgccatgaggcattgggacttttgtgtctagcttaatcacctatcttatgccttattgatgttagc

SEQ ID NO: 2428 - DNA, 149 bp, Zea mays
  Clone ID: LIB3227-043-P1-K1-G5
aaacaacatactaattgatgattcgttttttttttgggaagaacgcacacacaagacaggcggtccatttttaaaccaacactgacacgactcatgacacgatcagcagatactttgacaacctccatatgggtgagggctccagacga

SEQ ID NO: 2429 - DNA, 378 bp, Zea mays
  Clone ID: LIB3227-043-P1-K1-G7
gagagcatacatcagctcgactatgctgcggaagtctgctctgagggccgtagtcgagacgctttcaactgactcaactctttatgtgaggtagcaatattgaattgctggtcccgaacaagaatggttacatttcattgcaaaatctgtaatttgctctagcgaagaacttcactgatgcaatgaaggacttcagggatgtttattttgttaacaccgtgtgcgcttttttgtacaagaaactggatttttaagagtttgtcgtttccgacatcattgttttaccattatggaagccttgtgatacctgttttcagtacgcgaggctcccgttctatctgatctacatggtaagaaacttttcaattgtgactaaga

SEQ ID NO: 2430 - DNA, 342 bp, Zea mays
  Clone ID: LIB3227-043-P1-K1-G8
gcagatgagaaggcattctttgatgacttctaaagaggcccacctcaagctctccgaactggggtatgctgatgcttaaatggtccatatcctggagcgggacacaaactgctgcctgtatggactcgtgcgattcagggtgaaccatcagattgtctagtgtcttctttgtaataaatttatctgttcttggtactttgtctatggttgaatcggaacccattttccgtttgcctagattcttaatttctggtgctgtatccagctgaaactagtagatttatgatcttgtggctgcagcatgttcttgtcacttttaaaaaaaaatatataatatttatt

SEQ ID NO: 2431 - DNA, 99 bp, Zea mays
  Clone ID: LIB3227-043-P1-K1-G9
ctctttctctcctgcaataatggtcgctcgctcctcctcctcccagccggaggtggtcgcggaggctgtggttctgacagcggcgctgctgttgctggc

SEQ ID NO: 2432 - DNA, 402 bp, Zea mays
  Clone ID: LIB3227-043-P1-K1-H1
ggcgaggagcatggtgtatagcttcccgtgtagctcgtctgatggtttattgaacctcgacatgaaaatggctgatgacgtgcgtggttatctctcgccgctgagctttgataattgctttggcgcgtttgacgacttcactcgccctggatttgacatctctgagaaccccttctccttcccgccttcaggatcttgcagttatgggcagcagaacggtgatagctgatggatgccgccatcgatgatgactacaccgcggcactgtcaacctttatgtatgttgttgcatgatgctagtttggttcatcctctgttcaagagccattttaggctatgcctttaactttcttaagtgtaccttcgtttgtggtcattaataatgatcaaggacttctagat

SEQ ID NO: 2433 - DNA, 306 bp, Zea mays
  Clone ID: LIB3227-043-P1-K1-H10
gtcggacacgcgcacgacaaagcatacgtagcagaggacggcaacaagaactgctcaaccggtttcaagataatgcttggtaagcttctgccgaagctcgttactgccttctgtgaggccggtatcaccagcgacccgtaaaaccagcgcaagcctgctctctgctgcatcagcaatggaattggtacccttctttatattgcgcgtgtatattcgatgcttgtgtattccaaataaaatggcgcctggtttgtgtgttacttgtgcctgtcttgtaaatgtgaaacagtatatacagatgattgc

SEQ ID NO: 2434 - DNA, 222 bp, Zea mays
  Clone ID: LIB3227-043-P1-K1-H11
gtcggacacgcgcacgtcaaattatacgtagcataggacggcaacaagggctgctgaaccggtttcaagataatgcttggtaagcttctgccgaagctcgttactgccttctgtgaggccggtattaccagcttcccgttaaaccagctcatgcctgctctctgctgtatcagctatggagttgggtccctcttttatattgcgctgtttattttcgatgct

SEQ ID NO: 2435 - DNA, 398 bp, Zea mays
  Clone ID: LIB3227-043-P1-K1-H12
cgccttccgaggaaactcaccagcccaccacagacccgagcggaagaagccatgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcaccgtcatggacgtcgtctacgcgctcaagcgccagggccgcaccctctacggcttcggcggctaggctgatgggctcctcgcgatgttctccccttctgc

SEQ ID NO: 2436 - DNA, 407 bp, Zea mays
  Clone ID: LIB3227-043-P1-K1-H2
ctccctcgctctcgcagccgccactgtagaagcttcgaggctgctgctgcgcccatggccgcggaagccaagacgccgtccctcgctgaggaatattcacttccaccacaggaagttccagtggaaaaggtagctgaggagaagccctctagtggtactgagactgaatctgctccttcaaccaatgatgggactccttcatctgtagaagataagaatgaaacatctgaagtacaagatgctgctgaaaagtcagacgcagaagaaactaacactgctgcagaggaagcaagtgagactaccgaggaggaagaggctgagaaacctgagatcaagattgaaacagctccagcagattttcgtttcccaacaacaaatcaaacgaggcactgtttcacacgctatgt

SEQ ID NO: 2437 - DNA, 406 bp, Zea mays
  Clone ID: LIB3227-043-P1-K1-H3
ggcgagcgaacaagggaggcggggggcgtcggtctggcgctgcaggcgcgggcggcgggcgttggctccagccggcaccggggcggtctacaggcgcccaccgggagcctgagagtcgctgacccggcgggacctgaggacgctgtgcgggctcgcgggtccaagcccgtcgcaccgctccgactgcgtgcgaagaaatcgctcggcggtcatgaaaactcgcacaactccgttgacgaagctctcctgttgaagagagaatcagaagaagttctgttttacttgaacgggaggtgtatttacctagtgcgaatgatgggtactggaaaaagtactgtggggaagattatgtctgaagtcttgggttattcgtcgtttgatagtgacaagttagtggagcaagctg

SEQ ID NO: 2438 - DNA, 361 bp, Zea mays
  Clone ID: LIB3227-043-P1-K1-H4
gtcaatgagaaacctactgaggagaacattgacattggcggacttgagaaacaggttggagagcttgttgattcaatagtgttacctatgacacacaaggaccgatttcaaaaattgggcattcgtacccacaaaggggttcttttgtatggaccccctgcgaccggcaaaacgcttatggttcgtgcatgcgctgcacatactaatgcaacatttatgaaattggttgtttcacaacttgttcagatgttcattggtgatgtagctaagcttgttagatatgcttttcatcttgctaaggataataccccgttcatcatttttattgataaaaatgatgccattggaacaaagcgttttt

SEQ ID NO: 2439 - DNA, 400 bp, Zea mays
  Clone ID: LIB3227-043-P1-K1-H6
agacgtacgcgtacgagctgtcttgagttttcaagcatgacgacagtgttgtgattgccaatcgtgatgctgacaagcacactgacttggctgaaaaatatggagtttgtggttaccctacattgaagttcttccctaagggaaacaaagccggtgaagattatgatggtggccgggacttggatgactttgtcaagttcattaatgagaagtgtggcaccagctgggatccaaagggccacctaacttaagaggctaggctagtgccaagcttgaatcctcttgtgaaggagtttctcaatgctgatgatgacaagtggaaggaagtcctttcgaaaatagaagaggatgttgctaaactcagctgttctgcagtcaaacatgcaaagatatatgtgac

SEQ ID NO: 2440 - DNA, 249 bp, Zea mays
  Clone ID: LIB3227-043-P1-K1-H8
gccttaaaatccctgactgctgcggaaatgcagctggcagcataggagcttgctcgtagtgaactgcaatgaatggataccaagtgttgttaaacctaatgtgtgagtatgcagtaagctgaactatgataactgtaatatgaataataactgcagacaacataacacagattgaagataacaattgttgtatttgctaataagctgcattacttaaggcccaggacggatttgaaggaagccatgttt

SEQ ID NO: 2441 - DNA, 263 bp, Zea mays
  Clone ID: LIB3227-043-P1-K1-H9
cccactcggcgaccatcgcgctgtcttcgtcgcccgcgcggccggtctgcaagagggggcacgctcaggtcaagctgcaaggcgactagctgggctgcaccacgttctacgaccgcgagagcttactggcctccgacggggcgcttactctgggatacagcaacatctccttcggattacgcgccgctggtgcgctttggcagccgaatcaactactgcctggtcgaacactttctccccttggaacgccacctgatacctca

SEQ ID NO: 2442 - DNA, 366 bp, Zea mays
  Clone ID: LIB3227-042-P1-K1-C4-F3A
agtacttcgtcattgctggggctgagtgcttcggtatcatcactcagctggagttctttcgtggccattcgccagactccatgaagagcattttaacggcatttgcattgctcaccactgcccttgggaattacttgagctcagctatcatcaccctcatcgcaggggtgaccagggtatggcatagccctggttggataccagatgatctgaacaaaggacaccttgactactactactggtgtcttactaccctctcattggtgaattttgttgtgtatctgtattttgctagtaaatacaaattgaagaaagttgtttgttaatactaccaaacactaatgaaatatctttacgtgtaacatg

SEQ ID NO: 2443 - DNA, 281 bp, Zea mays
  Clone ID: LIB3227-042-P1-K1-C4-F6A
atggggaagatcattacgaaacgaccgatcccaatcctctgtaactgtgtgagctctaccccatttgttaaatacgttcggattgccggcacaagcactttgttgacagcaagtacccaaagcgtgacacatatcacttcaaatgagtataaggatgctggtggaatggacagggaaccgatcttggtgtccatcacagttccctgctgaataaaagtggtgtgcatttgcgagatcgcagcaccaaagaatattccagtcacccatattgggagcaagcg

SEQ ID NO: 2444 - DNA, 301 bp, Zea mays
  Clone ID: LIB3227-042-P1-K1-C4-R3A
gaaacaacggaggaaacggcggacagagagagccacacaccagacgcaaaaggcagccggaagggagacgcaagcactgcgggggcagcaagcacacaaagggagacacagagcagcgcaaaggagcaaaaggacgccggaaaaaaggacagcgaaccgcaacaggagaccaaacacgcacgcggagaagaaaagtggagagcaggagcgagaccgcaacaccaaccacaaacccagagaccgagaacgggagcaagcggggacaccgaggaccacacgggaaggccggaccaaagccagc

SEQ ID NO: 2445 - DNA, 346 bp, Zea mays
  Clone ID: LIB3227-042-P1-K1-C4-R6A
tgcttagcagttccccctcctgaacaatatgcagcctcttggtttctagaagtgctgccattgccatggcaaagatcatcatgaaacgaccgatcccaatcctctgtaactgtgtgagctctaccccatttgcaaaatacgttcggattgccggcacaagcactttgttgacagcaagtacccaaagcgtgacacatatcacttcaaatgagtataaggatgctggtggaatggacagggaaccgatcttggtgtccatcacagttccctgctgaataaaagtggtgtgcatttgcgagatcgcagcaccaaagaatattccagtcacccatattgggagcaagcg

SEQ ID NO: 2446 - DNA, 552 bp, Zea mays
  Clone ID: LIB3227-023-P1-F1-B6
gctaaactcggtctaagaaactgacaaaaggatggtccaaggcatcttgaagttctgctaattacaaagctgcacatacaaactgtcaccacgaaacttctatgcacacggtattcacaatatttacatgttataaactgctactgtttccaagagagctcaccagaacggacaccacccgacatagttttggcacaaattttcgtgtgaagtcgcttggagtatgagcttctgaacctgaaccttcactgagagaccaggttgggcatcccgggcatctcctgaagccaaatgctcactgccatgttggatagagctacctgctccagccaaagctgacccagaagagaagtcacgccctgttagtttgtcactcatccgtgccatcacagctacagcacgctcattcaaaacctcattggcatcaccgagttgattgacagcctgtagaagttccctctcacgtgctcctcgctgaggttgcatgaactctcggttagccactgcttcttcactactgacaaccgtgtgagcatgaacattaccatagtt

SEQ ID NO: 2447 - DNA, 620 bp, Zea mays
  Clone ID: LIB3227-023-P1-F2-B6
ggctaaactcgggctaagaaactgacaaaaggatggtccaaggcatcttgaagttctgctaattacaaagctgcacatacaaactgtcaccacgaaacttctatgcacacggtattcacaatatttacatgttataaactgctactgtttccaagagagctcaccaaaacggacaccacccgacatagttttggcacaaattttcgtgtgaagtcgcttggagtatgagcttctgaacctgaaccttcactgagagaccaggttgggcatcccgggcatctgctgaagccaaaagctcactgccatgttggatagagctacctgctccagccaaagctgacccagaagagaagtcacgccctgttagtttgtcactcatccgtgccatcacagctacagcacgctcattcaaaacctcattggcattaccaagttgattgacagcctgtagaagttccctcttacgtgctcctcgatgaggttgcatgaactatcggttagccactgattcttcactactgacaaccgtgtgagcatgaacattaccatatttcgacacttggagaacctcattgaaattgaacagacgccaattgattaacgggtcatgtacaaaagcc

SEQ ID NO: 2448 - DNA, 711 bp, Zea mays
  Clone ID: LIB3227-023-P1-F3A-B6
atggttgggtattagctaggtttaagagatcggcatccaagcaaccttatgttagatcgctatagtggaaaaatattacacatcgacttcggagattgctttgaggcttcaatgaatcgagaaaagttccctgaaaaagtaccattccgtttgactcgaatgcttgtgaaagctatggaagttagcggtattgagggtacattccgaacaacttgtgaaaatgtgatgcaagtccttcgcacaaacagagacagcgttatggccatgatggaggcatttgtacatgacccgttaatcaattggcgtctgttcaatttcaatgaggttcctcaagtgtcgaactatggtaatgttcatgctcacacggttgtcagtagtgaagaagcagtggctaaccgagagctcatgcaacctcagcgaggagcacgtgagagggaacttctacaggctgtcaatcaactcggtgatgccaatgaggttttgaatgagcgtgctgtagctgtgatggcacggatgagtgacaaactaacagggcgtgacttctcttctgggtcagctttggctggagcaggtagctctatccaacatggcagtgagcatttggcttcaagagatgcccgggatgcccaacctagtctctcattgaaggttcaggttcagaagctcatactccaagcgacttcacacgaaaatttgtgccaaaactatgtc

SEQ ID NO: 2449 - DNA, 304 bp, Zea mays
  Clone ID: LIB3227-023-P1-R1-B6
cacaaactacgctagaagcctcgctgttatcgatgatggttaggaacttgcttgggtaaggagatcggcatccaaacaaccttatgttagatcgcaagagtggtcgaatattacacatcgtcttcggagattgcttcgaggcttcaatgaatcgatcaaagttccctgaaaaattaccattccgattaactcgccggcttgcgcgaactattgaagttagcggtattgagggtacattccgagcaacttgtgaaaatgtgatgcaagtccttcgcacaatcagtcgcagcgttatggccatgat

SEQ ID NO: 2450 - DNA, 522 bp, Zea mays
  Clone ID: LIB3227-023-P1-R2-B6
cacaaactacgctagaagcctggctggtatcagcatggttgggaatatgcttggttaatgagatgggtatgcaaaccaccttatgttcgaccgctatattggaaaatttttacacatcgtcttagacgattgctttgaggattgaatgaatgttgaaaagatccctgaaaaagtaccattccgtttgactcgcctgctgactaaaactctggaagatactattattgatggtacattccgaactacttgtgaaactgcgatgcaagttcttacgacagacatacacacaatcatagacatgatggaggcatttgtacatgacccggtactcaatcggcgtatgaacaatttcaatgaggatcctcatgagtcgaactatgggaatagctatgctcacacagatgctaacactgaagaaacaatggctgacgcagagcttatgcaacctcagatacgagcacgtgaaagggcacttgtacaggatgtcaatcaagttggcgatgccaatgatgatgtcaatga

SEQ ID NO: 2451 - DNA, 696 bp, Zea mays
  Clone ID: LIB3227-023-P1-R3A-B6
tttccagagagctcaccagaacggacaccacccgacatagttttggcacaaattttcgtgtgaagtcgcttggagtatgagcttctgaacctgaaccttcactgagagaccaggttgggcatcccgggcatctcctgaagccaaatgctcactgccatgttggatagagctacctgctccagccaaagctgacccagaagagaagtcacgccctgttagtttgtcactcatccgtgccatcacagctacagcacgctcattcaaaacctcattggcatcaccgagttgattgacagcctgtagaagttccctctcacgtgctcctcgctgaggttgcatgagctctcggttagccactgcttcttcactactgacaaccgtgtgagcatgaacattaccatagttcgacacttgaggaacctcattgaaattgaacagacgccaattgattaacgggtcatgtacaaatgcctccatcatggccataacgctgtctctgtttgtgcgaaagacttgcatcacattttcacaagttgttcggaatgtaccctcaataccgctaacttccatagctttcacaagcattcgagtcaaacggaatggtactttttcatggaacttttctcgattcattgaagcctcaaagcaatctccgaagtcgatgtgtaatatttttccactatagcgatctaacat

SEQ ID NO: 2452 - DNA, 370 bp, Zea mays
  Clone ID: LIB3228-001-P1-K1-A1
aagcctcatggttaaggacttccgagtagcacctccaagtcctgggttccatggggctggagagcgaattattaggtttagttaaaaaacccccatcctgagccccatccgctctcggcttacgatgtcctgtgcgccaccctccggttgtgccgttgcagagtggacagttgatgccagcccgttagtgatggagggctagtattcggttattttctaggccgtgaccattgctctctgactatttttaatataatacccgacggctggtctttgcctcccctgccgaggttgtggacatttaccaacaacatcttacctatgtactaagaattcctaccccatatcttttttccatgaataggtgctg

SEQ ID NO: 2453 - DNA, 279 bp, Zea mays
  Clone ID: LIB3228-001-P1-K1-A10
cccacgcgtccgcagcaagttcgttaccaggcacatctgggccgatagaagatggagagaggcctgccatgggcgccgcagtaggcaccaatccctcggggatagggaatccgaaagctgcagatagataggaaaaaaaaagggaacgtccactgaaacttagaaacgtgatcaagccatggtcttagttaaaagtgagatatctgaacgagtaaattagctgctagagcgacttccagttccatttcgtgagtaattgtgtcgtcgtaacgtgctaaa

SEQ ID NO: 2454 - DNA, 388 bp, Zea mays
  Clone ID: LIB3228-001-P1-K1-A11
cctgctcatgccaggtcgcgctggctgcatttcattttatgcaagaaagcaagggtgcatcacaggttttttttctgctaactaatatacatacttttgccttcaagtactgagttgcggcattgttacacatcacagtacagtttggtcaaattttttttccacagaggaagtagggattgatttaatcattgatttaatcccacacgcgtgtatctacgtatacagttagcataacatgaaccacctatgtttgcgattggtttaaccatatatataatacttatatattgaattgtttttcataaaaaaaaaaaattggttcttccgctctaagacgattcaagtttacttacatcttcatgctacgttatagtttcttctatag

SEQ ID NO: 2455 - DNA, 395 bp, Zea mays
  Clone ID: LIB3228-001-P1-K1-A12
agcagcactcacaatagcaaaaaccaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttcctcctctaatttctcgaccccgtcgaat

SEQ ID NO: 2456 - DNA, 398 bp, Zea mays
  Clone ID: LIB3228-001-P1-K1-A2
gtgtccacgtgacattggagtccctgctgaacgacaaggacatccaggcaaccatcaaggacctggtcacaagcagtgggaggtccttccccggaaagaaggcggaaggtgccgacgagagcggggagaagctgtccaaggtgcagctgaatggtaaagcttaggaaaggattgcgagagctgctggaagcgaccacggttacaagtaaataaatagaataaggcgacagattgcatcacggtgttgatccaggtgatgctgtttctgctaggaaattcttacccatgtgatgtttttcaactctggaaataagaagcatcctctaccaagtcaggaagtgaaataatccatccagtgtcggttttcataatagaattttcgttgaccgcccagttat

SEQ ID NO: 2457 - DNA, 232 bp, Zea mays
  Clone ID: LIB3228-001-P1-K1-A3
agggcattcaaagtgctaggaatagtggtgctagcatacactattcatggcagatgtgtgcaccaacccgctcacagtgaaggacactatgtgatgcaaaccggaccgcttagtctgaccccgcacggtaacatcatgtgcgacgatgtgaccacagggcatgtgggcagacaacctgtgctctacgctcaaggagaggctgactggcacttgtacgcttagcgccaagacc

SEQ ID NO: 2458 - DNA, 399 bp, Zea mays
  unsure (1)..(399): unsure at all n locations; Clone ID: LIB3228-001-P1-K1-A4
ggccgggattcgtgcccaagaacctggacacctctgtcaccgacgagatcgttacggggaccgcagaagatgcgatggcgaacgccaggaggttggccagggaagagggtctgctagtgngcatatcgtcttgggcgaatctggcagcttgcctcaaggtggcgtcgagacaggagaaccgagggaagatgatcgtcaccgtgtttcctagcggtggcgagaggtacatgagctccgatctcttcgcggatgcaagggaggagtgcgtcgccatgaccttctgatcttctggacgctctgtgcggatctgcagcggcaaactgctatttctcagcgtggaatggatttttagtatcgtcgatccaatccagcagcttgcggaggcagaagatttggaat

SEQ ID NO: 2459 - DNA, 397 bp, Zea mays
  Clone ID: LIB3228-001-P1-K1-A5
cccacgcgtccgttttgagaagatgcagctaccactatgagaaactggatttttggcgaccactggttttgggtcccttgtgcaagtcatggccttcagtcttctgtgtggttggagatccctgatctaacttgaaagttcacagttgatgaataacagctttcacctcagtgctcgtagttttgtagctccctttacagatgccttcgggtcttgtgggacatgagcatgtacttttgcagttttgctaaattttgtactgtctcagatttgaagaatccaaacaagaaatttaattttactagatttgagaagtaaactccatatgtatggcgccttccgtgatagtacctctcatcaaccgtttaggttatctgatttcctatctcattcaaaa

SEQ ID NO: 2460 - DNA, 219 bp, Zea mays
  Clone ID: LIB3228-001-P1-K1-A7
cccacgcgtcccaaaacgcaaagtttcattttacatacataaaaatacagggcgactaagcaaattatattgattaactacacaacacaaaacaccacacacatatattaaaaatttcatctaattaaaaatacacctgaacttcacaaagcaacaaatccttcacaattgaagtcttacactgtactaacatacagaattaatatacaacatctattt

SEQ ID NO: 2461 - DNA, 386 bp, Zea mays
  Clone ID: LIB3228-001-P1-K1-A8
caagaagcagctcgaggaggtcggcgccaaggtgtctatcgcgtgacactaggtatacgaggactcctttttttttttctttagtttcttttgtttgcatccccaatctcttgtatccccactatcgttcgtaaggaattgctgtttcatgatatgagatctgtgtatgtgtcgattcactagcttatatgtgtgtgatatatctctgccttgaattggcagtgaatgtgatctgctcgaaagtggtaatgtgtgtatttgccttcttggcactatcattaaattcatgatggtggacaaatggacatttaaaaaaaaaaaaaaaaaaaaaaaaaaaataaaaaataaaataaaattttaaaaaaaaaaaaaaatataggggcggc

SEQ ID NO: 2462 - DNA, 203 bp, Zea mays
  Clone ID: LIB3228-001-P1-K1-B1
tagcctcacgcgtacggacttccgagtagcacctccaagtcctgtagatcgatagcgcgcggtagcgaatttttaggtttggttaaaaaatcctctcgctgtgccccatccgctctggggttacgatgtcctatgcagccaccctccggttgacacacgtgcagagtggacagttgctgccagccctgaagtgatgggggtct

SEQ ID NO: 2463 - DNA, 398 bp, Zea mays
  Clone ID: LIB3228-001-P1-K1-B11
gcgcacacgaacaaatacctcgccgccaataatggcctccagatcctccattgtgctcgccacggcgatgctagctacactattcgcggttggtttgtgcaccaccccgctcaccttccaggtcggtaagggatccaagcctggccacctgatcctcaccccgaacgttgccaccatatccgacgtggagatcaaagagcatggtggcgatgacttctcctttacgctgaaggagggcccgaccggcacctggacactcgacaccaaggccccgctcaagtaccccctttgcatccgctttgctgtcaagtctggtggctaccgcatcgccgacgacgtcatccccgccgatttcaaggctggcaccacttataagacgacactcagcatctaatcag

SEQ ID NO: 2464 - DNA, 398 bp, Zea mays
  Clone ID: LIB3228-001-P1-K1-B12
agaaaatagtgggatcgagttgtttcactgcacgagcacatcctccggcgaccaccggcctccctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggggcacctcgccccgaccggcctgatcctgggaggcaccaagtacatggtcatccaaggcgaacctggagctgtcatccgtggcaagaagggatccgggggcatcactgtgaagaaaacagggc

SEQ ID NO: 2465 - DNA, 396 bp, Zea mays
  Clone ID: LIB3228-001-P1-K1-B2
ggctgcatcaaagagtggtcaattcacattcatgaactgctttgacatgggctctggcagccttgcgtgcactgcaaaggagggtgtcaagttgtacgtcaacaacatccgaagtgcacacttggaaatggtgcggcaacgagccatggagaaagctttagctgatgctgtgacggaaggcctaacacctagtgaagcagccaaacaagctcagaagattagtgcaaaagcgactaaacttgctgctcgtcaagccaaaaggatattgggaccaataatttcttgtggttgggacttcttcgaagcaatgtactttggtggaagcatgacggaaggttttctccggggcactggcaccttgtttggaacttatatgggtggtttccatggtgagga

SEQ ID NO: 2466 - DNA, 393 bp, Zea mays
  Clone ID: LIB3228-001-P1-K1-B3
aggtcatccatcctgctcgtcatggtggtgctagctacgctattcgtggttggttcgtgcaccaccccgctcaccttccaggtcggcaagggctccaagcccggccacttggtcctcacccccaacgttgccaccatctctgacgtggagatcaaggagcacggtggcgacgacttctcctttacgctcaaggagggtccgactggcacttggacgcttgacaccaagaccccgctcaagtaccccctctgcatccgcttcgctgtcaagtccggtggctaccgcatcgccgacgacgtcatccccgccaatttcaaggccggcaccacctacaagaccaccctcagcatctgattagcctcttatgacgaataatatttcaagagagctcat

SEQ ID NO: 2467 - DNA, 398 bp, Zea mays
  unsure (1)..(398): unsure at all n locations; Clone ID: LIB3228-001-P1-K1-B5
cgtcgactgacccatctctctagttataatttttctctcgtccttgcattgcatattagttgctatccattggtaacgcacaacagtaaaacgacaaacatccaacagctatattatgttcgacggtgtaacaccctgaattttagggtataaaatttcttctctaaatgcaaaccaaattcaggtgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanggggggggccgttttagaggatccaagtttacgtccgcgtgcttgcgacgttatagtttttttttgggggcccctaaattaaattaactggccggggttt

SEQ ID NO: 2468 - DNA, 398 bp, Zea mays
  Clone ID: LIB3228-001-P1-K1-B6
gaccatggctacaagacagttgttatgattggtgatggcgcaactgatctggaggctcggcaacctggcggagcagacttgttcatctgttacgccggggttcagatgagagagccagtcgcagcacaagctgactgggtggtttttgattttcaagagctgatcactaagttgccatgaattcattacctaccgcaatttatgaacctttgcattgtcggctaaataattgcggccacattttaaagctgtagatttcactagcaattcttggagacaactgaattattacccggttgtaaagtattttttatttgttttcccgcattgtttgtatgatcctgaaccatgaatgcggaggttgtgttccgacgttgtcagtgaaattgtcctctagg

SEQ ID NO: 2469 - DNA, 304 bp, Zea mays
  Clone ID: LIB3228-001-P1-K1-B8
cctggccatgccaggtcgcgctggctgcgtttcatttcatggaagaaagcaaggatggatcacaggttgtcgttctgctaattaatctacatacgtttgccttcaagtactgtgttgtggcattgttacacatcacagtacagtttggtcaaattttttttccacagaggaagtagggattgatttaatcattgatttaatcccacacgcgtgtatctacgtatacagtttgtataacatgaaccacctctgtttgcgattggtctaaaaataaatataatacttatatattgaattgttttgc

SEQ ID NO: 2470 - DNA, 206 bp, Zea mays
  Clone ID: LIB3228-001-P1-K1-B9
ccccaaactccccttgggattcccctcatttcctagagtttgtaaacccttcaagtgacatttgaataaaatatttagtaatttgtggcaaaaaaaaaaaaaaaaaaaaaaaaaaaaaaaaaaaaaaaaaaaaaaaaaaaaacaaaaaaaaaaaaaaaaaaatttaacaaaaaaaaaaaaaaaacaaattaaaaaatgggaattaa

SEQ ID NO: 2471 - DNA, 305 bp, Zea mays
  Clone ID: LIB3228-001-P1-K1-C1
tagcctagtggttaaggacttccgagtagcacctccaagtcctgggttcgattcccctcgggagcgaatttttaggtttggttaaaaaatcccctcgctgtgccccatccgctctcgggttacgatgtcctgtgcgccaccctccggttgggccgttgcagagtggacagttgatgccagcccgttagtgatggggggctagggttcggggattttctcggccgggaccattgtttcggtctcttcttaatataataccgggagggtggtctttccctccccggccgagtttttttttttttaat

SEQ ID NO: 2472 - DNA, 397 bp, Zea mays
  Clone ID: LIB3228-001-P1-K1-C11
tgttttctttgtgtatggtttgtgggtggtttatctgtcttccatttgtacctgatgggcactaaccagacaacatacgagaatttcaggtatcgctatgaccggcgcgataatccatataacagaggtactctgaacaattttctagagatattctgcaccgctatccccccttcgaagaacaatttccgggcaagggtgacagtagagcaagggctgcagcaaacacgctcacagtctaggggtttcatgagccccagcatgggcaagccaaccatcggagagcttgagatgggcaggaagccagtagtaccttgggacgagccaaggacggcagctgatatcagggacttggaagcagggttcgggggcatgtttgacgagaaagagggcagag

SEQ ID NO: 2473 - DNA, 394 bp, Zea mays
  Clone ID: LIB3228-001-P1-K1-C2
atggcacatgagtgctggcgtaggaaagcatatgggtttggagcttgtacagaccgcagcactgaaagacattgctgagagtgtaatgtcattcaacatgaattacaaggacactggtctttttggtgtctatgctgttgctaacgctgattgcttggatgatttggcttttgcaattatgcatgagatgagcaaattgtcataccgggttacagaggaagatgttatccgtgcacgtaatcagctgaagtcctcaatccaactccaccttgatggttcaactgctgttgtcgaggacattggccgccagctgctgacctatggacgaagaattcctaccccagagctttttgcaagaatagatgctgttgatgcaagcactgtgaagcgtgtt

SEQ ID NO: 2474 - DNA, 393 bp, Zea mays
  Clone ID: LIB3228-001-P1-K1-C3
atggaacaagagtgctggtggaggaaagcatatgggttcggagcttgtacagaaagcagcaatcaatgacattgctgagagtgtaatgtcattcaacatgaattacaaggacactggtctttttggtgtctatgctgatgctaaggctgattgcttggatgatttggcttttgcaattatgcatgagatgagcaaattgtcataccgggttacagaggaagatgctatccgtgcacgtaattagctgtagtcctcaatccaacttcaccttgatggttcaactgctgttgtggaggacatatgccgccagctgctgacctatggacgaagaattcctacctcagagctttttgtaagaatagatgctgttgatgcaagcactgtgaagcgtgt

SEQ ID NO: 2475 - DNA, 201 bp, Zea mays
  Clone ID: LIB3228-001-P1-K1-C4
tgcttttctgctattggtccaccgttgcacagcaggaatgcagagtacagggcgttgtgggatgcatgatcgaacatgccatgtggcgggggggttttgccggagtcagacttcgcgcgtgattgactagaggctacagatcgtgacgtcgcatgcatgcaccatttaatacgtattattgtttatatacaatgtcatgta

SEQ ID NO: 2476 - DNA, 296 bp, Zea mays
  Clone ID: LIB3228-001-P1-K1-C5
cagatgcctttgcttaggctcataactgaaccaccgccgtcgccataggatttggccaaaacctggtgctgtcagaattagcgatcggggtgctctcagtacacgtttgctcccctaaccagttagtgtttttttttcttctctagatatgctacaagggcattcgtatttgctgttttgcactgacatcatttttgcgaaggccctaaacgagtgtttggcataatccaggcctcccgctatgtataatactgtgcgacgttcattactggcagcaatatacacaccccttgttc

SEQ ID NO: 2477 - DNA, 395 bp, Zea mays
  Clone ID: LIB3228-001-P1-K1-C7
gcgtccacgcgtacgacaatgttgtggtggcacagacacccaatgctggaattggtgctggtgcaaggtcttaggggaaaatgaatagtgatgtgcatacatgccaacccctgttggagaaacttgttcatgtgacgcgagaatttggatggagcgctgatattgcacaatggatgacggaatgactgctaacattgggtacgcctggatggtgttcgttttccttactaattctgctgtgtttaccgaatctagatgatctgaggtcctggaagcagtctttggccatgtttccttcatcagctgctctttaaccgtagaatcggcgttcgtcatttcaagtgttgtgaccgtatcccttttgtggtatataaataaaaatgctcagttagctg

SEQ ID NO: 2478 - DNA, 393 bp, Zea mays
  Clone ID: LIB3228-001-P1-K1-C9
aaagctatagccagctagtaacaagagcaaaaacaccatcatctcatccgcccgtctcaacgccaccccaatggcccagagcacgaggatggtggcgctggccctggtggtcctcctggtggcggcgacggcgtcggtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggcttcatcggcgcgcgggctcagctcgatatcagcatcatatacaatcgctgctccgtcgctcacgtcagcccatgcatgatctctcgacccggcccattg

SEQ ID NO: 2479 - DNA, 380 bp, Zea mays
  Clone ID: LIB3228-001-P1-K1-D1
atggaacaagagtgctggtggaggaaagcatatgggttcggagcttgtacagaaagcagcaatcaatgacattgctgagagtgtaatgtcattcaacatgaattacaaggacactggtctttttggtgtctatgctgttgctaaggctgattgcttggatgatttggcttttgcaattatgcatgagatgagcaaattgtcataccgggttacagaggaagatgttatccgtgcacgtaatcagctgaagtcctcaatccaactccaccttgatggttcaactgctgttgtcgaggacattggccgccagctgctgacctatggacgaagaattcctaccccagagctttttgcaagaatagatgctgttgatgcaagca

SEQ ID NO: 2480 - DNA, 382 bp, Zea mays
  unsure (1)..(382): unsure at all n locations; Clone ID: LIB3228-001-P1-K1-D10
cagcattggttcagaagggtctcgctgaattcactgccaagcttggtgcggcctctactgacctggagaaggctgaggcccagatcggagtcgatgttcacagtgccctcaatgctgcattgaccggttaattggtggcattttaaattgtcttgtatttttcatctacagttttagagtgagtttaagtttgcaaactcatgggcatgggatggagggaatgatcctaaataaattatactccatctaaaacatggacatatgtttcttgtttcctgaatcctgcatggatttctttttgtactggtgaacattttaactctgagctcaagacctggagctgctttctgccccaaanaaaaaaaaattaattaataataat

SEQ ID NO: 2481 - DNA, 396 bp, Zea mays
  Clone ID: LIB3228-001-P1-K1-D11
aaagctttttgctgtcggaactagtgcctctctgattggcactggtgtgaccaatgcactgataaaagcaaggcaggctgccagcaaggattttgccggtgaagttgagaatattccaattttatcaactagcgttgcatatggtgtgtacatggcagtttccagtaacctcaggtaccaggttttagctggagtgattgaacagcggatgctcgagccactactgcaccagcacaaactagtattgagtgcagcatgttttgcagttcggacagggaatacgtttttgggttccctactgtggatcgactatgccaggtggataggcgtacagtaggctcaagcatgggtacacaaatgcagttgctcggagttccagcaatatgggttcttcgt

SEQ ID NO: 2482 - DNA, 145 bp, Zea mays
  Clone ID: LIB3228-001-P1-K1-D12
cggacgcgtggggtgagggcagcggcttctctcgtttccttcttctctagctatttgtcccccctagctcgtttgttctctcgtcccgtcgtccggttcatttccgcttccgaggaataataatcaaccaaaggggctctgctct

SEQ ID NO: 2483 - DNA, 354 bp, Zea mays
  Clone ID: LIB3228-001-P1-K1-D2
atggaacaagagtgctggtggaggaaagcatatgggttcggagcttgtacagaaggcagcaatcaatgacattgctgagagtgtaatgtcattcaacatgaattacaaggacactggtctttttggtgtctatgctgttgctaaggctgattgcttggatgatttggcttttgcaattatgcatgagatgagcaaattgtcataccgggttacagaggaagatgttatccgtgcacgtaatcagctgaagtcctcaatccaactccaccttgatggttcaactgctgttgttgaggacattgtccgccagctgttgacctatggacgaagaaattctaccccagagctttttgc

SEQ ID NO: 2484 - DNA, 396 bp, Zea mays
  Clone ID: LIB3228-001-P1-K1-D3
atggaacaagagtgctggtggaggaaagcatatgggttcggagcttgtacagaaagcagcaatcaatgacattgctgagaagtgtaatgtcattcaacatgaattacaaggacactggtctttttggtgtctatgctgttgctaaggctgattgcttggatgatttggcttttgcaattatgcatgagatgagcaaattgtcataccgggttacagaggaagatgttatccgtgcacgtaatcagctgaagtcctcaatccaactccaccttgatggttcaactgctgttgtcgaggacattggccgccagctgctgacctatggacgaagaattcctaccccagagctttttgcaagaatagatgctgttgatgcaagcactgtgaagcgtgttg

SEQ ID NO: 2485 - DNA, 380 bp, Zea mays
  Clone ID: LIB3228-001-P1-K1-D4
ggcatcattctgaattctgattcaaacaaaacggtaggatcgcagagaccaaattgggatcatagtattagcatcgatcgggcaggattacagaaacaaaaccctcttggcgacccacacgatcaccaaggaaggaaggaacaacagacgatcacataattaggcaaccgcaagcaataaataaataaataaaacaacgattaattaattaatcgggtgaaccaaacacgatgctccatcccaggtttcccgcactccgcgcggtacgtcgctcagtggaggaaggaggcgaggaaggagacgacgagcgccgtggcggcgggcactgcggcggcggcggcggcgctgtcggaagggccagccgcaccgccggccgtgcc

SEQ ID NO: 2486 - DNA, 163 bp, Zea mays
  Clone ID: LIB3228-001-P1-K1-D5
gctgtacaaggctccaccattacgagaatgcatgatgaggctaggatggttgcttggcgaaaacccattcttgacattatatttgtactcatgaacactccaatactccatgaatcgagtgagtgtatgctggtccgttccagtcattgtgcctttctatttg

SEQ ID NO: 2487 - DNA, 76 bp, Zea mays
  Clone ID: LIB3228-001-P1-K1-D6
ttctggaggatccaggcttacgtccccgtgcatgcgacgtaatagcttttttatggggtaacctaaaattaaatta

SEQ ID NO: 2488 - DNA, 389 bp, Zea mays
  Clone ID: LIB3228-001-P1-K1-D7
aaaagcttttggttgccggacctagtgcctttttaatggccactggtgtgcccaaggcactgataaaagcagggaagcttccaccaaggattttgcccgtgaagttgagaatattccaattttataaactagcgttgcatatggtgtgtacatggcagtttccagtaacctcaggtaccaggttttagctggagtgattgaacagcggatgctcgagccactactgcaccagcacaaactagtattgagtgcagcatgttttgcagttcggacagggaatacgtttttgggttccctactgtggatcgactatgccaggtggataggcgtacagtaggctcaagcatgggtacacaaatgcagttgctcggagttccagcaatatgggt

SEQ ID NO: 2489 - DNA, 284 bp, Zea mays
  unsure (1)..(284): unsure at all n locations; Clone ID: LIB3228-001-P1-K1-D8
tattgtcgtcgttgatgccaaaggaacactgtacctagaggacagtcctatgcctcggagcttggaataatgatgatggagggagcggaaggatgcctgccatttgttggagcgtgcgtggtagtatttctaggcctgtaataaacaatgcctttttccatttacgttgttggttttatccggtgaccctcacacgattcatcaaggtggtgagcctggctattaaatcgggtgctgttttttttgggtaaacattggcaatggccttactgtcttgcagcana

SEQ ID NO: 2490 - DNA, 377 bp, Zea mays
  Clone ID: LIB3228-001-P1-K1-D9
cccacgcgtccgctttcatcctgaatcttggaatcccatgtggtctgttgcaagcattctcactgggcttctgtccttcatgatggacgatgcactgacaactggaagcataaagacatcagatgcagaaaagaggcgtttagcaaaagcttcccttgtctacaattgtgagagcaaaaactgcccgcacttcaggaaacttttcccagagtatgttgagaagtacaatcaacagctacaattggagaacactgctgcagagccggtgcctcaggagaatcctgcacctgctccatcccctgctgtccagcaagctccgaccgtggccaatagggcacaaccactggcggaggcgcgccgtgacaagaaccagaaga

SEQ ID NO: 2491 - DNA, 72 bp, Zea mays
  Clone ID: LIB3228-001-P1-K1-E10
ttgtcttgctgttgtaagtgccagcacaagcatatatacggcgtttatatatactacatactccgatcgttc

SEQ ID NO: 2492 - DNA, 163 bp, Zea mays
  Clone ID: LIB3228-001-P1-K1-E11
aagatgttctactgtgctacataccttttctctagccatgctttatataggctaaggctcgtatatatggctttaacagtacaaatagtcgcagttgtatcagaaaaaaaggtgaatagcttatgtaatggtttatcaaagtacatattattgtacatttgta

SEQ ID NO: 2493 - DNA, 301 bp, Zea mays
  Clone ID: LIB3228-001-P1-K1-E12
gggattgggaaggaatggggggggcgacccacgcgtgcgctcatgatctaacgcgagggcttcatattttgaaaaccatgctgaaagaggggtgcggatccatgttctcgcgtgccaatacttaattttttgtcatggtaaattatggctccacaccacccttgtagtacagctatcgtaccttttcctttctgcaccttgaagagatgtaataatacgggtattcttacttggaaatgcaataatgtctttcttccaaattggataagctacctgttctgctttttaaaataatattctt

SEQ ID NO: 2494 - DNA, 398 bp, Zea mays
  Clone ID: LIB3228-001-P1-K1-E2
ccagtttcgcgcgcgcgcgcgcgccgtctacgtcggctccgtgtctccgccccgagctgcgcgtgtaatctcagacccagcctaagcaaaccaccagagtcagtaccccgccagcacccgagcccctgttctggtgattggtgaagaccttgtcgcagatcgcaacgatgtcgggcgcggcagggacgccaccggaagacggaggggatcggccgtggcagtcttaccataccgcatacaccaacgccaaagctggtacgggcgcactttctctgctcgctccgtattgggggtttccgggctgacatggcgccggcttaacacgaaacctacggatagggtttcgccataagtgctttactagttggtccgcataatattagaacaaatctggaact

SEQ ID NO: 2495 - DNA, 332 bp, Zea mays
  Clone ID: LIB3228-001-P1-K1-E3
tgtttttcctggaagcaaaagccttgcgttctgtatgagacttctgtataccatgtgccctctctctttttccccaatctctgccgtagtcctgcactcctgctactgctgtaaactagaacttatttgctgttttgtctcgtggcattgtcgagtcgcttatgtgtctatgcaatgctagttgtgagaagcctaatgtaccttagcttaatcaccgaattgctcaagtttgatgtcttcctagtcagatcattcctacaattttctatatataatatgtacggtttctttgtataacataaatcaacatgaactgtagtagttagagacaa

SEQ ID NO: 2496 - DNA, 398 bp, Zea mays
  unsure (1)..(398): unsure at all n locations; Clone ID: LIB3228-001-P1-K1-E4
ccaacccgnccgacaaaaataaggaaaggtcccgcccttttccttcgacatccacaaggggggagggggaaacacgtacattcaccccgcggcaataatggcctcgggtccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggggtcaccgacgcgaccggcacctacacgatcgagctcaaggacagccacgaggaggaca

SEQ ID NO: 2497 - DNA, 251 bp, Zea mays
  Clone ID: LIB3228-001-P1-K1-E6
tatctggggcctggtcccttctttcgtcgtacggtgaaaatgaagctttgtaagagtccgtgttagccgtggtcgttgcttcgattctctagcatgtaatgataagttcacattgggatatgcttgctgttttgctgtaatgataagttcacattgggatatgcttgctgttttgctttttatttatttttcttgatcctctagcatgtaatagagtatcctccaagtagagtttttttttccttgaaaaa

SEQ ID NO: 2498 - DNA, 394 bp, Zea mays
  Clone ID: LIB3228-001-P1-K1-E7
tgctcttggtgattgtgcaacgattgctcaaagaaaagttatggaagatgttgctgccatattccgagtagcagacaaggataactctggcactttaaccgtgaagaaaataaaagatgtccttggggacatatatgagagatacccacaagtggaattgtatcttaaatccaaccaaatgaagagcttccacgagctacttaaagactcagatggtaactccaaggagttgaaagaactgaacatcgaacagttcaaaaaggcccttgctcaagtggactctcaagtcaagatgctcccagcaacggctcaggttgctgcacaagagggaagttacctagccgactgcttcaacagaatgaagacgtgtgaacaatatcctgagggtcctata

SEQ ID NO: 2499 - DNA, 393 bp, Zea mays
  Clone ID: LIB3228-001-P1-K1-E8
cggcgctctgcccctactgcctgtgctgcagcaaatggggcttctgcggcagcaccgaagcctactgcggcaacggctgccagagccagtgcgaccgctgcaacgccaccgtcgcgtccatcgtcacgcgggagctcttcgacgagctgctgctgcaccgcaacgacctcaggtgccccgcccagggcttctacacctacgactcgttcatcgccgcggcgggcgccgacgcgtccgacggcttcggcaccacgggcgccgtcgacatccggaagcgcgaggtcgccgcgttcctggcggagccggcgcaccggacctcgggcggctgggacggcgcgcccaacggcacctacgcctggggcttctgctacaagccggccggcgcccagaacg

SEQ ID NO: 2500 - DNA, 372 bp, Zea mays
  Clone ID: LIB3228-001-P1-K1-F1
cccacgcgtccggctccctcaccttctggatctgcgacatcatcgtcaccaactctctccctgtgatgctcagaaccatcggcctcgcgggtgtatttggctcctacgccttcgtctgctgcttgtcgctcgtcttcgtgtacctcagggtgcccgagaccaaggggttcccgctcgaggtcataatcgagttcttcaacgtgggtgccaaagctcagaagccggagcagcatgaagaggaggagaaccacgactaacccgtatatatttggattcattaataataactgttttttctttctttctttctttctttctttctttctggattatgagttgaatgaatgatgtcgatcagagagcttgatgacc

SEQ ID NO: 2501 - DNA, 348 bp, Zea mays
  Clone ID: LIB3228-001-P1-K1-F10
caacctcggcgcctgcaagcgcgccatcggcttccgcgacgccgtcaccatccgcgccacgatgagcatggtggcgcaggacacgcagaactgcgacgaggagttcaggaaggccgtctccaagaaccccatggaggaccacaacaggtcgctcatcgagatgtccgagatctgccgcacgctctccaacatgatcccttacgaacatgtccattgatttgtttgtttctttttcccgacccccctactacgttcagtaacgtggtcgtcgtcgtcgttaagtccggcggcctaaaacatatgtaatttgatgcttggtcgggtgtgtctgtcagtcgattgactgga

SEQ ID NO: 2502 - DNA, 315 bp, Zea mays
  Clone ID: LIB3228-001-P1-K1-F11
ccgagtagcacctccaagtcctgagttcgattcccctcgggagcgaattttcaggcttggttaaaaaattcccctcgttatgctccatccgctctcgggttacaatgtcatgtgcgccacccttcggttgggccgttccagagtggacagttgacgccggcccgttagtgatgggggccagggttcagggatttctcgtccgggaccattgtttcggtaatatcgggagggcgggctttccctacggccgagtttttcatttacgttacatttcgtaaaccaaacgacgccttagttttataataataaattgtc

SEQ ID NO: 2503 - DNA, 270 bp, Zea mays
  Clone ID: LIB3228-001-P1-K1-F12
cccacgcgtccgcccacgcgtccgtctcacgcgtccgcccacgcgtacgcgggcgcgtgggctcgacgattgcaggagaggaaaatttcgtcttcagctctaacagcgtacttaggcaatgatctagttttgttttgctttatctatacattgaaaacggtggatattagccttgcggatccaataaagatatctttggtgctggtgcatttatagcgaaggtcatgcaggaaacaagtatgcactctatatagttcggattggagggta

SEQ ID NO: 2504 - DNA, 394 bp, Zea mays
  Clone ID: LIB3228-001-P1-K1-F2
gggtcagccagcaaaggttcatcaggttgccgtgaggtggatcttttcgtgaagcaagtagacgggaagaaggtgactgatcctgcgaaacaggacgcgctgcggtcacgcctgaggtccgagacgctccatccgctcagggtcatggtcgtcggccgtggacccgacacggagctcctcgtcgccaacccggtcgaggcctccgggaagggacggccgcgcgtgttctacgacgccactcttgctctcaaggcgcttgggatctgcatcttctctgctgagatcgggaggcaagcggcgtccgagcgccattgggaggtgtacaggttcctcctggatgacagcaaggagttccccttggcaagcagcctcgctaacaggaactgtgtcgtcg

SEQ ID NO: 2505 - DNA, 218 bp, Zea mays
  unsure (1)..(218): unsure at all n locations; Clone ID: LIB3228-001-P1-K1-F4
cggacgcgtgggcggacgcgtgggctcttatgaggaaataatattttgaaagagctcatctgatccatgtgccagcgagctaatattntaatttttttctatggttattttatggcaccacaccacccaagaaataagttatgttacatgtcccttcgtgcaccttgttgtgttgggttaatacggttatataaattgaaatacaatatgtatttaat

SEQ ID NO: 2506 - DNA, 327 bp, Zea mays
  unsure (1)..(327): unsure at all n locations; Clone ID: LIB3228-001-P1-K1-F6
cgccagttatccgactcttaaatgggcttctccaacagctaaaactaacactctggctagctaaactagatagataatctgttggagtgagatgctatatatatagtgtaatctntatgtcaaagtgaaatagaaggttaaatagagagagaaaaaaataagagtcacttggagatgctctatgtagtctcttgtcactgcatatgcaaatctgattgcaccagcttgcggtagaacctgtgggtatatagttgagagttttgaagaaaataaagcttggatatacagatttgtacttgatttcttaatagaaacaaagtttctgng

SEQ ID NO: 2507 - DNA, 184 bp, Zea mays
  Clone ID: LIB3228-001-P1-K1-F7
gtttgtttatttatagacaaatgtagcactagttaactagttgtgattttttaaatttctcagctataaatcaggaaatattttttaacacttcaataatatatctttgttctccattattataaaaaaaaaaaaaaaaaaaaaaaaaaaaaaaaaaaaaaaaaaaaaaaaaaaaaaaaaacca

SEQ ID NO: 2508 - DNA, 392 bp, Zea mays
  Clone ID: LIB3228-001-P1-K1-F8
cggacgcgtgggtatgccgacccggtggcgatgctcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagaggtgatctgacccttccattgagttgaatgaagtagcctggaactgtggtagttcgtcttttacatcttaagctgctgatagact

SEQ ID NO: 2509 - DNA, 395 bp, Zea mays
  Clone ID: LIB3228-001-P1-K1-F9
cccacgcgtccggtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatg

SEQ ID NO: 2510 - DNA, 380 bp, Zea mays
  Clone ID: LIB3228-001-P1-K1-G1
ccacacacacactgacacacacaaagccattagccatgtcgttcaacaaaaacctagcagtggtcgttggcttaacctaggctctggtcatcgtgtcgaacggtgaagaaacttactcgtatggcggatcagcgcttgtgcgattcaacgacgggggtcgcctgcgcatccgacgcggtctgcgtgaccatctgcatgcgaagggctggacagaactacgtctacggccactgctacaaggagcctagcggcggccgttcgtgcttgagcaccgtacggtgtgatccactgtcggtggcggcgccgttgtaagagccgaccacggcggcggctccgtcgccggcaccaacttgtggctgaagcctaatgcacgaactcta

SEQ ID NO: 2511 - DNA, 283 bp, Zea mays
  unsure (1)..(283): unsure at all n locations; Clone ID: LIB3228-001-P1-K1-G10
cccaatcgtattatgacacaaagtttttctcctctaattgnanaaaaaaaaggagctatttcttttttttttatttcccactaatatactaaatgatatgaacttccttaaaaaaaatgctattatttctattgaaaaaaattcaaaactcttaaaaaagatatattcattgtttaattgataaagaagcctctcgttgtgatacttttaatttgtctttaataatgtaaacaaaattttttcccacctgttggttatgagattatgtaactgctccaccgtt

SEQ ID NO: 2512 - DNA, 189 bp, Zea mays
  Clone ID: LIB3228-001-P1-K1-G11
gcctctctctaccgaatgggtttatgcttgggttgaccatcgctgccattgctgcagtcatgtatgcagaatcccctataataggagcgcctatagcagcaagctgtgcccttatctgcaacataatggcgggctattagctcggtaacctttttattgatcaagcctcgagtgatgcatgtttgttac

SEQ ID NO: 2513 - DNA, 127 bp, Zea mays
  Clone ID: LIB3228-001-P1-K1-G3
actcagagtctagtatgctggtgacggattgcttcaatggcctcaaagacacccggagctttcaactgtggggaagtctactgggacatagaagtccttcggtttcgaaacatttgatcatttcact

SEQ ID NO: 2514 - DNA, 295 bp, Zea mays
  Clone ID: LIB3228-001-P1-K1-G4
tcgccgccgctgttggattccgcaagaagcgccggccccacttattggagaagaagatctaactattggtttgtggtttatttcccactaggtttctcactgatgggaacttggtggagacttatgctattatctggatcgaaggtactgcaatactggtaaagaggatatattcatcgtttagttgatcaaggtggctgtgggggggatccttttagtttggctggaatggtggaaacatgtttgtgtcgggctgtggtcgttttggtttgaaactggtaacatggttgagtct

SEQ ID NO: 2515 - DNA, 313 bp, Zea mays
  unsure (1)..(313): unsure at all n locations; Clone ID: LIB3228-001-P1-K1-G5
gaccaagccttccgcgggggcgctttaaccgaggtcctaactcagatctatcgtgtggtcagcaagaaggccctggccattggcaagacccccttgctcaaccaaagggcaaccaatcaacgttgggggcagggatgatgtctctgctgtgaaaaaagtaagggtgctgttcatcctaaataacttatgaccatgaaaaaggaaccatatactctccgatcatatgattggtaactgaaaataggactctcttgtgcttcctaacctgttggttatgagattatgttggtgctccagngnntnaanntaaaaa

SEQ ID NO: 2516 - DNA, 405 bp, Zea mays
  Clone ID: LIB3228-001-P1-K1-G6
aagtggcacaaatctgataaaaaaatggaagcacgcacggttacaaagtctgattctcgagctgaccgctccgcagcaagtaactcttctcctgagacaaagctttccaggaaatcactggacatatcaagtgttgcttcagatttgaagacttcagtgtctgttccttcaacgccacccttagtatccagagcagatccatcatcctccaaggggcattctcaacctacagattcagattcgatgaagaaagcatggcggtcaccagggtatcaattatacagacaggtttcggacagtaaaattccatctctcagatctcttaatgagataaggtctcctgaaggaaggcctccctcttccatgttatcagcctgcagcaatgacttgtcagcagcaggatcc

SEQ ID NO: 2517 - DNA, 305 bp, Zea mays
  Clone ID: LIB3228-001-P1-K1-G7
gggatatagatgtgattcacatggatttcattctatgtgtatttgccttttgtgtaaaagttagttatcttaagacaagcggggatatattctatgttcatatccgtcatttagggtgttgttcaaataattttatgggataataattaactagtttgtttacttctagatatatgtaatactacttaaataatccttatttctttaatttcttagctctatagctagaaacatgtttttagttgccaaccactttagtaatatatgtttcttctcctttattataaacctcaatacttgttgtg

SEQ ID NO: 2518 - DNA, 176 bp, Zea mays
  Clone ID: LIB3228-001-P1-K1-G8
tcgattatatagaggcgattcacatggatcacactttatgacgccttccttccagggcgtaagttttttattgggtgacatgacattaaatcacttatcgccgtattacaacaatctgggttgtgtaaaccccagcgtttcccaaaataattgcccttgtatgcaaaccccttttt

SEQ ID NO: 2519 - DNA, 128 bp, Zea mays
  Clone ID: LIB3228-001-P1-K1-G9
cctcagtctctagtatgctgctgccggattgcttcaatggcttcaatgacgaggcttagctttcaactgtttggatttctcctgtgacattgaattccttcggtatcgaaacatttgatcatttcact

SEQ ID NO: 2520 - DNA, 113 bp, Zea mays
  Clone ID: LIB3228-001-P1-K1-H1
cttcggcaaacgttccgggttatagaccgagggcggccgtttaggaggttccaagttacgcgccgcgtgcttgcaaggtaatagttcttctatagggtaacctaaattcaatt

SEQ ID NO: 2521 - DNA, 393 bp, Zea mays
  unsure (1)..(393): unsure at all n locations; Clone ID: LIB3228-001-P1-K1-H11
ggccaacgatggctctggcattggagctgctctccttgcagcctcacactcccagtatggcgagagtgactagtcttgaaaactggtgtggatcgaacttcgagtgtagctctcatttttatctttttttcccttcaaaacatccctaatattccggctctcctcggggaatttttcggcttcctttcttggctattctgtggatgcacttaaggctctgcagcgggatatagctagtatagagccaatcagtttggaggttatctaatggcataagatttggacggcaggagcatagaaatggaagctgaacaatgccattcatgttctgcccaatttttcttccccttgcatgngtgtgtaaaccaatcaaaaaatttaaccttttttttt

SEQ ID NO: 2522 - DNA, 267 bp, Zea mays
  Clone ID: LIB3228-001-P1-K1-H12
cccacgcgtacggccaagcgtactcccatgcgtgcggaccacgaaaggaggggccaagtgcacctgagaagatgtcggcccaatacgcgggtttcccgccggctacacggtgcgtgccgccgtgcaaacgtaacctaccacactagacgcaagcgtggtaggttatgtctaggaataacatgttctcttttcttgttctttccttgggtgggggctcggatgggccgcgccgtggtgctggttagaggatccaaacttacgtacgcg

SEQ ID NO: 2523 - DNA, 252 bp, Zea mays
  Clone ID: LIB3228-001-P1-K1-H3
tagggcttgcacggaagctaccaacatgtgatcttgcagccactaaaaaaggtgacgattgccaggaatccttggacgaggatgacctgacttaaaacgatctcccgagccaaaaggtgaacgtcatagtttgccatcggtgggggaacaactgtaaaaagaggttatgcgagttacatactaaaaacttgtgggcagcattcccagatctataaacatgaaatttgtagggcccaattatgttgtatccgt

SEQ ID NO: 2524 - DNA, 249 bp, Zea mays
  Clone ID: LIB3228-001-P1-K1-H4
ttttgtgtaagacaataatggctgccaaatgttttataaggtacggaagttgtagattgagaccatgtatgagaattttccccaccgctactcatctctttgccaccactattttagtcatcagtgctggatgggcaccctatttatttcgacgtaccctttattgctagcattgtaataagcgatgggcatgcttgtagttgaataagtacaatgtccatgtattcaaacatcagcgtcatgtttatt

SEQ ID NO: 2525 - DNA, 405 bp, Zea mays
  Clone ID: LIB3228-001-P1-K1-H5
cccacgcgtccggcgagcccattttgccggccgcgttgccctcccccgtcgcggggcccggccgccgcggtaggggtggtaagcgcaagatcaagccatcagcggcaacccatgaggattccaacatgatcccgcgcaagcccgtcgaagcagtggtggtgggtaagggtaaggtggccaaggataccgtgtccgagtcacctgctccaagccccgcccccgtctccgccccttagttgcgtgttgggcgccgctgcccgccggcccccgccaccatgcgtcgtgtctgcgcgcgcacgcacgcattgaacgggagatagaatatggtatcgttcaatgcagattgccatgctatagctccagagtttatctacctggtagcaccatgacacgatggcccgttcg

SEQ ID NO: 2526 - DNA, 55 bp, Zea mays
  Clone ID: LIB3228-001-P1-K1-H6
gtccacgcgtacggtgggccaatttttccggccgcgttgccttcccccgtaaagg

SEQ ID NO: 2527 - DNA, 273 bp, Zea mays
  Clone ID: LIB3228-001-P1-K1-H7
cccacgcgtccgcccacgcgtccgcgccgacgacgtcatccccgccgattgggggccggcaccacctataagaccacactcagcatctaatcagcctctgatgatgaattatatttcaaaagagctcacctggcgctcacgttagcaagacaatattttttctatggttattttgtggcgccaaaccacccaagaaatatgtgatgctacatgtcccttatgatgccttgttgtgttgggttgatattattacataaactaaataaattattc

SEQ ID NO: 2528 - DNA, 307 bp, Zea mays
  Clone ID: LIB3228-001-P1-K1-H8
ctgacgcgtgggcggacgcgtgggaaaaaaaaaaaaaattaacaaaaaaaggggggcattataactttttatttgcaaaaaaaaaacaaaaaaaaataaaaatgttcatgctttcatctttcttagcactacaaattgtcatatttatcattaacaatatcaaaagccctcaaaaaatgataatttcctaacatcttcttcaactttttttcttatttaacttgaacaatttatcttattaactttttcttaatctctaccaaccaaaactaatattcaaattttagatatttatttttcaaccctt

SEQ ID NO: 2529 - DNA, 392 bp, Zea mays
  Clone ID: LIB3228-002-P1-K1-A1
ggtgagcgcggcgacggtggggcacgatgaagacacggtgggcaacggctgctgcgggaagggaggagtggtggtgcagcagcagcaacagcaacagatggcggcggcggggtgcccgtggacgaggatgaagtggaccgacgacatggtgcgcctgctcatcagcgtggtctacagcgttggggatgactgggagggcgcggcaatgcctggcggcgcggggggaggcaaggcgagcagggcgggctcgtcggggcacggccacggtcatgcgggggcggcgcagcagcagaagaagggcaagtggaagtcggtgtcgcacgccattatggacaagggctttgtggtgttcgcgcaacagtgcgaggacaagttcaacgaccttaacaagc

SEQ ID NO: 2530 - DNA, 305 bp, Zea mays
  Clone ID: LIB3228-002-P1-K1-A11
cggacgcgtgggcacacaccacgccgccgccgccgcatgaatcatcatgtcatatgcatgcatcgcttctcttccttgtcgcattaattttcatgcgtccaatgattcatatctctatatgcatatctctctgctctgccttgttggctggctcttctcatcattccctagcagatcgcatagtattagttgcatgcattatattgatgatgcaggtatttcgtcgagcaacaaggcgtactatcaattgtttttgtaatacccaaaattagtgaataaagggaaactggttataaaatttaaaa

SEQ ID NO: 2531 - DNA, 394 bp, Zea mays
  Clone ID: LIB3228-002-P1-K1-A12
ctcgcaaaaacaagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgtggatgagaaccttgagaagctgaagaaggtgctagaggtgtacgaggcacgcctgaccaagtgcaagtaccttgctggagacttcctcagcctcgccgacctgaaccatgtgtctgtcactctctgcctgttcgctacgccctacgcatctgtgctcgacgcctacccgcatgtgaaggcctggtggtctggtctgatggagaggccgtctgtccagaaggtcgc

SEQ ID NO: 2532 - DNA, 379 bp, Zea mays
  Clone ID: LIB3228-002-P1-K1-A2
cccacgcgtgagggtgaggcacttgttcatcgaatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcagggttggcaggcaaattgtcaacgtcccatcattcatggtgagggtggagtctgagaagcacattgacttttcactgtcaagcccattcggtggaggccccgcaagaagggtgaagagaaagaatcagaagaaggcaagcggtggcggggatgctggtgatgaggattaggagtgaggat

SEQ ID NO: 2533 - DNA, 233 bp, Zea mays
  Clone ID: LIB3228-002-P1-K1-A3
tgtaccggtgcggaatctcgctggcgtcgtctccacggcgtgcgcaaaacaatcgataataaataaaaaaaaaaaaaataaaaaaaaaaaatgaacaaaataaaaaaatgatagatagagaaaaaaaacaagctaaaaaaatagggggggccgctttagaggatcaaagcttacgaaggcgtgtttgcaaactaatattttttttatagggtcacctaaattaaatacaatgc

SEQ ID NO: 2534 - DNA, 403 bp, Zea mays
  Clone ID: LIB3228-002-P1-K1-A4
tggagacaaggaccatggtggtgtgcgcgacgggacggcccttgtgctgtgggagtggtgcgagggagacaaccagcgctggaagattgttccctggtgaacaaggaaatgtgtgaccgagcccgcaccaaggaggagctcctgccgtaataagtgaagtgattggtactgaagtttctggaaataagaggctcttctgagatgcctgtttgtgtgagtatttgcgtttccattccgttttcatgataataaaacgcattgattattaatatatgtaatgtgatgctacactgagtggcagcgttggtatatatttgtaagaattaagaacccattgttgttggactaagcgtgacgagtgatgtactgatgtatgaacctttgcttgatgcatatgctcttt

SEQ ID NO: 2535 - DNA, 393 bp, Zea mays
  Clone ID: LIB3228-002-P1-K1-A5
cccacgcgtccgttttgagaagatgcagctaccactatgagaaactggatttttggcgaccactggttttgggtcccttgtgcaagtcatggccttcagtcttctgtgtggttggagatccctgatctaacttgaaagttcacagttgatgaataacagctttcacctcagtgctcgtagttttgtagctccctttacagatgccttcgggtcttgtgggacatgagcatgtacttttgcagttttgctaaattttgtactgtctcagatttgaagaatccaaacaagaaatttaattttactagatttgagaagtaaactccatatgtatggcgccttcccggatagtacctttcatcaaccgtttaggttatctggatttctatctcattc

SEQ ID NO: 2536 - DNA, 318 bp, Zea mays
  Clone ID: LIB3228-002-P1-K1-A6
cggacgcgtgggggcattctttgatgactacaaagaggcccacctcaagctctccgaactggggtatgctgatgcttaaatggtccatatgctggagcgggacacaaactgctgcctgtatggactcgtgcgattcagggtgaaccatcagattgtctagtgtcttctttgtaataaatttatctgcacttggtactttgactatggttgaatcggaacccatttttcgtttgcctagatacttaatttctggtgctgtatccagctgaaactagtagatctatgatcttgtggctgcagcatgttcttgtcactttt

SEQ ID NO: 2537 - DNA, 407 bp, Zea mays
  Clone ID: LIB3228-002-P1-K1-A7
gcgccaacccttcggtcatacgtgagggtgggaataattgttcatcaaatgaaccggtatgccctgagcgcgtcgatatatctatacatgccaagataaaggtattggagtagtgacgcaagttccagccggacgtcattctgcttatcctgcttattgtgtccaccgatatggcacaggcaagggaatgcgagaagtacagtgagcgatttgttggggcatgcatgatcgcagacaactgcgccaatgtgtgccgcggtgagggctttttggacggcaggtgcagcacctttcggcgccgctgcatgtgcactaggcagtgctaaacaagatcggtcgatcgctcgccatgcatcgacaacctattcttaataacgttcattatctgggtcttatttatgacgaat

SEQ ID NO: 2538 - DNA, 379 bp, Zea mays
  Clone ID: LIB3228-002-P1-K1-A8
gatgtacctatgccaattcatggagcaaaatggtggaaagcttccggatcgcctggaaggctccaaaatgacgacaaaacgttttggaggccaaaagttcttacagggattgcaactggcaatagaatcagggaattgtggcaaggacaccattgatatgctgttgaaagatgctgattcctatgataaaataaacaggacgtcctccatcaaatctgccagctaattattatctggtcgatactgattcgatgcccagccggaatatttatacgggtttcattacaagtaaatatgtaaatagctgcagccttttgcttgcaggaagtgcattttgattaatttgtaagcttgcgcaaaatgctagtagttgctacta

SEQ ID NO: 2539 - DNA, 338 bp, Zea mays
  Clone ID: LIB3228-002-P1-K1-A9
ttgccccacccgttcgacccacaacgccaatctttagccactggccgcgccgaacatacgcgtaggctaggcagtatctcctgtgagcgcacaatcatcgttcaacaccacgccggagatggagaagctgttccgtagcaagaggcttgactcggagatcttctttgcgccttcaaactgattcattcgccggtggaaaatggtccatccatctcgagtaaacttggtgtcctgggtgtgttctttagcagcttcagtttagaataatcaggttatgtcttcatcatcagttttttagatcggttcatgtaataataaacttgagatggtacaaaaca

SEQ ID NO: 2540 - DNA, 252 bp, Zea mays
  Clone ID: LIB3228-002-P1-K1-B1
cggacgcgtgggttcagaggcgtcgaagtgtccttgacgacgacgattagacgcgacctgcaagctttgcctctgagtgcatgatgatgggctggtgattgattgattataagctgtaccgaacttgtttgcttaaagacaatgatctgatgcgactgcaaacagccatcaaaacttggttgtatatgatccgatgtcttgttggtgtacccccgttgaggacagtcgatatattggctgtgattatccctg

SEQ ID NO: 2541 - DNA, 382 bp, Zea mays
  Clone ID: LIB3228-002-P1-K1-B10
cgggatcgcgcgcggtgccgtcgtcgtctgtgcgccaaacgatccgatccggccgtctcctcataggttaggttggtcatgtcttgcaaattgtgaaattgtattgtatccgcacgattccccggcgcgtttgtgttcttgccatgtcctggcctcctgtctgatttgggcgtacttctgatctgatggatttgtaattaggcacctgcgttgtatggtgtggattattctatttttacttctccctcttcttttgttaatacctttttttgaaaggttcttcctttattaatatcggacggcattgttgtgcctgcccatcttggatccaaaaaaaaaaaaaaataaaaaaaaaaaaatataaattaaaataccttatttt

SEQ ID NO: 2542 - DNA, 322 bp, Zea mays
  Clone ID: LIB3228-002-P1-K1-B11
ccacgcgtccgaatgttttgtgttttcgctattcaatctccacttcaaggtcaagactattcggatatgagctccattcccttgcctatggttggtacgggaatgcaatatggaaccaggatatacaagaatcttcttcaagaaactggtcatcgagctgatctaagactccccatttatactactattagatcggggccagatcatacacctgggttcacatgcatagtggagttggcaggaaagaaatttactggcaatcctagcaaggctaaaaaatgttgcaatggctgcctggtttgaattgaaaaaacctaaggga

SEQ ID NO: 2543 - DNA, 391 bp, Zea mays
  Clone ID: LIB3228-002-P1-K1-B12
aaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggt

SEQ ID NO: 2544 - DNA, 241 bp, Zea mays
  Clone ID: LIB3228-002-P1-K1-B2
tcggggacacgtgtgtttaaaggtgtacaaatgtccttacaatagcacgaataaaacccaatcttttgctatcgtatcaagaacattaccacctgccattatttatgatgattataatgcttaccccactttttttttttaagacaaaaaaatcgttttactgctcataaaaatcaaaactttcctgtatatgatcctcactttttttgttgtcccctcctttattacaaaatgtatattc

SEQ ID NO: 2545 - DNA, 402 bp, Zea mays
  Clone ID: LIB3228-002-P1-K1-B3
ggcacattggctggtgggagatatatggataacgatgtagttgcagccgtaatattgggcactggtacaaatgcagcatatgtggagcatgcaaatgcaattcctaaatggactgggttactgcctaaatctggaaacatggtaattaatacggaatggggaagctttaaatccggcaagcttcctctctcagaatacgacaaagccatggactttgaaagtttgaaccctggagagcagatatacgaaaaaatgatttctggcatgtatctgggagagattgttcgaagaattttactcaagttggcacatgacgcttctctatttggagatgttgttccaactaagctggagcagccatttatattgaggacgccagatatgtcagccatgcatcatgac

SEQ ID NO: 2546 - DNA, 335 bp, Zea mays
  Clone ID: LIB3228-002-P1-K1-B4
gcgggcacattggctggtgggagatatatggataacgatgtagtggcagccgtaatattgggcactggtacaaatgcagcatatgtggagcatgcaaatgcaattgctaaatggactgggttactgcctaaatctggaaacatgggaattaatacggaatggggaagctttaaatacggcaagcttgctttctcagaatacgacaaagtcatggactttgaaagtttgaaccctggatagcagatatacgaaaaaatgatttctggcattgatctgggagagattgttcgtagaattttacttaagttgtcacatgacgcttctctatttggaga

SEQ ID NO: 2547 - DNA, 387 bp, Zea mays
  unsure (1)..(387): unsure at all n locations; Clone ID: LIB3228-002-P1-K1-B5
cggacgcgtgggcggacgcgtgggggaaggaggagcaagcggatttgaaaccaaggaaacgtgtccggtttgatgctaatgttaaggatcgcgagtcggatatgtttgaacgtgatgaagattctccaatggttcctcaatccatggaagtagtcacagggaaggagagcacgcctactttgtctgtgtctcctggtgtccctgactatgtaaggaacccttcaaagtacacccgttacaccctggatgtaccagagtctaatgatgactcgaacaggacggctcttgctgacctgcatgatctgttagggagatcagaccaaaacaggatacattctgagactgctgntgagattcctagctcaatcacattcatccctcgcaaaa

SEQ ID NO: 2548 - DNA, 345 bp, Zea mays
  Clone ID: LIB3228-002-P1-K1-B6
gccgtgccagaaagcaccctcgtcacctgcattgacaagtatgttggtgggaggtgaaatatcaacctgaggcaactagcatgggtgggtatgggtataccgttcttattgaactgctgttgagtagctgtatgtagataataatatgattttcactccaataaatgcgatttaaggatggcaagtcatccggatgaaaaaaaaaaaaaaaaaaaaaaaaaaaaaaaaaaaaaaaaaaaaaaaatgaatgtaccagagtttaaaagttgtcttgcaccggacggcttttgctgacctgactgatcttttagcaatgattctttcatattcaggttctatttattt

SEQ ID NO: 2549 - DNA, 163 bp, Zea mays
  Clone ID: LIB3228-002-P1-K1-B7
tcgcccacgcgtacgaccacgcgttcggtcgtggagaaaaccgtcatcgaggaggagaagtcagcgtgagcagaccatgcagaggaaaaggttgccaccgtcgccaagaccacgacaactgtggtggcgaagaaaaactccccagcggtctggaaggagaaac

SEQ ID NO: 2550 - DNA, 395 bp, Zea mays
  Clone ID: LIB3228-002-P1-K1-B8
caaagatagcatagcagcagcactcacaatagcaaaaaccaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttcctcctctaatttc

SEQ ID NO: 2551 - DNA, 393 bp, Zea mays
  Clone ID: LIB3228-002-P1-K1-B9
attctctctctctctctttcatttctatagccagcaggtagcaggcaggcaaccggccggtatattagtagatcttcgatcgttcatccaagctaataagtcagtaagcagcagtaggtcgaaaatggcgatgaggtcgctagcgctactggtcctcctcagcctgctggttgttggtgtggcgcaggcggtggagttggagatggagttggtgcctgctgatgcaattgcgatgactatggatcatgagccgccgcaggagtgcgcgaccccggtgagcgtggaggaggcgtgccgcggcgcgtcggagacgcacgccggcgtggcctacgaccactgcatggcgtcgctgggcgccgacccgcgcagcaaggaggccggcaacaagaacat

SEQ ID NO: 2552 - DNA, 84 bp, Zea mays
  Clone ID: LIB3228-002-P1-K1-C1
aaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2553 - DNA, 252 bp, Zea mays
  Clone ID: LIB3228-002-P1-K1-C10
cccacgcgtccgcccacgcgtccgcccacgcgtccgcccacgcgtccgcccacgcgtccgcccacgcgtccgcccacgcgtccgagccccatcagtgaagttggtcgcgggaggaagtttgcctcccactttgaaaacaataaacttttgtgcgggaggtgttttgccttcctggcctgtaataataccttatgcactcgtaataccctggtattgtaataataatactctctctatatatttaatgaatgt

SEQ ID NO: 2554 - DNA, 58 bp, Zea mays
  unsure (1)..(58): unsure at all n locations; Clone ID: LIB3228-002-P1-K1-C12
cccacgcgnccgaccacgcgcgcgcttttgcgtccgcccacacgggcggccacggggg

SEQ ID NO: 2555 - DNA, 258 bp, Zea mays
  Clone ID: LIB3228-002-P1-K1-C2
aattaggtatctaatgacatgcgaatctatcttcttttgttcctctccgtcatctaggagtgttgtctaaataattatatggtaaaatagttaactagtatgtttactattagagttatgtagcactagttaactagtcgttatttcttcaatttcttatatctagaaacatgtttttagttgtcaagcacttcaataatatatgtttgttttcctttattataaaaaaaaaaaaaaaaaaaaaaaaaaaaaaatatt

SEQ ID NO: 2556 - DNA, 406 bp, Zea mays
  Clone ID: LIB3228-002-P1-K1-C3
gcaaacctgcagtcatctcctccaccaccaccaccaagctcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggtgctgtacggcaggatccagtgcaagggcaagtgcaccgagcagaagggcatcacggcgccggccatgaaggtctgccaggaggagtgcgacaaggcgtacgt

SEQ ID NO: 2557 - DNA, 234 bp, Zea mays
  Clone ID: LIB3228-002-P1-K1-C6
gttcgttcctcaagtgatcttaatcgtcgagaagttaccagctagcggagatcatcggcaatgtcgaacatggggcaatccttccaggccggcaaggcgcaggcccagggcgagtgccaggcggagcgcgcagcgcagtgcgttagggacggcgccggcgccaccgcctgcgccgtgaccgacacctccggagccgatgacgtcagcgctcaactgctggtgcaccgcgccttc

SEQ ID NO: 2558 - DNA, 394 bp, Zea mays
  Clone ID: LIB3228-002-P1-K1-C7
gtgggatcgagttgtttcactgcacgagcacatcctacggcgaccaccggcctccctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggggcacctcgccccgaccggcctgatcctgggaggcaccaagtacatggtcatccaaggcgaacctggagctgtcatccgtggcaagaagggatccgggggcatcactgtgaagaaaacagggcagtc

SEQ ID NO: 2559 - DNA, 348 bp, Zea mays
  Clone ID: LIB3228-002-P1-K1-C8
cccacgcgtccgagtaccccctctgcatccgctttgccgtcaagtctggcggctaccgcatcgccgatgatgtcatccctgaaaattttaaggccgacaccacctacaagaccaccctcagcatctgatcatcctcttatgaggaataatattttgaaagagctcatctgatccatgtgccagcgagctaatatttaattttttttctatggttattttatggcaccacaccacccaagaaataagttatgttacatgtcccttcgtgcaccttgttgtgttgggttaatacggttatataaattgaaatacaatatgtatttaatatttttagagagggacaaaaga

SEQ ID NO: 2560 - DNA, 177 bp, Zea mays
  Clone ID: LIB3228-002-P1-K1-C9
gccacgcgtccgaggacccctgctggatacaatgtgaccacaagtatggcttgttgcgtggcgccgctgatgggtagccaagtaatagttatgtagcaaatatctactatgaactattattaacctgataattattgcttgaggaactatatcccgaaagagatgatgtgatccatg

SEQ ID NO: 2561 - DNA, 395 bp, Zea mays
  Clone ID: LIB3228-002-P1-K1-D1
gaacgacagttcctgagcacagggcgcgatggacgtcccggccgtggcggaccctggaacggagcgaggcgaaggcgcgctgatccagtgcccgtactgcgactcggaggcgatgcacaagctggcgcagatcctcctcccgggcctcgccgccgtctgcgtggacggcaccacgggggacccgttccgcagcccgtccgcggtggccgtggacctccgcaaggagatggtggactacatcacgcagcggagcgacagcttcatcgcggacgcgctgatcgagtcggaggcgaaccaggacgcgcccggggccgaggtgcccgacgaccccttcgagaccgtgtccgtcttcatggacgacttcgccagcaccaagcgcaacatcatcggccacg

SEQ ID NO: 2562 - DNA, 389 bp, Zea mays
  Clone ID: LIB3228-002-P1-K1-D10
tgacagccttggtattgatgtaagagccttttctggcttggaaggtaagactgggcgattttcattcaatgcacaggcgctctctgaacgttcagctgaaaagaagatcaggcgaatgcttttcccccgttaccagcgtaaaaacgtgaaagcctctactgaagatgagtcttaacctatcagctgtttttcctgagaaagcatgcaaacacctggttcaaagacaaggtgtcaagggaatcaacacgatatcatcttatgcgagtttgctagtagatagcgcacaacctgtcgactatgagaatgaccaaaagcatcagagtaataaggtttgccatgcatgggctttaacatgcttccaagaataaagttgggttttggacaatatt

SEQ ID NO: 2563 - DNA, 291 bp, Zea mays
  Clone ID: LIB3228-002-P1-K1-D11
tgacagccttggtattgatgtaagagccttttctgtcttggaagggaagactgggggatttttattcaatgcacatgcgctctttgaacgtgcatttgaaaagaagatcatgcgaatgctttttcctcgttaccagcgtaaaaacgcgaaagcctttactgaagatgagtcttaacctatcatcttttttttctgtgttagcttgcaaacacctgttttaaagacaaggtttgatagggaatctacactatatgattttatgcgtggttcgctatttatataggtgcacaa

SEQ ID NO: 2564 - DNA, 248 bp, Zea mays
  Clone ID: LIB3228-002-P1-K1-D12
ggacagcctggggatagatgaaagagccaactctggctcgaagggggagacggggagaggggcacacaacgcacaggcgctggaaaaacgtgcaactgaaaagaagagcaggcgaaggctcaacccacaagacgagcgaaaaaacgagaaagccgatagtgaagatgagccgaaaccaaacagccgagggttcggggaaagcgggcaaacacgagggacaaagacaaggggacaagggaaacaacacg

SEQ ID NO: 2565 - DNA, 357 bp, Zea mays
  Clone ID: LIB3228-002-P1-K1-D2
gaacgacagttcctgagcacagggcgcgatggacgtcccggccgtggcggaccctggaacggagcgaggcgaaggcgcgctgatccagtgcccgtactgcgactcggaggcgatgcacaagctggcgcagatcctcctcccgggcctcgccgccgtctgcgtggacggcaccacgggggacccgttccgcagcccgtccgcggtggccgtggacctccgcaaggagatggtggactacattacgcagcggagcgacagctttattgtggacgcgctgatcgagtctgaggctgaaccaggacgcgccctgggccaaggtgtccgacgactcccttcgagatcgtgttcggttttatg

SEQ ID NO: 2566 - DNA, 387 bp, Zea mays
  Clone ID: LIB3228-002-P1-K1-D3
cccgatcgccaccgccgaccggactcccctcaaaggcggccacagcacagcgagcatgggagaccggcatcagcatgggcctggcagcggcgtggaggacccggcgacgctgctgcggcgggtgcagacccgcgcgcccaactcgacgcaggtggtggggttcctgacgctgctcgtctctggcgccgtgctgctgctgctgacgggggtgacgctgacgggcgccgtggtggcgctcgtcttcctgggccccatcgcgctgctcaccagccccatctgggtgcccgtcgccgtcgtgatctccgccatcgtcgccgccgcgctctccgcctgcgccttcgccgccgccgcgctccccgtggccacctggatgtaccgctacttcac

SEQ ID NO: 2567 - DNA, 406 bp, Zea mays
  Clone ID: LIB3228-002-P1-K1-D4
cggacgcgtgggcaagatgttcttccacatcgtgctggagcggaacatgcagctgcacccacgacacttcgggccgcacctccgcgacaagctcgtttccaagctcatcaaggacgtcgagggcacctgcagcgggcggcacgggttcgttgtggcgatcacgggtgtggaggacatcggcaaggggctcatccgggaaggcacgggatacgtcaccttccccgtcaagtaccagtgcgttgtctttagacccttcaagggcgagatcctcgaagctgtcgtcaccatggtgaacaagatgggcttctttgcggaggctgggccggtgcagatcttcgtgtccaaccatttgattccagacgatatggagttccaatcaggagatgtgccgaactacacaactttt

SEQ ID NO: 2568 - DNA, 224 bp, Zea mays
  Clone ID: LIB3228-002-P1-K1-D5
gctagtcgtagaccgcgagcgccgccacatcgtacgggatcttttcatttttttgttcctatggcgggttttcatggccgtggcatcaagctggtttacaagctgatgatggacggctaggggaaaaccagcgcgcccaacggggcggaacaggcgggaacgcaggcgcaggacaaaaaaaaaagcgcgatcctggtagggacgggaaacactctcacccccgc

SEQ ID NO: 2569 - DNA, 353 bp, Zea mays
  Clone ID: LIB3228-002-P1-K1-D6
ataatgggcttggcgtgattggtgatgatggacagctaagctttccatcttgtgagatgaggtgaagtgagctgcaaggcatctgtcgaaagaaaaaggatgcaatgcaatgggtgagtttgttttctttttactcttggaattgtaaaaggtcgaagaaatttatgatgatcagcaatgggaagggaaaaaaaaaactcgttcccgttgaaaaaaaaaaaaaaaaaaaaaaaaaaaaaaaaaaaaaaaaaaaaaaaaaaaaaaaaaagaaaaaaaattttaaaaaacaaagtgtttcttatgggtaaaaaaaaaaaaaaaaaaaaaaaaagggggccccttttaaaggatcc

SEQ ID NO: 2570 - DNA, 384 bp, Zea mays
  Clone ID: LIB3228-002-P1-K1-D7
accacgcgtacgcatgacgcaaggaacacgagcgtaataaacaaatacgtgcacatacggaaactaataaatccgagggacaactcccttttacttcgacaaaccacatatagtcgagatggggatgaaaaaggtcgcctgcgccgacctcgacggcgccgactgcgccaccgtggtcctcgccgccgaggccccggcgcccgcgcccaccagcgcctactcggctgcgttcccggccgtcggcgccgtgctgagcgcctccgtgctctccttattcgcctactacctgcagtaaaattaaatgaggatcggtgggagaggctgatgggtgccattgcctgtattcgtttggatcccgttcatatatatatatatatattcaag

SEQ ID NO: 2571 - DNA, 378 bp, Zea mays
  Clone ID: LIB3228-002-P1-K1-D8
cccaaacatacgaatgacgctaaaacgcgagcaaaaaaacataaagggtgatatactgtacttgaaaattgtcaatgaaaaaaaactattatataccaaatgacactacttaatagaatatgagaatccaaacggctaaatgggtgccatttgttgtgtgtacacacgctactttccattattctacgacttgttccgttgttatgtgggaccctttcatattcccatggtggcgcttttattaaattgtgtctttaggaaatatttcgtattttcatatttatatcccttggtgaaaaaaattcttttattatatgtggcttaattttttatgtttccctctcttttttatctctttctaatacaatgtctatcttt

SEQ ID NO: 2572 - DNA, 256 bp, Zea mays
  Clone ID: LIB3228-002-P1-K1-D9
ggaagaaacggggcgacttacacgtccgacaaaaaaaaaaactaatataaaaaaactagcataaaaaaaaaagcggtaaaaaacgtgaattaaaaaattttttataaaaaaaaaataaaaaaaaaataaaactatctttaatagaaaacaaaaataaaactcccaaatagtaagattttgttgtggttaatataatattatttattataaagtcgtgaattatatttttacaatatattatttataaaaaaaacaa

SEQ ID NO: 2573 - DNA, 393 bp, Zea mays
  Clone ID: LIB3228-002-P1-K1-E10
cggacgcgtgggcagaccaagaaagcttcaataatgtgaagcaatggttaaatgaaattgatcgttatgcaagtgacaatgttaacaagctccttgttgggaacaagagcgacctaactgccaacaaagttgtggcaactgagacagcaaaggcatttgctgatgagatgggcatcccgttcatggagacgagtgccaaaaacgccaccaacgtggagcaggccttcatggctatggctgcatccatcaaggacaggatggccagccaaccagccgcggccaacgcaaggccagcgacggtgcagatccgcgggcaacccgtcaaccagaagacgtcttgctgctcgtcttaagcttgcctgatttctctggttccttgtgactattactacc

SEQ ID NO: 2574 - DNA, 403 bp, Zea mays
  Clone ID: LIB3228-002-P1-K1-E11
caaagccacaacacatacaggaaaagcaagcaagaatcatcggaataatggctcgtgcatgtgtgttcctcgtcgtgctcctcctggccgccatcgcggtggcaccgttcgcgggcgccgcacgcgtggacgtcgtggagggtaggtccatggcatccgccgatgcaccggaggcggcggccgatgctcccgctcctagccccgactccgcctcatccccagactcatcgtcagaggcgccctccagcagcagctcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattgttta

SEQ ID NO: 2575 - DNA, 398 bp, Zea mays
  Clone ID: LIB3228-002-P1-K1-E12
aaggactataggccttagttcaatgggtaatcaacatacaaataaatcttatctacagagatagacatgtgaattggtctcttgagaaggtgagttcttttgccagatggaaaatctagcatcattctgcccttttttacacataagaggtttatgagcaaatcatcaccatgtacgaaattatctattctttcgttagtttctggtcagtaggtattgggggccttcggcttccgaaggtcctcaaaaacaagatttaacagtatttttggagtataatgtgtgaacaggtatcttcggactcgaatcggtaccacagtgggagaagcccaaagaatacgaaggtcgacacagcaccgaagctgtgagcaggaaagcctcggcgtaatagcagaaaa

SEQ ID NO: 2576 - DNA, 335 bp, Zea mays
  Clone ID: LIB3228-002-P1-K1-E2
ttttaataggattcaagcttacagactcgtgcatgccacatcggggctgatgtatagcgtgaaaaaaataaaatccactcgacctacaagaacaccctcaggactggaaaaaccctgatgtgcccaacttaatgaacgagctcacatgatccatgtccccagcgagctaatatataaaattggcccgaaccgatcgttcttgccaacagtctgcgcaaacctaaatggcgaatgggatgcgccctttaacgaaccattaagcgcggatgatgcgggggtatggcaatgggacgcgcccttgatcggcgcattaaacgcggcggttgtggtggtta

SEQ ID NO: 2577 - DNA, 385 bp, Zea mays
  Clone ID: LIB3228-002-P1-K1-E4
cccacgcgtccgagcagctgcaggagatgggcatcattgatgtcgatcccaagggtggacggcgcatcacctcccagggaaggcgtgatctggaccaggtggctggaagggttgctgttgaagcttgagcaatctcatatttggtttctatgatgtcatgtttgattgttgagatggctacactttatttgcactttggattaggatttttgtgttaagagaactcaaggcattctagctatggttcacactgtattttccctgagtacctatttatcaaaacctattcgtatgtttgggaagtgtctgagctgatattcatgacatgtatttggtataggtctatctatgtgacgtgataatatcattggatagattacgatct

SEQ ID NO: 2578 - DNA, 362 bp, Zea mays
  Clone ID: LIB3228-002-P1-K1-E5
gcgcccacgcgtccgagcagctgcaggagatgggcataattgatgtcgatcccaagggtggacgggggatcaccttccatgtgtggcgtgatctggaccaagtggctggaagggatgctgttgaagcttgatcaatctcatattttgtttctatgatgacatgtttgattgttgagatggcttcactttatttgcactttggattatgatttttgtgttaagaggactcaaggcattcttatcttttgttgacactttattttgcctgagtacctatttattaaaacctatttttttttttgggaattgtcttatcttatattcattacacgtattttgtttaggatcattttatttgcact

SEQ ID NO: 2579 - DNA, 400 bp, Zea mays
  Clone ID: LIB3228-002-P1-K1-E6
gagcagtgagggccgccgctttggggacttcttcaacaacgccatatgggctcgggaatcaggccggtgaccttcgcggggtcgccgtggattcgtctgggaccgcgacgggtgagtccgagaactggggcaccgctaatcgctcgccggacgtctggcgcgctcaccaaatcactgttcgccgtggtccggtctctgcgccacccgattgccgacgagcaagccaccgtggaatctgaggttcagcaagtagagatagctgagcaggagctcattgaaggagaagaacaggtggtcgaagaggagtcgcctaacactgaggagttcgatctgatctaggtggcgtttctcagttgactttggcgccgacgatccttagttcggtttatatttatcttta

SEQ ID NO: 2580 - DNA, 290 bp, Zea mays
  Clone ID: LIB3228-002-P1-K1-E9
aaaaaacaaaaaacaacaaaaaaaaacaacgcaaacaactataaaaaaaaacaagctggcgtgctcgtaacatgcgaagttacaaagtttactcttcgcgtcgccttcgttctattttattggccctcgttttacctctcgtcgactggttataccctggtgttcccctacttaaccgcctttccgcacattctcctttggtcagctgtcgtccttctgatagggccctgaccagctggcctttctcccccttgccccctttctatcgcccttgggacccgctctgtagc

SEQ ID NO: 2581 - DNA, 393 bp, Zea mays
  Clone ID: LIB3228-002-P1-K1-F1
cccacgcgtccgcccacgcgtccgcggacgcgtgggtgtcaatcaacaaccttggttcaacactaggctcattcctgggggctgctatggcatcagctttgaacctctccacagcacagtttgacaatcttgctctgggtttgggtgtacagatgatttgtactctcttgccgattgggttcctatctctgattccaaaggaagtcacagggctaacatcataggttgaggtacgggcctgatcatacttgttctattcctgccggaaggtaatggtctgtgctcgaacctcaaatttctgactcacgtaaagcacgcatacttacagctgtgtaccagagaaaggaatatacacatcataggaaggaaattcaagatagttggaaaatagac

SEQ ID NO: 2582 - DNA, 402 bp, Zea mays
  Clone ID: LIB3228-002-P1-K1-F10
aacaaagccacaacacatacaggaaaagcaagcaagaatcatcggaataatggctcgtgcatgtgtgttcctcgtcgtgctcctcctggccgccatcgcggtggcaccgttcgcgggcgccgcacgcgtggacgtcgtggagggtaggtccatggcatccgccgatgcaccggaggcggcggccgatgctcccgctcctagccccgactccgcctcatccccagactcatcgtcagaggcgccctccagcagcagctcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattgt

SEQ ID NO: 2583 - DNA, 400 bp, Zea mays
  Clone ID: LIB3228-002-P1-K1-F11
cccacgcgtccggcttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtga

SEQ ID NO: 2584 - DNA, 298 bp, Zea mays
  Clone ID: LIB3228-002-P1-K1-F12
aacaaaaatacaaaatattaaaaaacacggctggctatctcaaagaatgcaatctatcgcacgcgtgcatttcaacatcatacatctactgtacagcatcttaatgtcaatgtactggggggcgcctctcaagggacgccaattttaaaaccccgctcttcacccaccttaattttttttaaggccacccaaatttaatctcatggcccgggttttaaaaaggtcagacctggaaaaccttgggcgttctcaactaaatggctttggaaaaaaaccccctttggaacggtggtttaat

SEQ ID NO: 2585 - DNA, 312 bp, Zea mays
  Clone ID: LIB3228-002-P1-K1-F2
gccctagcttgctcctcgatccatcaattgcaagaggagcaagataccaccaccgtagcaccacacgcaggtacgaagaaggcgacgaacatggcgaggctggccttggtagcggcggtggttctgtgcctcctgttagcgacagggccgcagggggccatcaacgccgaggggatggtgtcatttgacaatttgatcaggtgcaagggactgggcaactgcgacaagaacctgggccccgaggccttccggccaaggaaacccggcaacgacttcacccgggggtggaacccgatcaacgggttgcggggg

SEQ ID NO: 2586 - DNA, 349 bp, Zea mays
  Clone ID: LIB3228-002-P1-K1-F3
caattgcaagaggagcaagataccaccaccgtagcaccacgcgcaggtacgaagaaggcgacaaacatggcgaggctggccttggtagcggcggtggttctgtgcctcctgttagcgacagggccgcagggggccatcaccgccgaggggatggtgtcatttgacaatttgatcagctgcaaggtactgggcaactgctacaagaacctgggccccgaggccttccggccagggaaacccggcaacgactacacccgcggttgcaacccgatcaccggctgtcgcggctgatcatatatctctgggcgatgtggcgcgcaatgtcaatgttcgcacgcgcgtgcaggta

SEQ ID NO: 2587 - DNA, 396 bp, Zea mays
  Clone ID: LIB3228-002-P1-K1-F4
acggcacctaagaagctgttggcatctgattcacggctgaggcctgatagatatgccctcgagaagggtgacatgtctaagtccggggcagagaagagcaggctcgaggaacaacagagagctgagaaacgaactcgagaggccaagggcgagcaatttactcctagatggttcaacctgacagatgtggtctcccctacaccgtggggtgacctggaaatttatgaatacaacggcaaatacacagagcaccgggctgccatagaccgctccgatgtcaccgacgagacagatgtcacttcagtcaagttcagcccatggcaatatggtagctcatcttcccaatgattctccgtggccagaagccgccatgcctacgcgcattgtgtaaaacac

SEQ ID NO: 2588 - DNA, 74 bp, Zea mays
  Clone ID: LIB3228-002-P1-K1-F6
cgcaaatgcagattaaaagttctggaaccctgttggaacttgctctcctaagcgagttgatccaactgaggagc

SEQ ID NO: 2589 - DNA, 391 bp, Zea mays
  Clone ID: LIB3228-002-P1-K1-F7
gcgaccccttggctcgacggcaagcacgtcgtcttcggccaggtcggcgagggcatggacgtcgtcaaggccatccagaaggtgggcacccgaaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagattaatttagcggtttacgtgtggatctgtgaaccccatggcgcctctgcttgactcgaggttcacctggtatgttctgagattcatgataatgctatgagaactgaaattc

SEQ ID NO: 2590 - DNA, 366 bp, Zea mays
  Clone ID: LIB3228-002-P1-K1-G1
ccactggattttctgggtgggcccgctcctgggcgctgccatcgcggccttctaccaccagtacatcctccgggcgggcgccatcaaggctctcggctccttcaggagcaacgcgtgatgagcagagctaaagaaaggccttcgctggactgcgtgctggagcgacggcgatcgatcgatctagcgtggggagaggcggataggcgggcgcgcgagggaggagaataagtttgtgccggtggcccggtctcgtcggtcgcttttgttccagcatgcagctgcgtcgcgttcgtgtgcgtgcgtgggggtctccttaatttccccggcccctgtaatcatcaatcaccatgtgtgcgtataatatct

SEQ ID NO: 2591 - DNA, 340 bp, Zea mays
  Clone ID: LIB3228-002-P1-K1-G11
tcccgcttgattgggcgtgggctgtctacttaatcccagacttacgagggcctgcattcgacgtgataaattttttataggagtacataaattgcattcaggggcccgcggtaaacaagggcgcgtctgatacaatccacttgttacacaagtacgtgaggtaccagcacatgcgctgtttcaccgttggcgtaataggtaaaaggagcggacacatggctctttccaacagttgctcgatcagaatggagaatgtgacgcggccatgttctctgtattaagcgcgacggttattttggttacccgcattgtacaccgtacatttgtgcagaccctaggg

SEQ ID NO: 2592 - DNA, 401 bp, Zea mays
  Clone ID: LIB3228-002-P1-K1-G12
gtttttaataatgaagacatgtctaacgaaggttgctttcgtgcagagtatgctgttgagcaaagctttaaaaatgcagcaagatctggaagacaagaaacacgaggttataattgaaaatttagaaagcaaaataaaagagcaatcagctactattgaaaagaagaacttcgagcttcaagcaactgaaggcttactggcggaagccgaagctaaaataacagaactgaacatgaagcttctctgccaatctgaacagtttgaacaagaaaagcaagaacttactgcaaaacttgaagccgaagtccaacaaaattcagatttgaaaagactattggcgggccttcaagacaaatgtttggaatttggcaacaaatgtattcaacgactgagaaaaattt

SEQ ID NO: 2593 - DNA, 281 bp, Zea mays
  Clone ID: LIB3228-002-P1-K1-G2
acaaacaatacctctctagctcgccaccaacaatggcctctaggttctccatcatgctcgccacaacggcactggctacgttttttgtgattggttcgtgcaccaccccgctcaccttcaaggtcggcaaaggctccaagcctggccacctggtcctcacccccaacattgccaccatctccgaagtggagatcaaggagcacggtggcgatgacttctcctttgagctcaaggagggcccggccggcacctggacgcttgacacaaaggccccactcaag

SEQ ID NO: 2594 - DNA, 400 bp, Zea mays
  unsure (1)..(400): unsure at all n locations; Clone ID: LIB3228-002-P1-K1-G3
ggacactggtctttttggtgtctatgctgttgctaaggctgattgcttggatgatttggcttttgcaattatgcatgagatgagcaaattgtcataccgggttacggaagaagatgttatccgtgcacgtaatcagctgaagtcctctatccaactccaccttgatggttcaactgccgttgttgaggacattggccgtcagctgctgacctatggacgaagaattcctacccccgagctttttgcaagaatagatgctgttgatgcaagcactgtgaagcgtgttgcaaaccgcttcatctttgatcaggatgttgctattgctgcgatggggccgatccaaggacttccagactacaactggttcagacgccggacctacatgnctccgtactagatt

SEQ ID NO: 2595 - DNA, 392 bp, Zea mays
  Clone ID: LIB3228-002-P1-K1-G4
acaaaagcaaaaagcatcatcacaataatggcccgcgcgtgtgtgttcctcgtggtgctcctcctggccgccgtcgcggtggcgccgtttgcgggggctgcgcgtgtggatgtcgtggagggcaggtccatggcgtccgccgacgcgcctgaggcggcggctgacgcgcccgctcccggtcccgactccgcctcatccccggactcgccgtcggaggcgccctccagcagcagctcatccgactagccgcgcacaacgcagttcttgtcatgatctatctagcaaataaaaagatcatatgtctcggttgattctctggaataactaatagtatatatgctgcgcccggatgatatataaatatgtgcatcaaatgcgtgcggcaaacgcat

SEQ ID NO: 2596 - DNA, 398 bp, Zea mays
  unsure (1)..(398): unsure at all n locations; Clone ID: LIB3228-002-P1-K1-G6
cttctccgtcccgcctcggcactcgacggccgccggcacacaccgcgcagtctcgagacagatcccgatctcgttctgccaaccgccgagggagggttgcgctcgccggatcccgcccgagtcacgtgcggctttgattcgctgcacctgtcgtgcaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcggnggcctctacatcggcgtcgagcagctcgtgc

SEQ ID NO: 2597 - DNA, 276 bp, Zea mays
  Clone ID: LIB3228-002-P1-K1-G8
ccacgcgtccgcccacgcgttcgcccacgcgttcgaccatacatatgcggacatgtgaatggatacgtgtccaataactaaaacgaaacctaattacaatgggcaaattttttatatgccagcattatgacataaaagcatgtggtaacctatttaaatgtattttgcagaatatttacattttgataactatcgtacttgttttaaagtacgtagaaattaaatttaagaagaagattgtaacaagaatgaattaatgatactctatgtttatag

SEQ ID NO: 2598 - DNA, 360 bp, Zea mays
  Clone ID: LIB3228-002-P1-K1-G9
tcattcgtccgcacacgcgttctctaatttgtttggtcttacgagtgcgattatgcaaatatacatgactatcaacaaattaacatacctgaatacaaaagacgatgtttttattccacgttatgagatgaaagcctttgtaaaactctaccatgatgttgcaactagcttagatgacgacatttgtcgtaattgtgtaacctaaggaagaaaaattacttccctcgaggtttgttacagaattgaatctgtagacgctatcactctaaaacgttttacaaacgggttaatatttgataaggactgtgttattgatgctatggttccgttccaacggcttgcataattcaaatttgttaa

SEQ ID NO: 2599 - DNA, 409 bp, Zea mays
  Clone ID: LIB3228-002-P1-K1-H1
ggacatggaattggcaacagaagaggccctaaagagggcagagatggctgaggcagccaaaaaggctgtagaaggtgagctcaagagatggcgcgagaaggagaagaaaaccgcagaggctcagccgtcggcaggggcagaagaacttggaagtggatcgcctcctgtacctcagacttcagctgggaaagcttctgagaagaacgacgggcataggaacagcagaacgctactgaggaggagcttcatgctgccaaacatcacgagcatgttccataagaagaaaaaccaacctggcagcagttctccctcctaccttcctggggaaaaatctgggtaatctataagacgctcttgtctgtgaattgaaatttccaaacttgaacgcatgcttttacattataatctg

SEQ ID NO: 2600 - DNA, 408 bp, Zea mays
  Clone ID: LIB3228-002-P1-K1-H2
gcgggacatggaattggcaacagaagaggccctaaagagggcagagatggctgaggcagccaaaaaggctgtagaaggtgagctcaagagatggcgcgagaaggagaagaaaaccgcagaggctcagccgtcggcaggggcagaagaacttggaagtggatcgcctcctgtacctcagacttcagctgggaaagcttctgagaagaacgacgggcataggaacagcattatgctactgatgaggagctttatgctggcaaacatcacgagcatgttccataagaagaaaaaccaacctggcagcaggtttccgtttctacctttctggggaaaaatctgtggaatctataggaaggctcttgtctgtgaatgggaatatttcaaacttgaaacgcatgcttttacatt

SEQ ID NO: 2601 - DNA, 249 bp, Zea mays
  Clone ID: LIB3228-002-P1-K1-H3
tcaccttcaggccggagccggcatagtcgccgatagcaagccggatgacgagcaccaggagtgcctgaacaaggctgctggggctgctcgcgccattgacctcgccgaatccacgtttctccaagagtagtcgcctaggcctagctatagtccggaactatgttgttagttgattatggattattgtacctggaaaacaatatatatgttttatttatttacttggttgaataaaaactcgattgtaat

SEQ ID NO: 2602 - DNA, 74 bp, Zea mays
  Clone ID: LIB3228-002-P1-K1-H4
aaaaaaaaaaataaaaaaaaaaaaaaaaaaaaaaaaaaaaaaaaaaaaaaaaaaaaggaaaaaaaaagaaaaaa

SEQ ID NO: 2603 - DNA, 62 bp, Zea mays
  Clone ID: LIB3228-002-P1-K1-H5
tgcgtttaagcctcttatgcactaggttgtgagttcgagcccccacaactacacattttttt

SEQ ID NO: 2604 - DNA, 385 bp, Zea mays
  Clone ID: LIB3228-002-P1-K1-H6
taaatagttcgtgaatccctgaagcgtgcttatttttattcctgccaagataaaggtaatggagtcgtaacgcaggttccagccggccggaatcctgtttttcctgttaattgggtccaccgatatggcacaggcaagggaatgcaagaggcacagaggcgatttgttgggcatgcatgatcgaacacatctgcgcaatgtgtgccgggagaggctttttggcgagatgacaacattttccgccctgtatatgactataggagtgaaaagagcgctgatcgctctcatgcatatcaacatattattaataacagcgattatttcgttcttatttatgacgaatgacatgtatgttctggtgactgtcatgtatattctgatgact

SEQ ID NO: 2605 - DNA, 62 bp, Zea mays; identical to SEQ ID NO: 2603
  Clone ID: LIB3228-002-P1-K1-H7

SEQ ID NO: 2606 - DNA, 390 bp, Zea mays
  Clone ID: LIB3228-002-P1-K1-H9
cccacgcgtacgcccacgcgtccgaccacgcgtccgcggacgcgtgggtttttacgcatgataacgcggattaccatttctcaaagatcagatcaaaacatggatcaagatccaacacgtccatgtacaaaaactagccactacacatcacgcgagggggctcccgattattcgacttgctgcacgggtccaattcagttcatcaccatacacgcatgcatcgtggcgcacgccactcacgagcgcggcgcccatgcgcccacaacttattacgactcgtcaccaaccaaccaaaccaagccacccagcaggtccagtccaggcgtgtgtgctgtgctctcctctaccggccgccggccacatcacgccggcgaggcgcccttggcgtcg

SEQ ID NO: 2607 - DNA, 429 bp, Zea mays
  Clone ID: LIB3228-003-P1-K1-A1
cccacgcgtccgcacgtggtgaacaacgactacacgcactggatcatgtacgccatcggcggcaacatgaaccccaccatcatcagccagggcaaccgcttcatcgcccccgacgaccccaacgccaaggaggtgaccaagcgggagtacacgccgtacaaggactacaaggagtgggtgtggaagtcgcagggcgacgtcatgatgaatggcgccttcttcaacgagtccggcggccagaacgagcgcaagtacgacaggttcgacttcatcccggccaagcacggccgctacgtcggtcagctcacgcgcttcgccggaccactcaagtgcatcgtcggccagccgtgctagtagacagcggcccggtcgggcacatactcctctttctatatacatccgatttggatgggcggcatatatgtacgt

SEQ ID NO: 2608 - DNA, 426 bp, Zea mays
  Clone ID: LIB3228-003-P1-K1-A10
cacattcaagaacctactcgcctcctacattgaccaacaactaagcctccgtgaccgccacatctattaggtgcagccatgggtgcctgtgcaacgaagcctaagacgcttgaggggaaagccccagctgaggccaccatctccacacccaaggttgcacctgagaccactgccatccacattgaggttgcggcgaaacaggcagtagttgagaaggtggaggaggacaaggaggaggcactaacagtggcggcgaaacaagagccagcagccaccatcgagcctcaacagattgctggtgaggtgaccacttcggaagtggcggtcgtcgttgtcgagcctgagaacaaagaggaggaggaagttgtggagaagaccgtcatcgagaaggagaagccatcagcagtccatgaagaggaaaatatc

SEQ ID NO: 2609 - DNA, 424 bp, Zea mays
  Clone ID: LIB3228-003-P1-K1-A11
cgcaacacacggaaccagaaagcaaacgcaaacaagaagcaaaccagcaatggcccgcgcctgcgtcttcctcgtcgtgctcctcctagccgccgtcgccatggcgccgttcgcgggcgcggcgcgcatcgacgtcgtcgagggcaggtccatggcgtccgcggacgcaccggaggccgccgccgacgctcccgctcctgctcctggccccgactcctcctcgaccccgtcgccggcacccttcagcagcagctcttccgactagccgcccggcagagatatctacggcgtccgatcagtctttggcgccacctataacctatcggatcctgcaaagctatatatgattctatggtataatgtgtggttgcggcaaacgcgcggaaataatgtgcttgcgtgagtgggtttctctctctttttt

SEQ ID NO: 2610 - DNA, 325 bp, Zea mays
  Clone ID: LIB3228-003-P1-K1-A12
cagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaagcgaagaagatccaggacgacttctgctcgacgctgtgcgagggcaagaaggggacggacctggtcgtgtgcaaggagtcctgcgcgctcttccagcagtccaacctggtgctgtacggcaggatcccagtgcaagggcaagt

SEQ ID NO: 2611 - DNA, 407 bp, Zea mays
  Clone ID: LIB3228-003-P1-K1-A2
acgagtccggcgggtacttcttgaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatccacgagaccacctacaactccatcatgaagtgcgacgtggatattaggaaggatctgtatggcaacatcgtcctctccggtggtaccactatgttccctggcattgctgacaggatgagcaaggaaatcaaccgcctggctcctagcagcatgaagatcaag

SEQ ID NO: 2612 - DNA, 390 bp, Zea mays
  Clone ID: LIB3228-003-P1-K1-A4
cccacgcgtccggcgagaaggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagttcgatggtggacgtttattctatttattggcttacttgattttttttcccctaacaataagaaaacgcacgtgctggcatgtacgttgtgttgtatatgcttttcttgctggcttcatttgctgattactgatgagttgtaaggtccctgcacgatccatttcacatggatatgatgcttaattgtattcctgcttatatggtatctatatttaattaatt

SEQ ID NO: 2613 - DNA, 292 bp, Zea mays
  Clone ID: LIB3228-003-P1-K1-A5
cccacgcgtccggcggttacctgccgctgactcgctctagtggtgaggacctgctgcagtggacgtctgccgtggacgtggtggcggagaggggtgctggcggcgagcgacggcggagcagccatggaagcggtgcagacggtacgcgatctaatccgccttttcctcgtttcttcaatcttgtcccacgcgcgcgtggacatgtctaggcatctagccgcttgatcaattattccgttgtttgtatgcgtgggaacatgatcctatttattactttccgcgttgcttgcgt

SEQ ID NO: 2614 - DNA, 218 bp, Zea mays
  unsure (1)..(218): unsure at all n locations; Clone ID: LIB3228-003-P1-K1-A6
cggacgcgtgggcggacgcgtggggcgtcgaccgcaacggcgacggcctcgtctccttcgacgagttcaagctcatgatnggccgcggcggcggcgtcggattcggcaggatcggtgcctaggaacaaggatcctgtgcctgtcctgctttgcctctgttttgctccgttcccacaaattgtgattctttcattttatgtgtgcacatatactacact

SEQ ID NO: 2615 - DNA, 80 bp, Zea mays
  Clone ID: LIB3228-003-P1-K1-A7
ccacgcgtccgagcaaatcgtgttaagatgttgccgtttgtcattctatagcaagaattccatgacaaagattgcttggc

SEQ ID NO: 2616 - DNA, 383 bp, Zea mays
  Clone ID: LIB3228-003-P1-K1-A8
acgagatgtcggcgaccactgcagcggtgcccttctggcgggcggcgggggggagctacatcggctactgcaacatctgcgctgcgctggtccggaactgcctcaaggagcccttcaagtctgaggccgcgtcccgcgagaaggttcatttctccatttccaagtggacggatggcaagcaggagaagccaactgtccgcacagaatcggatgactaagggctggcgcgccatggcgacatagtccttcctacagatgatttgaagcgttgttgcaagtttctgagacttgttatttagttggcttgatttgtaatcaatgctgaagaataaatactttttgcgacaatggtctttttacaaagtcgggttggtttcgttgct

SEQ ID NO: 2617 - DNA, 321 bp, Zea mays
  Clone ID: LIB3228-003-P1-K1-A9
gacatagatcatgcgcggactgtatagaatggccaagactgcgtaccacggcctgcgacggtatgaccagtgtatagtataacatataatggagatactggcccttgttcaacaacgcaatgtcatgtagaacctactaacatcccaacatatgttgctgtgctcgaatccaatgttacgccagcttgcactgtagcaagcatgcgcagaccaatgggatcttgcatctgttgaacatcctgaatggaaacagtgacgcgccgttgaacgtgtcaacaaacgcgatgcttgtgaagcactccctcagttggaccgatacac

SEQ ID NO: 2618 - DNA, 374 bp, Zea mays
  Clone ID: LIB3228-003-P1-K1-B1
cgaacacacgcagggcgcgcataggcgaggcgagggcccccgcgagggatggtgtggtcggctgggatggcaatgcgaggcgcctccgccgcgctgctcgtgctggcgctcgtcgccaccgtggcgcgcgcggaggacccctaccacttcttcgagtggaaggtgacgtacgggacgaagaccatcatggggacgccgcagaaggtgatcctcatcaacgacatgttccccggccctaccatcaactgcacatccaacaacaacatcgtcatcaatgtcttcaacatgctcgaccagccgctcctcttcacctggcacgggatccagcagaggaagaactcatggcaggacggcatgctgggcaccatgtgccc

SEQ ID NO: 2619 - DNA, 422 bp, Zea mays
  Clone ID: LIB3228-003-P1-K1-B10
gtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcggtcttatttatgacgaatgtcatgtatgttctggtgactgtcatgtatattctgatga

SEQ ID NO: 2620 - DNA, 406 bp, Zea mays
  Clone ID: LIB3228-003-P1-K1-B12
cccacgcgtccgtgcagcagcatccatcgcgtgcgtacattaatctaagcgatcttcatccagccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattc

SEQ ID NO: 2621 - DNA, 416 bp, Zea mays
  Clone ID: LIB3228-003-P1-K1-B2
cctgaacctgaacaacaagggcgacagccttactggagcctactatcacaaggtgagcgaattgaccaacacagctgttggggcagagcttacccacagcttctcgaccaatgaaaacaccctcacctttggcgggcagcacgccctggacccactaaccgtcttgaaggcccgcattaacaactctggcaaggccagtgccctgatccagcacgagtggaggccaaagtcgctggtcaccatctcggccgaggtcgacacaaagaccatcgagaagagctcgaaggttgggattgctgtggccctcaagccctgattggttatacagaccatttttccccttctaagttcctagcatgactgtttgggtcagatcagatcagctggggaaaacaaaactgttggggttcctggca

SEQ ID NO: 2622 - DNA, 403 bp, Zea mays
  Clone ID: LIB3228-003-P1-K1-B3
atgatgcgctttctgagtgtctgaagagaaacctctatgtgcccacaacttcaagcagcaatgaagatggtgacatcaaatgcatcatatgtctggaggagtactcttctggtgtggaggtggccaagatggcatgcgagcattactaccataccacttgtatccaacagtggcttcagcaaaagaactggtgcccgatttgtaaatgtgacgcttctgccattagctcatagtgttcttgacagtaacagaagtatcagttcattgtaatcaaataggattacacaagtttttttggttctagaacaaattattcacttcaatcctatactgctcttcaattcacactacacttgtcataggaagcaggaaaataagtcctagaagaaaggattttctcaaa

SEQ ID NO: 2623 - DNA, 384 bp, Zea mays
  Clone ID: LIB3228-003-P1-K1-B5
tatatatcttttagatttcaacttcctcgactacttttttaggtaggtcgattggggtttgtaggtgaagtgtcgatttgtctgtgagagtgagaccacatgaagctagagagagaagatgccaataagctattcaggctgccgctgcttcgtgcttccgttccactggccgggtggcttgattgtttatgcagacttggctaataagctattcagaaaaaaaaaaaaaaaaaaaaaaaagaaataataacacaaaaaaaacaaaaggctgcccgttttaaaaaaatccaagttaaagaacgcatacaagcaaaaaaaaaaaattttccccaaaaaaaaaaaaggggggggcccttttaagggaccaaaattttctccccgggg

SEQ ID NO: 2624 - DNA, 393 bp, Zea mays
  Clone ID: LIB3228-003-P1-K1-B6
taaaaaaaaaaaaaaaaaaaaaaaaaaaaaataaaaaaaaaaaaaaaaaaaaatagaggggggataaaaaaagagggaggagatacataaaaaaaaaaaaaaaaaaaaaaaaaaaaaaaaaaaaaaaaaaaaaaaaaattatgggggggccccttttaggggtccaaattttccttccccttctttggaagtaaatattttttttttggggcccccaaatttaatttcccgggccgggtttttaaaacggggggttgggaaaaccccggggttacccaaatttaattcctttgaaaaaaatccctttttccccggtggggttaataaaaaaggggccccccccttttccctttccaaaaatttgcccccctttattgggaattggcccccccc

SEQ ID NO: 2625 - DNA, 345 bp, Zea mays
  unsure (1)..(345): unsure at all n locations; Clone ID: LIB3228-003-P1-K1-B8
atcaaaaccggtaacatctgatgatatacattcattcttcgagaatcttgctaagaagaagaaacagaggttatcttagcttttgtgaccgcatcggaccccacctgaggcaatcgttctgctggacagaggtcctagtttgttgggctagtaaatgtaatgttatcttaggtggtacttactaatcgggccagtaatgttgaattctagctggaacgcggtaatgtttgatgcaccgaagtcgcttgcagtaggttccgatggcccaagccaccaaaaacttgtttgctccatgaacctcgcaatcctgttaggtgataatataatatacattgtggtggccna

SEQ ID NO: 2626 - DNA, 429 bp, Zea mays
  Clone ID: LIB3228-003-P1-K1-C1
cccacgcgtccgcggacgcgtgggtggtggcgcactccggtgagccctctgcgtcaagagttctagtgtcccatctcacagatggctcggtactattcgacatacggagtatagcgaataaatggaggtgaagtttaccggtaataatgggttggtgaaggcggttcacggagcaaggcgagatcgcggcgtgataggattccggcgaggaattctgctcgtcccgggctccaattcacatcggggcggtgacgatttcacaccagggaacacttcgaaggtctctgggctagcctcgcgcttcaatctgctacacaggcgaagagcagatgtggcgactctccttctctcttttcgcagtgctggcacggtagtttggataggcgcggtcaagggtgtccagccctactgtaaccctctgaattgggg

SEQ ID NO: 2627 - DNA, 56 bp, Zea mays
  Clone ID: LIB3228-003-P1-K1-C10
ctgttggatggtgtaacaccctgaattttagggtataaaatttcttctctgggagg

SEQ ID NO: 2628 - DNA, 400 bp, Zea mays
  Clone ID: LIB3228-003-P1-K1-C11
cattcaagcacctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggcagcagcccatgcagaggaaaaggtcgccaccgtcgtcgagaccacgacg

SEQ ID NO: 2629 - DNA, 406 bp, Zea mays
  Clone ID: LIB3228-003-P1-K1-C3
aaaaaccttggatttgctgcgatcgatgccttcccttgttgatgtggatgttccgaacggtggacattttacagtttgcggtgatgtgcatggccagtactttgatttgctcaacatatttgacctcaatggccttccatcagaagaaaatccttacctcttcaatggcgattttgtggaccgaggatctttctccgttgaagtcatactcaccctttttgctttcaagtgcctctacccaaaagctatgtaccttgcaagaggaaatcatgaaagcaagagcatgaacaaaatatatggctttgagggggaagtgaggtcaaagctgggtgagaagtttgttgaactttttgctgaagtcttttgttggttacctcttgcccatgtcatcaacaacaaggtcttt

SEQ ID NO: 2630 - DNA, 403 bp, Zea mays
  unsure (1)..(403): unsure at all n locations; Clone ID: LIB3228-003-P1-K1-C4
atcgcgctcggctccgccaagggcctcgcctacctccacgaggactgccatccgcggatcatccaccgcgacatcaaggccgccaacatcctgctggacaacaacttcgaggccatggtggcggacttcgggctggccaagctcacgacggacaccaacacgcacgtntccacgcgcgtcatgggcaccttcggctacctggcgccggagtacgcgtccagcggcaagctcacggacaggtcggacgtcttctccttcggcgtcatgctgctggagctgctcacggggcgccgccccatcgataccaccaactacatggaggacagcctcgtggactgggcgcgcccgctgctgagcgccgcgcttgcgggggagaccggcttcgccgagctcgtcgaccccc

SEQ ID NO: 2631 - DNA, 409 bp, Zea mays
  Clone ID: LIB3228-003-P1-K1-C5
acttctcacccctcgcatccgtctccttcgcgccctcctccccgctcgccgtcgcctcgctcgcgcccttcggccagggccccggcaacaccaccacgatcgccttccgcctcgtcgtagaggatgcctacgtcgggcccgacgacgccgcagcgctcaagaccggcgccgggggcgctgtcgacgtcgaggtcaggctcatggccgttgccgtcttcgacagaggtggctggcgcacgcgccggagggtcatgagggttatgtgcgatggcgtcaaggtggttttccgcgggaagaattccactgaggcggccttcgatgggccgccaagaaggtgcgatgtcgtgttgtgaaagagttaaggatcatcataacaggtttgctgactactctggatgctgatcggggg

SEQ ID NO: 2632 - DNA, 395 bp, Zea mays
  Clone ID: LIB3228-003-P1-K1-C6
cagagctcgtcgccaccggccaccgccaccctcgatcacgccgtccgtcgaggtaagggcagcatggtgagggtcagtgtgctcaacgatgcgctcaagtccatgtacaacgctgagaagattggcaagaggcaggtcatgatcaggccgtcatccaaggtcatcatcaagttcctgacggtcatgcagcgccatggctacattggagagttcgagtacgttgatgaccaccgatcgggcaagattgtggtcgaactcaacgggaggctgaacaagtgcggcgtcatcagccctcgctttgatattggcgtgaaagacatcgagggatggactgcaaggctgctcccgtccaggcaggtcggatacatcgtcctcacgacttcggcaggcattat

SEQ ID NO: 2633 - DNA, 66 bp, Zea mays
  Clone ID: LIB3228-003-P1-K1-C7
aaaaaaaaaaaaaaaaaaaaaaaaaaaaaaaaaaaagaaaaaaaaaaaaaagggagggaaaaaaaa

SEQ ID NO: 2634 - DNA, 395 bp, Zea mays
  Clone ID: LIB3228-003-P1-K1-C8
cccacgcgtccgcaagagaatttcacaacttttgcatgagtctctgatggtagggacatctttgaaccctaaaattggctatgacaatgctgcagctgttgctaagaaagcccacaaagaaggaaccacgttgaaggaagctgcattagaccttggagtattaacggagcaagaattccatgagcttgtcgtcccggagaaaatgattggtccttctgattgataaccccatgttcactatgtttctttgaagcattcaagttgccacatccgcgagttctggtggccctgtgtttccaaggtaatgattctagcgcacccataaataaagcaaataatttttcatatggtcattaggtcctcaccgtaccgcactagagaaatgatttttgcat

SEQ ID NO: 2635 - DNA, 360 bp, Zea mays
  Clone ID: LIB3228-003-P1-K1-D10
cccacgcgtccgcaccagcgccaggacgccaagaggcagcaccaccgcgcggggcccaagcaggcaagcaccactgactcaccaggccaccaccccaccgctttttgccgagggagaaggcggcgcggggcggcgcgctcaggtcggggatgaggggggggtccagaccgggctcggtcgccctgtttcttctcgctgcgtgcgggatctgggcccagttcaccgcagagctagctggtgatcctcaaacattcaacgacgataagaaggctggagctcagcccaagggccatactggcaagacagatttgttcgttcttctaggagtgggggccggcggtctcgtgtcatttttcattt

SEQ ID NO: 2636 - DNA, 312 bp, Zea mays
  Clone ID: LIB3228-003-P1-K1-D11
tccacgctttcttactattgccagtccaacaatgggcagcaccaccttgccggtggcaagcatgcggggacgtcttacccaccatttcattaccccaccgtttctagctgagggagaagtctttactttgcggttcgctcaggtcgtagattaggtgcgtttccagacagtccttagtcgcctctgtttcttctcgctgcgtccggtatcttcgctcattttaccctatttcttgctggtgattttcaaacaatcttcgactataaatattgctgaagtctatctgatgggcgggggtgtcatgacaatttt

SEQ ID NO: 2637 - DNA, 399 bp, Zea mays
  Clone ID: LIB3228-003-P1-K1-D12
cccacgcgttcgcggacgcgtgggcgaatcagctccggtcggcgacgctgctgggcgtccccgacaaacttgccaagcctctggcgtcgctgcccgccgataaggtgcggccggcggtggagaaccacgtccttctcagttacttcgaccccatcaagctggacgagatgaagacacgcaccgccatcctccccacgctgctctccgtcaccgacaagaaactcggcgtcctcaactacaccagggccgacgacgggcagatgtacttcggcgctcccggcgccccctgcgtggccaagctcgtgaaggtcgtcgcagcgcggccgtactctgtgtccatcatggagatcagcgagcccattttgccggccgcgttggcctcccccgtcgcggcgcccg

SEQ ID NO: 2638 - DNA, 412 bp, Zea mays
  Clone ID: LIB3228-003-P1-K1-D2
cccacgcgtccggagagacgcacatctatctgtcaagcgacgccgcggcctcgatcagagtcggaggcgaacacccccatggcggcggctggcggcggcgcaggagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatcaacccccagcaaagtgcaggcaacgtgtttctgaaacatggttcggagctgcgtctcatccctcgcgatagggttggagctgtagtcatgtcttccggttagaggatatatacaggccaatgcataatgagcaaaactt

SEQ ID NO: 2639 - DNA, 427 bp, Zea mays
  Clone ID: LIB3228-003-P1-K1-D4
ccaatctagccaccaaggcaccaaccaagagccatggcatccccgttctgcgccgctgccgccgcttgccgccttgccgtccccgccccgtcccctcccgccgcacgggcgcctaggccccgacgcggcctggtggcggtgcgcgcggaggcgggcggtgggataaacccggccatccggaaggaggaggacaaggtggtcgacaccgtcctcaccggcgagctcgccaagccgctcaccgcgtactgtcggtgttggagatcaggaacattcccactgtgcgatggatcccatgtgaagcacaacaaagcaaccggtgataatgtgggccccctgctcgttaagaagtagatgcagtttcgttcgacttttgccctagcatcatgttgagcgctgagctgaacactatctgtctggcatgatatat

SEQ ID NO: 2640 - DNA, 389 bp, Zea mays
  unsure (1)..(389): unsure at all n locations; Clone ID: LIB3228-003-P1-K1-D5
cccacgcgtccgcccacgcgtncgcggacgcgtgggcgagagaggaacgcgaacagccaacgatcgcctcatcgccatggctcgctctgtccccatcgccgtcgccgtcgcgcctctgctcctgctcctcctcgtctccactgcgtccgctgcacggaccgtgggcgacaccgtgcaggacgcgtgcagcaagacacaattccccaagatctgcgtggacaggctcgccgcaaagccagagagccagaaggcgaccccgcgccggctggcggagctgttcgtgaacatcgcggccgagaagggatccgggatggccacgttcgtgcacgggaagtacaacaacgccaaggacagcaccgtgttcaagtgctacgacagctgctcggacg

SEQ ID NO: 2641 - DNA, 397 bp, Zea mays
  Clone ID: LIB3228-003-P1-K1-D6
cccacgcgtccgcggacgcgtgggccgtcaacaaaacaagtgcacacaaataaatacctggctcgctagattgccaagagcaatggcctttaggtcatccatcctgctcgccatggtggcgctggctacgctattcgcggtcggttcatgcaccaccccgctcaccttccaggtcggcaagggctccaagcctggccacttggtcctcacccccaacgttgccaccatctctgacgtggagatcaaggagcacggtggtgacgacttctcctttacgctcaaggagggtccgactggcacttggacgcttgacaccaagaccccgctcaagtatcccctctgcatccgcttcgctgtcaagtctggtggctaccgcatcggcgacgacgtcatcccc

SEQ ID NO: 2642 - DNA, 362 bp, Zea mays
  Clone ID: LIB3228-003-P1-K1-D7
acgagaggaggaccccatttctattattgggataacagaaatacaaagtggttcagatagtttccacactaccaacgcaaaataacaggaagaacccgcaaacagaagcgctgacgagccaatccgcttcggatgactcagaacagccgggtcccctaccaggcaacatgccaaccgacgagtttagagttttacatcacacaagtaccagaccatacgacataacagacagcagcaaaatagagcgagttcctgacaaagctaacaccaggcgagcagtcacgtcatgactcaacgcccgtgtggctgcagcattcctttcatctcatcgcccgacccgaggatccaattttctctagcac

SEQ ID NO: 2643 - DNA, 409 bp, Zea mays
  Clone ID: LIB3228-003-P1-K1-D8
cccacgcgtccgcaccagcgccaggccgccaagcgccagcaccaccgcgccgcgcccaagcaggcaagcaccactgacccaccaggccaccaccccaccgcttcgagccgagggagaaggcggcgcggggcggcgcgctcaggtcggagatgaggggcggatccagacgggcctcggtcgccctgtttctcctcgctgcgtccgggatctgcgcccagttcaccgcagtgctagctggtgatcctcaaacattcaacgacgataagaaggctgaagctcagcccaagggccatactggcaagacagttttgttcgtcctcctaggagtgggggccgtcgttctgttgtcatttttcattttcaagtattggcagaagaagaaaagggaggaacaacatgcacgtctact

SEQ ID NO: 2644 - DNA, 411 bp, Zea mays
  Clone ID: LIB3228-003-P1-K1-D9
gcgcagggccgcgcggacgcgcgcgaggccacggggttcgtgctccagaagtgcgagttccaggccgaggccgcgctccgggactccgggcgcccgcccatccgcaactacctgggccggccgtggcgcgagtgctcgcgcaccatcgtcatggagtcggagctcccggacttcatcgacaaggcggggtacttgccctggaacggcgactttgggctcaagacgttgtggtacgccgagttcggcaacacagggcccggcgccaacacggcggggcgcgtcagctggccggggttcaagaaggtgatcagcaaggcggacgccaccaagttcacggtcgagaacttcctgcacgcccagccatggatcgatcccacaggcacgccggtgaagtacgacctgttcacatga

SEQ ID NO: 2645 - DNA, 407 bp, Zea mays
  Clone ID: LIB3228-003-P1-K1-E10
cggacgcgtgggcagaccaagaaagcttcaataatgtgaagcaatggttaaatgaaattgatcgttatgcaagtgacaatgttaacaagctccttgttgggaacaagagcgacctaactgccaacaaagttgtggcaactgagacagcaaaggcatttgctgatgagatgggcatcccgttcatggagacgagtgccaaaaacgccaccaacgtggagcaggccttcatggctatggctgcatccatcaaggacaggatggccagccaaccagccgcggccaacgcaaggccagcgacggtgcagatccgcgggcaacccgtcaaccagaagacgtcttgctgctcgtcttaagcttgcctgatttctctggttccttgtgactattactaccgtttgtgcgagcac

SEQ ID NO: 2646 - DNA, 267 bp, Zea mays
  unsure (1)..(267): unsure at all n locations; Clone ID: LIB3228-003-P1-K1-E11
ccaaaaaagcttcaataatgtgaaacaatcncaaaagtgtatttatcacatattcttttacaacattaacaagctcctagttagtaacaatatctacctaacttccaacaaatttctatcaacttatacatcaaatacattttcttattaatatttcataccatacatttaaactaataccaaaaacaccaccaacttataacattccatcatatttatctatacttccatcaaatacagtatctccatacaaccattcactatcaa

SEQ ID NO: 2647 - DNA, 424 bp, Zea mays
  Clone ID: LIB3228-003-P1-K1-E12
accgagacatcaagtcaagcaacatactgctctttgaccatgatgttgcgaagatcggggacttcgacatctcaaaccaggcccctgacatggctgcgcgcctccactctactcgcgttcttggcacctttggctaccatgcaccagaatatgccatgactggacagcttagcacgaagagtgatgtctacagctttggagttgtgctgctggagcttttaaccggtcgcaagccagttgaccacacactgccccgtggccagcagagccttgtgacatgggctacaccgaggcttagtgaagacaaggtgaggcaatgcgtcgatccaagactcggagatgaataccctccaaaggctgtagccaagatggctgctgtggccgccctctgcgtgcaatacgagggtgaattccgtcccaacat

SEQ ID NO: 2648 - DNA, 432 bp, Zea mays
  Clone ID: LIB3228-003-P1-K1-E2
cccacgcgtccgcggacgcgtggggtcgagcacatggagaagaaagagtggtagagaggttccgccggcaaggatcttgcccatgttgccgctcgggattcaattagggacctggagggtttcgtcctggtgtggggtcgacgcaccttgcttcgctgggtgagaatttgggatgaaggtccgaacaattgatcgtcggaggccgattccgccgctggaccgcatcccatcgtggccggtcctcaccaccacttaatcactgcgcgaggtcacgagtcatctgaagagcaagttggtacctggaatctcaagtcccagaagctgatgaggaagactgtgacgatggtgatgacaagtactgagtctagcgatgcgccagtcatcttcccatggaagattacccttgctatttctgatgtactttgataatga

SEQ ID NO: 2649 - DNA, 437 bp, Zea mays
  Clone ID: LIB3228-003-P1-K1-E6
taaaaaaaaaaaaaaaaaaaaaaaaaaaaaaaaaaaaaaaaaaaaaaaaaaaaaaaaaagggaaaaaaaaaaatttatattaaaaaataacatccaaaaaaaaaaaaaaaaaaaaacaaaacccaacccaacaataaaaaaaataataatatattgggcccccccctttaataaccccacctttcccccccctcccacccccctttaaattcctttttttttcccccctaaattaattttccgccccccttttttccccccttttcccttaaaaacccctggtccccccccctttaacctccttaaaaaaatccccctttttacaatttttgttaaaaccaatattccccccccctttccccctccccacaatttccccccctctatcgctatttttccccccccttttaccccccctttaacccctttgttttttt

SEQ ID NO: 2650 - DNA, 419 bp, Zea mays
  Clone ID: LIB3228-003-P1-K1-E8
gaagcagggtggcatccggtacaccatcaccgggaacaagtacttcaacatggtgacgatcaccaacgtaggcggcgccggcgacatcgcggcggtgtcggtgaaggggagcaagcgcgttaagtggacggagatgaagcgcaactgggggcaagtgtggcagaccggggaggacctcacctgcgagtcactgacgttccgggtgatgaccagcgaccaccgcaaggccacctcatggcacgttctccccgctgactggaagttcggcgtcacgtaccaggcgttcaagaacttctaagtagccactttccctcctcttcttcaacctgcatgccagcaagcagccatacggatgataacatgcatcatgcatgcatattcattctttcgctcatgcacttcgatacggggccggagtt

SEQ ID NO: 2651 - DNA, 122 bp, Zea mays
  Clone ID: LIB3228-003-P1-K1-E9
cgacagtatatatatacacaattacacatacacaccccaaaaagaaaagaaaaaaactactgccattgctgtcgttgtgcgtagcttctctctatatatatacccgtatttaaattctcgac

SEQ ID NO: 2652 - DNA, 424 bp, Zea mays
  Clone ID: LIB3228-003-P1-K1-F1
gcgtcagcgagcagagatcagatcatccatcggcaatgtcgaacatagggcagtccttccaggccggcaaggctgaggcccagggcgagtaccaggcggagcacgcggcgcagtgcgtcaaggacaccgccgcagccgcggccgacagtgcgcagctgcagcagcaccgccccaccggcaccgttgagcaggtggcgcagacgggccagggcgtggcggcaggcgtcaaggacacggtggcgggcgcggcggttggcgtcacgaacacggtggcgggcgtggcggcgggcgtcacgaacacggtcacgggcgccgtggcgggcgtcacgaacacggtgaccggcgcggcggcgggtgtcaaggacaccgtgaccggcgggcactgatcgacgacccaagaatgctttatgcatggccaagtgtt

SEQ ID NO: 2653 - DNA, 182 bp, Zea mays
  Clone ID: LIB3228-003-P1-K1-F10
gacgatttgatgcatgcatgcatgggtatacctaccaatttgatgaccgacgatgtatagtttcgtcgactgcttcatacacatatatagcagcccaattaatgtaacgtcacgcaaataagcatttgcggtaattttttgtctcgttgattcgatgaataaagggcatgcttgagagtaac

SEQ ID NO: 2654 - DNA, 338 bp, Zea mays
  Clone ID: LIB3228-003-P1-K1-F11
ctcggtgctgaccttgtcaggatcgacgcccactccatgtgctcgcccggcttgtgctgcgactccgcctaccaggtcacctacatcgtgcgcggcagtggccgcgtccaggttgttgggatcgacggcacgcgagtgctcgagacccgcgccgagggaggctgcctcttcatcgtgccaaggttcttcgttgtctccaagatcgccgacgaaaccggcatggagtggttctccatcatcaccacccccaacccaatctttagccacttggcgggccggacatcggtgtggaaggcaatatctccggcggtcttgcagtcgtcgttcaacaccacgcc

SEQ ID NO: 2655 - DNA, 433 bp, Zea mays
  Clone ID: LIB3228-003-P1-K1-F2
atcgatcacaacaagatggcatgtatagacaatgcaatgagagccttgttccttgtagcgctcttctgcaccgtgcatggtgagaaggcaaagtcaaaggacaacgattcaaaagcgtccgggcccggtgggtccttcgacatcaccaagttgggcgcctctggcaatggcaagacggatagcacgaaggctgtgcaggaggcgtgggcatcggcgtgcggcggcaccgggaagcagacgatcctcatccccaagggcgacttcctcgtcggaccactcaacttcacaggcccatgcaagggcgacgtgaccatccaggtgaatggcaatctgctggcgaccacggacctaagccagtacaaggatcatggtaattggatcgagattctacgcgtggacaaccctgtcatcaccggcaagggaaagctcgacg

SEQ ID NO: 2656 - DNA, 375 bp, Zea mays
  Clone ID: LIB3228-003-P1-K1-F3
agaacatcaccggcacctcctccaccccggaggccgttagcctgctctgcactggcagaggtcccatgcaccggcgtcaccatggatgacgtcaacgtcgagtatagcggcaccaacaacaagaccatggctatatgcacgaacgccaagggcagcaccaagggttggctcaaggagcttgcatgcttctagacccttcatcgactgacccatctttctaggtataatttttctctcggccttgcattggccattagatgctatccattggtaacgcacaacagtaaaacgacagacatccgaccaaaaaaaaaaaaaaaaaaaaaaaaataaaaaaaaaaaaataataaaagaaataaaaattaaaataagggg

SEQ ID NO: 2657 - DNA, 433 bp, Zea mays
  unsure (1)..(433): unsure at all n locations; Clone ID: LIB3228-003-P1-K1-F4
gacgagccggggcacctcgccccgaccggcctgatcctgggaggcaccaagtacatggtcatccaaggcgaacctggagctgtcatccgtggcaagaagggatccggnggcatcactgtgaagaaaacagggcagtcactcatcattggcatctacgacgagcccatgactcccgggcagtgcaacctggtggtggaaaggctgggcgactacctgctcgaacaggggatgtaacaacaaccccttcccctggaatgcatgttgatgatgttgctggttccaacttcgttttcagtaataataacaacaaagcgaagaccctcctacctaccctatttgcttgagcggctcttgtccgcgccacaagataccaattgttgcgctgggaatattcagttacgatgacccgctttagttcaagttttttttttgg

SEQ ID NO: 2658 - DNA, 299 bp, Zea mays
  Clone ID: LIB3228-003-P1-K1-F7
ctttttctcgcgtttccttctctagccagccttgtctgtcccctcctcgtgttaggctctctctctcttttttcgttcgcttccgaggaataatacccaaacaaaaaaaacaaaggggctcaagacttcatcatgcatgcatgcataacacctcgagtaggagttgaagtacatgatcattgatggtatatatatagaggaagcatgtctatctaataagtccctcatccaaaattggtctttatgtcatgtatatgtacgtgcatatatatatatataaaaatacgtctccttttatt

SEQ ID NO: 2659 - DNA, 384 bp, Zea mays
  Clone ID: LIB3228-003-P1-K1-F8
cctccatcgatgcctaggcgagtgctgggtgtttgatttagatttctggcactgcgggggtgatcgagtccgccacctcgatttctcgcccacacagcgtctcggtggccggagttgggtgggtgtgactcggcggacagcaagtgtcgcgttgagggagcctctggctcaaggggagcttgggacgacggggatttctcaacgacgagccacgctgacaggggatctgcgcactgtcgtggctgcgggaatcggcgccaccacttgcgcgcgaggacacgtgtcatctgaaaagcaagttggtacctggaatctcaagtgccaggtcaagaacaggtactgcaggatgaggcgcatggaggatgccgcgatgtgttcgtgaga

SEQ ID NO: 2660 - DNA, 353 bp, Zea mays
  Clone ID: LIB3228-003-P1-K1-F9
cccacgcgtccggcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgagggcggactgcgccgagatcgaccactccc

SEQ ID NO: 2661 - DNA, 422 bp, Zea mays
  Clone ID: LIB3228-003-P1-K1-G10
cggacgcgtgggcggacgcgtggggcaagcacttcggcaccggcaagctcgagcgcgcgcatctacggggtcaccgacgcgaccggcacctacacgatcgagctcaaggacagccacgaggaggacatctgccaggtggtgctggtggccagcccgcgcaaggactgcgacgaggtccaggcgctcagggaccgcgccggcgtcctgctcaccaggaacgttggcatctccgacaggctgcgccccgccaacccggtaggctacttcaaggacgtgccgctccccgtctgcgccgcgctgctcaagcagctggactcggacgacgacgacgaccagtaaactataccacggcggcgtcgcggacatgctgcacaaaactacaacgatacagagcgaacgcatggcatggatagcagtatcta

SEQ ID NO: 2662 - DNA, 429 bp, Zea mays
  Clone ID: LIB3228-003-P1-K1-G2
cccacgcgtccgccacaaaagggacttccgttccgtgctagcgcgcgatcgcgtcgggctccactccaccttcccgaaaaagcttaccctttgtgtttgtgtgtctgtctggcaatcgatcgatctccatgacgacgtccccgccgcgcgcacgcctgctcgccatggcgctggcgctggcattcgcctgcgtgctgctcgtcaggtccgcggacgccgccacgcccggcggctccgcgtacgggtgcaacccggccacggacaggacgtgcaggcccgagggcgtcggggtggtgctgcccgacggcggcattgacctcgacggcgacggcgactaggacgagctgccgcagttcgacccacactttacgatcctcggccatgcccagtgagtgtgagtgcaggtgcagctggctgggtggtcatttt

SEQ ID NO: 2663 - DNA, 405 bp, Zea mays
  Clone ID: LIB3228-003-P1-K1-G4
gtcacattctctcaagaatgacatcgaatttgaacctttgagaaagaaaattccagagcttgtattgagaatggaccaaatcatttccaagaatataaaggtacctgcaatctgcatgacccatgatgaactcgatgaaagatgcagattgatgagcagaatcgatgctttgttctatgaaaatcagcattttcgagggttgcttgcagacaggatgaaggacgttaaggcattatcatcccagctatctgaagccagtacagaactgtcaatgcagatgctgtcggaagaagagctcctgagacaaatcgataaagttagagaagactgtgaggacctccgaattgaatgtgatgttagagaaggaatgtaccaaactgttacaaaacatttgcttgatgacta

SEQ ID NO: 2664 - DNA, 348 bp, Zea mays
  Clone ID: LIB3228-003-P1-K1-G6
atttctgctgcatcttacctggttcatgctgttcgggtaatccgcgaagaaggcaacaacctttggcaggttaagaggagagtcaggttgccgtcccaatatattttcagctttgcagatgcaacggataagcacttactccttcgtgggattccatggaatttgcacctggagccttctactcctggcgctgatataggatacttctctgttgagttcgagtctatgcaggttgagaaaatttgtggcatcaggaatcttctatacgccaaactgtacactggttttccaccgtcattgtccctaccaagcatatgaaatggtaaacttgctatccaatttttccgt

SEQ ID NO: 2665 - DNA, 394 bp, Zea mays
  Clone ID: LIB3228-003-P1-K1-G7
ctccattcgtttacctgaagcacaagaataaacgcagccgggcatgggcgaagctaagctcaacaacgtgaccgtcctgctggtggccctcctcctcctgagcagtggcgttcaggacgctgccgccatgccaggcacgttgaactacgacgcgattgtcgccgacgagccaaacggaaagaacaaggacctgtaccgccccgtcgccaacgccaataaatacacccgcgggtgcgagcccatagaacgctgcaggggcgcgcgctgatcaccaagcatatacatatagcacatcgatttcttattattgcatgcacgtttatataagtgctcattgtcttgctgttgtaagtgccagcacaagcatatatacggcgtttatatatactacata

SEQ ID NO: 2666 - DNA, 422 bp, Zea mays
  Clone ID: LIB3228-003-P1-K1-G9
gtttgagattggatccacctgatgcatgccgatgcatctatccattactagggtggcatcctgatactactttggcggagactcacagggccgtccctaaatagcatccattctgctttagcgcagggtgcacggcaactcgttctatagaaggcaaaggcttcgcacgttgctacgcatagtgctatcgctgagatacacatcgattttattgtatgcgaatctacccatggtgtgaaagttagttatcttaagacacgcggagacacaatacatgtccatatccgtccaccagggtggtgcttacctagcattatgggatggtaacttgctagtcagttttctcgtagatatatgtaatactacttaaataatccttatttctttaatttcttagctctatagctaggaacatgttttta

SEQ ID NO: 2667 - DNA, 339 bp, Zea mays
  Clone ID: LIB3228-003-P1-K1-H1
ccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccgtcgactgacccatctctctagttataatttttctctcggccttgcattgcccattacatgctatccattggtaacgcacaacagtaaaatgacagacatccgacagctatattatgttcgacggtgtaacaccctgaatttgagggtat

SEQ ID NO: 2668 - DNA, 66 bp, Zea mays
  Clone ID: LIB3228-003-P1-K1-H3
cccacgcgtccgctgtagacttcactgtttctatagtggagtttgaatatgagaatgtagatgagt

SEQ ID NO: 2669 - DNA, 430 bp, Zea mays
  Clone ID: LIB3228-003-P1-K1-H4
cccacgcgtccggcttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctg

SEQ ID NO: 2670 - DNA, 416 bp, Zea mays
  Clone ID: LIB3228-003-P1-K1-H5
ggagcgtgagggcagcggcttctctcgtttccttcttctctagctatttgtcccccctagctcgtttgttctctcgtcccgtcgtccggttcatttccgcttccgaggaataataatcaaccaaaggggctctgctctatctcaagaagacttcattcatgtgggcaccagcagtcactcactgccaggggcgggcgaccagggagattaagaggcgatggtccgctgcaatgcatgcatgcggatatatgcatgcgtaaacacatcgagacgccgtaaaattgttcttttatatttatgtatatgtacatgcatatgtctcctgattcaactttgatgtttattgtctctttcgctttcgtactgaacttctctgtgtaagttgatatatggatcaatagattgttattcactat

SEQ ID NO: 2671 - DNA, 339 bp, Zea mays
  Clone ID: LIB3228-003-P1-K1-H8
cccacgcgtccgcccacgcgtccggtcgcctggcggccgtctgcagctccgcgcctctgctcggaagttggtgaaggtttcttgaagctgagaagatggtgctgaagacagaactctgccgcttcagcggccagaagatttatcctgggaaaggcatccgatttatccgtgctgattctcaggttttcctttttgccaactcaaaatgcaagcgctactttcacaaccgcctgaagcctgcaaagcttacctggacagcaatgtacaggaagcagcacaagaaggatatccatgctgaggctgtcaagaagaggcgccgcgccaccaagaagccatact

SEQ ID NO: 2672 - DNA, 393 bp, Zea mays
  Clone ID: LIB3228-004-P1-K1-A1
gggcaagcgatggtggacggcatctacgacgagcccatgacccccctccagtgcaacatggtggtcgagaggctcgaccactacctactagagcacggcctgtgaatggattcatttaacctcgctcgcttgtccatggttcgcagcagcgataccaacacccgcattatttaattggtagcctcctctagctacgcacgcatttttagtctcctacacgcccttggattgtgcgtggctctgttaatcatctctcatccttcgtctgccatttctcccctgagatttttgttccttgttggtaccatgcattttggcaaataattttgtgattccactcccaaattaaagtttggttgacagatgggttgtcaacccagaacaatatatata

SEQ ID NO: 2673 - DNA, 373 bp, Zea mays
  Clone ID: LIB3228-004-P1-K1-A10
gtgggatcgagttgtttcactgcacgagcacatcctccggcgaccaccggcctccctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggggcacctcgccccgaccggcctgatcctgggaggcaccaagtacatggtcatccaaggcgaacctggagctgtcatccgtggcaagaagggatccgggggcattac

SEQ ID NO: 2674 - DNA, 372 bp, Zea mays
  Clone ID: LIB3228-004-P1-K1-A12
cggacgcgtgggcttttattgtaaaagagggatcccttctttccattgcattcttgcaatccgtttcttcttgactatgtttcttcttgactatgtaacgataataacatgagaaaattatctgaatgacattatattttttctaaaaaaaaaaaaaaaaaaaaaaaaaaaaaaaaaaaaaaaaaaaaaaaaaaaaaaaaaaaaaaaaaaaaaattccaaaaaaaaaaaaaaaaaataaaaaaaaaaaaaaaataaaaataaaaaaatgggggggcccttttaagggtaccaagtttaacctccctggcatggcaataaaaattttttttatatgggtccccaaaaaaaaaataaatggcccgttttaaaaa

SEQ ID NO: 2675 - DNA, 189 bp, Zea mays
  Clone ID: LIB3228-004-P1-K1-A2
gtctttattccttgccactttcatagtttctttcgctggtccacactgacatttatgatggtgggagcaaactctgatctgttttgactagtgtacacgtttgtgtgtggaatctgaagagctgttctgaaatgttgaaaataaatgggcggtctctcttgaggattcatgctttcgtacgcttgcttg

SEQ ID NO: 2676 - DNA, 409 bp, Zea mays
  Clone ID: LIB3228-004-P1-K1-A3
tggagacaaggaccatggtggtgtgcgcgacgggacggcccttgtgctgtgggagtggtgcgagggagacaaccagcgctggaagattgttccctggtgaacaaggaaatgtgtgaccgagcccgcaccaaggaggagctcctgccgtaataagtgaagtgattggtactgaagtttctggaaataagaggctcttctgagatgcctgtttgtgtgagtatttgcgtttccattccgttttcatgataataaaacgcattgattattaatatatgtaatgtgatgctacactgagtggcagcgttggtatatatttgtaagaattaagaacccattgttgttggactaagcgtgacgagtgatgtactgatgtatgaacctttgcttgatgcatatgctcttctgcttc

SEQ ID NO: 2677 - DNA, 424 bp, Zea mays
  Clone ID: LIB3228-004-P1-K1-A4
agcccacatagatataaccgtttggggaaaagaatcgtgggctgtgacctgtcgtcttcgtctccggcagagcaaagcggcggcgaggcgggagatatagaggagagacgagagcgggatggggtacctgtggagggtgcggctgtcttcatttgctgccggcgcggcgacggcttcggcggcggggttcttcctcctctacaaggaccacctgctcgcccgcgctgccatcatcagccaggtggaggacatcaaggaaacttctgaaaagcattatgcagccctaaataagaggatatcagcactggaaagcagaagagaaccaggaactatcaaagaggcatcagattaattctgagttgggcttatgtcatgggtacatctgcccatgtgtttttgattgctgcaggcggtataaactgca

SEQ ID NO: 2678 - DNA, 389 bp, Zea mays
  Clone ID: LIB3228-004-P1-K1-A5
cccacgcgtccgcgatgtcgaaccaggcctccgagaaggaggccggccccaacgtctccgtgaagggctacgacgtgatcgaggagatcaagacggagctggagaagaagtgcccgaacgtggtgtcgtgcgcggacatcatctcggtgagcgcccgcgactcggtgaagctgacgggcgggcccgagtacgcggtgcccctgggacggcgcgactcgctcgtgtccaaccgcgaggacgccgacaacctgccgggcccggacatcgcggtgcccaagctcatcgacgagttcgacaagcagggcttcaacgtcgaggagatggtcgcgatgctgggcggcggccacagcatcggcgtctgcaggtgctttttcatcgagaccgacgcg

SEQ ID NO: 2679 - DNA, 255 bp, Zea mays
  Clone ID: LIB3228-004-P1-K1-A8
acgaagccccacacacacaaaagcaaaaagcatcatcacaataatggcccgcgcgtgtgtgttcctcgtggtgctcctcctggccgccgtcgcggtggcgccgtttgcgggggctgcgcgtgtggatgtcgtggagggcaggtccatggcgtccgccgacgcgcctgaggcggcggatgacgcgcctgctctcggatccgacttcgcctcattctttgacttgccattggaggctccctttcaataaaagcttat

SEQ ID NO: 2680 - DNA, 316 bp, Zea mays
  Clone ID: LIB3228-004-P1-K1-A9
cgccccaccaggggctcggcacggtggaagccaccagcgacgtgccggaaaaggagagagaaggcaaggacacccacagagagagaaagaaacaatctgccatatggctggtactcctacctcgctgtttgggggtctgcatggttaccgggggcatctctgggggtcaaggatggtgtgcgtggatttctttgggcgtgcggctctccatgggaacctttgttgcctgactcgtcggtcgcccatcaccgcgggtgggattcgatgtcgtgtaatcgctggtaccgctggaggaacatgaaagatggaacgatga

SEQ ID NO: 2681 - DNA, 391 bp, Zea mays
  Clone ID: LIB3228-004-P1-K1-B1
gggtgccatgatatccaaccttgcatttgttttccgcaacatcttctcgaagaggggcatgaaggggaagtccgtcagtggcatgaattactacgcttgcctgtcaattatgtccctggtcatactgactccatttgctatagctatggaaggccctcaaatgtgggctgctggttggcaaaaggctcttgcagaagttggacccaatgttgtctggtggattgctgcacagagcgtgttctaccacttatataaccaggtgtcctacatgtctctcgatcagatttctccattgacattcagcattggcaatacaatgaagcgtatatcagtgattgtttcatcaatcattatctttcacactcctgtccgcgctgtcaatgcactggga

SEQ ID NO: 2682 - DNA, 174 bp, Zea mays
  Clone ID: LIB3228-004-P1-K1-B11
gtggactccaaatggccatgcttatttcttctctctgagcttaaaatgccatgtgttggcaacttagattgttcatgtactgaacctgttgaagttctaccaaaatttcttgtcgaacggctgaacagttgtcccaatgttatgctataaacagagcttatctttccccgtgcc

SEQ ID NO: 2683 - DNA, 334 bp, Zea mays
  Clone ID: LIB3228-004-P1-K1-B12
aaagaagtcgcctaattctttcgatcgaattaggcgccttcttcgtcccacgctccgtctttatttgtaatctgaagcttacaggaacatttgagtggatcatggacggattggtaggcctcttgaaagtccgggtggtgaggggcatcaaccttgcctaccgcgacgcaagaggcagcgatccgtatgtcgtcctacgacttggcaagaagaaacttaagacgagcgtgaagaagagatctgtgaaccccatctggcacgaggagctaactctgaccgtcacagattccagcctagctctgaagctggaggtgttcgacaaggacacgttcag

SEQ ID NO: 2684 - DNA, 409 bp, Zea mays
  Clone ID: LIB3228-004-P1-K1-B3
tggagacaaggaccatggtggtgtgcgcgacgggacggcccttgtgctgtgggagtggtgcgagggagacaaccagcgctggaagattgttccctggtgaacaaggaaatgtgtgaccgagcccgcaccaaggaggagctcctgccgtaataagtgaagtgattggtactgaagtttctggaaataagaggctcttctgagatgcctgtttgtgtgagtatttgcgtttccattccgttttcatgataataaaacgcattgattattaatatatgtaatgtgatgctacactgagtggcagcgttggtatatatttgtaagaattaagaacccattgttgttggactaagcgtgacgagtgatgtactgatgtatgaacctttgcttgatgcatatgctcttctggttc

SEQ ID NO: 2685 - DNA, 353 bp, Zea mays
  Clone ID: LIB3228-004-P1-K1-B4
tggagacaaggaccatggtggtgtgcgcgacgggacggcccttgtgctgtgggagtggtgcgagggagacaaccagcgctggaagattgttccctggtgaacaaggaaatgtgtgaccgagcccgcaccaaggaggagctcctgccgtaataagtgaagtgattggtactgaagtttctggaaataagaggctcttctgagatgcctgtttgtgtgagtatttgcgtttccattccgttttcatgataataaaacgcattgattattaatatatgtaatgtgatgctacactgagtggcagcgttggtattatatttgtaagaattaagaacccattgttgttggactaagcg

SEQ ID NO: 2686 - DNA, 63 bp, Zea mays
  Clone ID: LIB3228-004-P1-K1-B5
aaaaaaaaaaaaaaaaaaaaaaaaaaattaaaaaaaaaaaaaaaaaaaaaaaaaaaggggcag

SEQ ID NO: 2687 - DNA, 418 bp, Zea mays
  Clone ID: LIB3228-004-P1-K1-B6
aacgaagccccacacacacaaaagcaaaaagcatcatcacaataatggcccgcgcgtgtgtgttcctcgtggtgctcctcctggccgccgtcgcggtggcgccgtttgcgggggctgcgcgtgtggatgtcgtggagggcaggtccatggcgtccgccgacgcgcctgaggcggcggctgacgcgcccgctcccggtcccgactccgcctcatccccggactcgccgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatatataaatatgtgcatcaaatgcgtgcggcaaacgcatggaatgtgc

SEQ ID NO: 2688 - DNA, 412 bp, Zea mays
  Clone ID: LIB3228-004-P1-K1-B7
cggacgcgtgggcggacgcgtggggtcgagcacatggagaagaaagagtggtagaaggttccgccggcaaggatcttgcccatgttgccgctcgggattcaattagggacctggagggtttcgtcctggtgtggggtcgacgcaccttgcttcgctgggtgagaatttgggatgaaggtccgaacaattgatcgtcggaggccgattccgccgctggaccgcatcccatcgtggccggtcctcaccaccacttaatcactgcgcgaggtcacgagtcatctgaagagcaagttggtacctggaatctcaagtcccagaagctgatgaggaagactgtgacgatggtgatgacaagtactgagtctagcgatgcgccagtcatttttccaatggagaatacccttgctatttc

SEQ ID NO: 2689 - DNA, 374 bp, Zea mays
  Clone ID: LIB3228-004-P1-K1-B8
ggcaacatcatcatcagtgtgggttgcagaaggagccgatgacttaaaagtttcttgcgttaaagagtgcacccaaaattttaacactcccgagggcaagaagatctgtgaaacgatgtgtgccaaccctaaaggaaggcctatcgacagagttagagctgattgatcaatgctcatctttatttgtagctagctatcatgcatgcgatgatggccttcttgattattattatttcattcctcatgttgtttgttcttgcatgttttttccaccactaatattgtcctaattgatgcatacaagttgtcactcaaagcattttctatgctttacttattggttaaataaatacaaaggcttccttttacctaaa

SEQ ID NO: 2690 - DNA, 90 bp, Zea mays
  Clone ID: LIB3228-004-P1-K1-C1
gccttcaatatttgccactctcatagtttctttccctaaaaactcactgacatatgtgggtgttggagcaaactctccactgcattaact

SEQ ID NO: 2691 - DNA, 342 bp, Zea mays
  Clone ID: LIB3228-004-P1-K1-C12
cccacgcgtccggatttcactagtgatgcttttcaaagggaagaacgggaacgatggctgccattggtgccactacctgaactgcgtgccaacatccaagtggaagtgtaacacctagacacctcagttttctgttacactcgggggcaaaaatgtagtatccagatttacaagaccattctctatgtttgtttgtctgtagatatgaacaagttccttgttgtttactggatttgagtttctttgcctatgtaaactgcttcgttgagcgttctatgtttataattggagcttgatagctgtttaaaattgctcaatggaaaagcagtaccattgatgcgc

SEQ ID NO: 2692 - DNA, 107 bp, Zea mays
  Clone ID: LIB3228-004-P1-K1-C2
aaataaaaaaatataataaaataaaaaaataatataattaaaaataaaaaaaaaaaagagagtgctaaaaaaaaaaaaaaaaaaaaaataaaaaggggcgccttttt

SEQ ID NO: 2693 - DNA, 418 bp, Zea mays
  Clone ID: LIB3228-004-P1-K1-C4
cggacgcgtgggtttcattccaaggactctttgtgaagacaatgacccaatggatgtgttggtcctgatgcaggagcctgttgttcctggttcgttcctgagagctagagcaattggccttatgcccatgattgaccagggtgaaaaggatgacaagataatagcagtatgtgctgatgatcctgaataccgtcactacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaggcagtagattgcaagcaaacaattatctatcatgcgtctt

SEQ ID NO: 2694 - DNA, 368 bp, Zea mays
  Clone ID: LIB3228-004-P1-K1-C5
cggacgcgtgggttttattccaaggactctttgtgaagacaatgacccaatgggtgtgttggtcctgatgcaggagcctgttgttcctggtccgatcctgagagctagagcaattggccttatgcccatgattgaccagggtgaaaaggatgacaagataatagcagtatgacgctgatgatcctgaataccgttactacaacgacatcagcgagctgtcttctcaccgcctgcaagagatcaagcgcttttttgaagattacaagaaaaactagaacaaagaagttcgagttgatgcatttttgcccgggacaacagcctaagaagccattcatttcctcatggacctgtttgcccagcataatttg

SEQ ID NO: 2695 - DNA, 348 bp, Zea mays
  Clone ID: LIB3228-004-P1-K1-C6
gcgcgaacgcgtgcatgcgcagacgttgaggtcgagggacacggtatctctgaggttcatcagagagcgacccgtcaccgtcacgcttggccgcaagccgagaagagtgccgggccgggagaccggacgataattgatccgtagcagattcgctaatggcggagacggcggacatggagcggatcttcaagcggttcgacaccaacggcgactgtaagatctcgctgtcggagctgacggaggcgctacggacgctggggtccacctctgccgacgaggtgcagcgcatgatggccgagatcgacaccgacggcgacggcttgatcgacttcaacgagttcatcacct

SEQ ID NO: 2696 - DNA, 413 bp, Zea mays
  Clone ID: LIB3228-004-P1-K1-C7
cccacgcgtccggcaacacacggaaccagaaagcaaacgcaaacaagaagcaaaccagcaatggcccgcgcctgcgtcttcctcgtcgtgctcctcctagccgccgtcgccatggcgccgttcgcgggcgcggcgcgcatcgacgtcgtcgagggcaggtccatggcgtccgcggacgcaccggaggccgccgccgacgctcccgctcctgctcctggccccgactccttctcgaccccgtcgccggcacccttcagcagcagctcttccgactagccgaccggcagagatatctacggcgtccgatcagtctttggcgccacctataacctatcggatcctgcaaagctatatatgattctatggtataatgtgtggatgcggcaaacgcgcggaaataatgtgcttgcgtg

SEQ ID NO: 2697 - DNA, 371 bp, Zea mays
  Clone ID: LIB3228-004-P1-K1-C8
ggcacccagccagggatcgaaggctaggagatcgcgccgctagccaaggggaacgtggcctcgccctgaagagttcggcctgaacagtccctgatctagcacgtggtgcaaagatgttgggacatattcttatatatgctgtatcgtttatgtgatatggacaagaatgaggagcagcttgattgggctagtggtatgtacaggactgggggccacgtggcgcatcctattaagcgcatgaacaagttgcttgtgcttgcaggtaagtaccactagttaatttgatatagcgggtgcatacatggtcctactttgggggagttttttgctttacttattgggtaaataaattcaaaggctttcttttacct

SEQ ID NO: 2698 - DNA, 351 bp, Zea mays
  Clone ID: LIB3228-004-P1-K1-C9
ttttcctggtagtccccgacgaccaggctcccgacaggcgttcgttccgcgtgggctcctcctgccacgacaggtaccgcttgcgcgtcgccgacttctcgtctgccaccaggaagtggcagattctcccctggtcggagcctgtgccgacacagacggcgagcggtaagtactggcttctctcggggaggcaggtgagtgggttcctgtgctggtcacaccataagaatgcctacaaggtgttgctggacactgcgaccctgcaattctccgtcatcgatctgccgtatggcttgagtggtcaaggtcacctttacaggactggggataccaaggatgggaagctctgta

SEQ ID NO: 2699 - DNA, 171 bp, Zea mays
  Clone ID: LIB3228-004-P1-K1-D1
gcgtaaattaatatctcaaccacataatctctttccttaaaacaaaaatgacatatgtgagtgctggagaaatcactccaagatcatcaactactgcgctttcttgtcaattataggtttaggagtacacactacacacttaataactatacgatggtcgctcaaatattt

SEQ ID NO: 2700 - DNA, 295 bp, Zea mays
  Clone ID: LIB3228-004-P1-K1-D11
gacgtagggcccagcctccgagaagatcatttggtgcgtaccctagaagcggttcaaggtggaccccgtcaccgccgccctccttctgcgtctcgtattccacgactggttcgcaaacggctgcaacgcgttcatcttgatcgaccccatgtcgaaccaggcctccgagaaggaggcgggccccaacatctccgtcaagggctacgacgtgatcgaggagatcaagacggagctgttgatggagtgccccaacgtggtgtcgtgcgcggacatcatctcggtgagcgcccgcgac

SEQ ID NO: 2701 - DNA, 60 bp, Zea mays
  Clone ID: LIB3228-004-P1-K1-D12
cggacgcgtgggcggacgcgtgggcggacgcgtgggcggacgcgtgggcggacgcgtggg

SEQ ID NO: 2702 - DNA, 428 bp, Zea mays
  Clone ID: LIB3228-004-P1-K1-D3
cggacgcgtgggcaagatgttcttccacatcgtgctggagcggaacatgcagctgcacccacgacacttcgggccgcacctccgcgacaagctcgtttccaagctcatcaaggacgtcgagggcacctgcagcgggcggcacgggttcgttgtggcgatcacgggtgtggaggacatcggcaaggggctcatccgggaaggcacgggatacgtcaccttccccgtcaagtaccagtgcgttgtctttagacccttcaagggcgagatccttgaagctgtcgtcaccatggtgaacaagatgggcttctttgcggaggctgggccggtgcagatcttcgtgtccaaccatttgattccagacgatatggagttccaatcaggagatgtgccgaactacacaacttctgatggatcggtgaaaattcaaa

SEQ ID NO: 2703 - DNA, 396 bp, Zea mays
  Clone ID: LIB3228-004-P1-K1-D4
accacgcccccgctcctctcgtctctatcttcgcctcttccatcgcaggattcagcggccatgggcggcggcaacgcccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaactagtaagcagcagaagcatatgctctgctcagctaaaagacaagtactacatatatatatatatacgctgtgtgtcaattaatgggttctaggctgctgctgatg

SEQ ID NO: 2704 - DNA, 391 bp, Zea mays
  Clone ID: LIB3228-004-P1-K1-D5
cccacgcgtccgcccacgcgtccgcccacgcgtccgcatcatcatatgaattagagacacttcaatcaatgagtgaaattgacaagattgaggtcgacaagctagacaaggaaagggttacatatgctgaagctctggcggcagcgagagagaaccctgacgaggagcacttgaatatagctgcggaggcgaggtcaaggctgcaggtccttgtactttagtgtccccttctgattatagcgtttgtatgataatgttgaactgctgatgtaattgtatgtgttggcttgagttgaggtgctcgtggaatccttccggtgattgattcagcactgtaaactgacagctggttcatgttgtaaccaatatttaaggcgtgtttgatttcttt

SEQ ID NO: 2705 - DNA, 419 bp, Zea mays
  Clone ID: LIB3228-004-P1-K1-D6
agaaacccccccgctgcgcaaccggaggcgtctcccagccccgcgccgccgctgacggagatggccggccccgtctcctcagcgccccggaccgtcgaggacatctacaaggactacgccgcccgccgcgccggcctcgtccgcgctctcacatctgatgtcgacgggttctacagcatgtgcgacccagagaaggagaacctgtgcctgtacggtctcccgaacggcggctgggaggtatcgctgccggtggaggaggtgccgccggagatgcccgaaccagcgctcgggatcaacttcgccagggacggcatgaggcgtcgcgactggctctcgctcgtcgccgtacactctgacgcttggctcgtctccgtcgcattcttcttcgccggcaaactcaacggcaacgacaggaagcg

SEQ ID NO: 2706 - DNA, 275 bp, Zea mays
  Clone ID: LIB3228-004-P1-K1-D7
cggacgcgtgggcggacgcgtgggttggagaacggctatttaactgacgatggtgttttctgttctggtttaagcaactcgtcaagcggcaagttctccaaactgtcccgcatggccaggtcgtcatattcctcatcagacctgttgcagtcctcgtccacagacccttccatctcctcatcgatctccatggtgtcttcttcacttaggtcctcatcactccctgaattaggacggacatcagcttcttcttcctcttcttcatcactgccatc

SEQ ID NO: 2707 - DNA, 328 bp, Zea mays
  Clone ID: LIB3228-004-P1-K1-D8
aaggaaggcagaggcaaaagcagccatggcgaactcgtcgtccggccttgcggtgaacgacgagtgcaaggtgaagttccgggagctgaagtcgcggcggagcttccggttcatcgtgttcaggatcgacgacacggacatggagatcaaggtggaccgcctcggcggaccgaaccagggctacggcgacttcaccgacagcctccccgccaacgagtgccgctacgcgatctaccaacctcgacttcaccaccatcgagaactgccagaagagcaagatctttttcttctcctggtcccctgacactgcacgcaccaggagcaagat

SEQ ID NO: 2708 - DNA, 369 bp, Zea mays
  Clone ID: LIB3228-004-P1-K1-D9
ctgaagcgcgcgagagacagacgcgtatacccaggcggcggttgaggaggaggagaagaagaagaagaagatggcttcctccgcgtacgcctcatggtccaagcggtggatccgtcccgaggtgtacccgctgttcgtgccgatggccgtggccctgggtatctgctcgtaccagcttgtgcgcaacatcacgggcaaccccgaggtgcgggtgaccaaggagaagagggcggccggcgtcctggacaaccacgacgagggcgagaggtacgccatgcacggcctcaggaagttcgtccgcgggaagaagcccgagatcatggctttcatcaacttcttctttgccgatcctcccagggacgattaagc

SEQ ID NO: 2709 - DNA, 273 bp, Zea mays
  Clone ID: LIB3228-004-P1-K1-E10
ttttgtacaggtttggattatttataaattttttattgattattgtacatataaatatgaaaattatttatctgtataatgatgaaaaaacatgtaaaactagattacattgtcaattatataatagatgaataatcagataagtggaatcaatagaccataaaattttactgttatcagagaataaaaatcaccctggttattaagaaaataaaaattatgcttattctaaaacaaaaatgatatgagaaagtatatttaatttttggagct

SEQ ID NO: 2710 - DNA, 197 bp, Zea mays
  Clone ID: LIB3228-004-P1-K1-E12
ctcgaataacaatgtccaagaaaaaaaaattatataagagcttaaaaaacaaagtgaagaaaaacttaaaaagaaaaacgaaaacaaaaaaaaaaaaaaactaccaaaaaaatggggcggcccctttaaagaatccaagctaacgtacgcgtacatacaacgctaaactttttttataggggcacctaaatacaatt

SEQ ID NO: 2711 - DNA, 405 bp, Zea mays
  Clone ID: LIB3228-004-P1-K1-E2
tgagtttcttcagttactaaatgagccctttgaaggcggagagggggatttcttggaccaacctgaggaggatgaaatgcctcatgccattagtgttacaccagaggagcaggaggccattggacggcttgagtccatggggttcgacagagcacgcgttatcgaagcattcttagcctgcgataggaacgaggagctagcagcaaactatctccttgagcatgctggtgaggaagattaagcgggagtagttttcatacgattttttttagtaccgagtgacgaagagttgatatggagctgacgatcatttgaattgatttcgttgtgcaagacttgtattacataaacatttaaatacatgtagctgaacatttcagtagaaatgctacggttgtggtctcc

SEQ ID NO: 2712 - DNA, 426 bp, Zea mays
  Clone ID: LIB3228-004-P1-K1-E3
cctttagttgccaatttaaaggaacagtataaggaataccgatttgatggcccaaaataagcagatcattgttgcggtggctctccttttgcttgtggtggcaacattatcatcagtgtgggttgcataaggagccgatgacttaaaagtttcttgcgttaaagagtgcacccaaaattttaacactcccaagggcaagaagatctgtgaaacgatgtgtgccaaccctaaaggaaggcctatcgacagagttagagctgattgatcaatgctcatttttatttgtagctagctatcatgcatgcgatgatggccttcttgattattattatttcattcctcatgtcgtttgttcttgcatgttttttccaccactaatattgatctaattgatgcatacaagttggcactcaaagcattttttat

SEQ ID NO: 2713 - DNA, 307 bp, Zea mays
  Clone ID: LIB3228-004-P1-K1-E4
ggtcgaggccacgcgtccgaccacgcgtccgatggagctgaacctgtaggccaacatctgaatggatcttgcagacatgatatgaaccacgcatgcaaccacagccagaggtgccatcgcatgcaacgaatgcttgcatacattcttcatttaattaagaattcattgcaactatgaggtatatatcatgcgtaactctatgtgtatgcatactgacctgcactatatattcaatagcatgtgctgagaacatgcggaggcgaggcattgggcggacgatctagaggatgcatgcttacacctcacg

SEQ ID NO: 2714 - DNA, 431 bp, Zea mays
  unsure (1)..(431): unsure at all n locations; Clone ID: LIB3228-004-P1-K1-E5
cggaannnccgngtcgggcggcgcgtccgagctgattgttggtggatcaacttttggaaatgtagctattgcagatcaaacctgaggggagaagttaggtgttctaaaatcagatcatggaccattggcaataagatccttatcttcctgcacaaattcacacatgatatttgctggttcgtcagctggttatgcacattgctgggacttaaggactttgaggcctctctgggaaaaaagagtcagcccaaatgtcatctacagcacacgtcatttgcccggtgacacggcaacgctggcagttggaggcattgacggcgtgctccgcgttatatgccaaagaactggtgacatcattcgcagtcttgtcgttgacgcagatcttccagcagaagccacatctagatcccggcagcaaatagagaagaaac

SEQ ID NO: 2715 - DNA, 417 bp, Zea mays
  Clone ID: LIB3228-004-P1-K1-E6
cccacgcgtccggtacaagatgctgctgaaaatccagaggcagaagaaactaacactgctgcagaggaaacacctgctgtagaggaagcaagtgagactaccgaggaggaagaggctgagaaacctgagatcaagatcgaaacagctccagcagattttcgtttcccaacaacaaaccaaacaaggcattgtttcacacgctatgttgaatatcacaggtgtgtggctgcaaaaggtgaggatgcacctgagtgtgataagttcgccaagtactatcgatccctgtgcccaggtgaatgggttgatcgctggaacgagcaacgcgaaaacggcaccttccctggacctctgtaatcctacaatgcaaaagaagtatgaactcacgatgttgtgccggcttttttttcttggtaactg

SEQ ID NO: 2716 - DNA, 426 bp, Zea mays
  Clone ID: LIB3228-004-P1-K1-F1
gctttggcttgtgtgattggaattgctgtttgttgctgccttccgtgcattattggtatcttgtatgctgtaactgatcaggaggagggagcatctgaagatgacgtaaacaacctttccaaattcaaatttcggacaatgagtgatgcagacaagctagctgccggcattgcagcacctgtgggtggagtgatgacagaatgcggagtgctgtatctgcctatgcccgtatgaagatggcgtggaactacttgagctcccttgcaaccaccattttcactgcagctgtatagacaagtggcttcacataaatgctacatgcccattgtgcaagttcaacatcgtcaagagcaatctccacagagaagaggtctaggtcaataaggggaaaaaaataatcattgcaacacatttcggcatgttcca

SEQ ID NO: 2717 - DNA, 275 bp, Zea mays
  Clone ID: LIB3228-004-P1-K1-F10
ggaacgaacgacgcagcccaacccgttcccaccaaaccagcggcaccaccgatggcttcggcggcggcgagatccggtctccggtcgctggcggtgcgcgccgccccgttgaggcgccgcatgttctcctccgtccacgacgactcctatgagacggccaagtgggagaagatcacctacgccgggatcgtgacctgcaccctcctggcggcgtacaacctgtccaagggccacccacatttcgatgagccgtcggcgtacccctatcttcacat

SEQ ID NO: 2718 - DNA, 381 bp, Zea mays
  Clone ID: LIB3228-004-P1-K1-F11
ggaacggacgacgcagcccaacccgtttccaccaaaccagcggcaccacccatggcttcggcggcggcgagatccggtctccggtcgctggcggtgcgcgccgccccgatgaggcgccgcatgtatctcctccgtccacgacgacgcctatgagacggccaagtgggagaagatcacctacgccgggatcgtgacctgcaccctcctggcggcgtacaacctgtccaagggccacccccacttagatgagccgccggcgtacccctatcttcacatccgcaacaaggagttcccatggggccctgatggctcgtttgagacgaaggaccaccactgagccctgattagcacaccttcaggagctggtgcacgcttaaaaga

SEQ ID NO: 2719 - DNA, 162 bp, Zea mays
  Clone ID: LIB3228-004-P1-K1-F12
ggaaataagaggctcttctgagatgcctgtttgtgtgagtatttgcgtttccattccgttttcatgataataaaacgcattgattattaatatatgtaatgtgatgctacactgagtggcagcgttggtatatatttgtaagaattaagaacccattgttgt

SEQ ID NO: 2720 - DNA, 418 bp, Zea mays
  unsure (1)..(418): unsure at all n locations; Clone ID: LIB3228-004-P1-K1-F2
catcactcaaagccaagcaacagcagcagcttccctagcaacaccttgcccctgagctcatgggatccctgggccccacagtgagcttgagcatnatggccaggccaggcggccagcagccggcggagatggagaggaagaaggacagcggtgtcttcttcggtgggggctgcggcttccggatgccgctgcactacccgcgctacaagaaggcggactacgagagcatgccggagtggcgcgtcgactgcctgctccgcgagtacggccttcccgccgacggcgacgtcgacagcaagcgccgcttcgccatgggcgccttcctctggcccgaccagtactgatccaaccaaacaaagctcagcgctagctagctgcgtgccggccgtgatctcgtcatatttagaggatcagctgc

SEQ ID NO: 2721 - DNA, 416 bp, Zea mays
  Clone ID: LIB3228-004-P1-K1-F4
cgcgctcctcggcggcgaggccagcgtggcccccgacgccgtcctcgcgctcagcccgcaccagctccgccagatcggggtctccccgcgcaaggcgtcctacctccacgacctcgcccgcaagtatgcctcagggatcctctccgacgcctcgatcgtcaacatggacgaccgctccctcgccgccatgctcactatggtcaagggcatcggcgcctggagcgtccacatgttcatgatcttctccctcgcgcgccccgacgtgctcccctccgccgacctcggcgtgcgcaagggcgttcagatgctctacgccctccaagacgtgcctcgcccctcgcagatggacaggctgtgcgagcggtggcgcccctaccgctctgttggggcctggtacatgtggcggctcattgagt

SEQ ID NO: 2722 - DNA, 133 bp, Zea mays
  Clone ID: LIB3228-004-P1-K1-F5
tgcatgcgcttcttgcgattcgtcatgtaaaatcagggtgtctgtctataatctagcctccatggatgctcaaccttcgtcatgtaacaataatcagtgctactcttcattacataattttgatgctatatat

SEQ ID NO: 2723 - DNA, 376 bp, Zea mays
  Clone ID: LIB3228-004-P1-K1-F9
aaaaaaaaaaaaaaaaaaaaaaaaaaaataaaaaaaaaaaaaaaaaaaaaaaaaaagaaaaaaaaaaaaatttaaaaaaaaaaaaaaaaaaaaaaaaaaaaaaaaaaaaaaaaaaaaaaaaaagggggggccgttttagaggatcaaagtttacttccccgtgattgcaacgttaaattttttttttggggcaacttaaattaaattaattggccgggttttaaaaacgttggaattggaaaaaccttggggttaccaaattaaatggctttgaaaaaaatcccttttttccaagttggggtaatagcaaaaaggcccgaaccatttgccttttcaaaaatttgctaaccttaaatggtaaatggaaccccccttt

SEQ ID NO: 2724 - DNA, 426 bp, Zea mays
  Clone ID: LIB3228-004-P1-K1-G1
gttccctgagggtgattcatcgagggagctactagagaaggttcagaagacctactacgtggtcagcctcgttgacaacgactacgtccagggggacctgtttgctgccttcaagatctgattatgctctcatggtctgtattgctgtatggttggacccaacaatattcttgcatccccgactacaggtctgatcgccatgaaagcttctgttcatttgagctcgggggagtccgctagtcttatttttcttgatttctcttggctttctggaaccatacgaatcaataaggaatgagctgtgttcactttccagttcctccgtgcaagtggcgcaacggccaggatcttagatgtaaaattcgctctctaatacagagattggtattgtatgttagtgtaggatgcgctgctcgcattgcactg

SEQ ID NO: 2725 - DNA, 368 bp, Zea mays
  Clone ID: LIB3228-004-P1-K1-G10
gcaattcgccgcagcctctcaccctcgcgagtcccgacctcccgcagccgccggacagatggcacccaaggcggagaagaagccggtggccaagaagcccgcggaggaggagcccgcgacagagaaggtggagaaggctccggcggggaagaagcccaaggccgagaagcgcctcccggcgggcaagtccaaggagggcggcgagggcaagaaggggaaaaagaaggcgaagaagtccgtggagacctacaagatctacatcttcaaggtgctgaagcaggtgcaccccgacatcggcatctcgtccaaggccatgtccatcatgaactccttcatcaacgacatcttctagaagctcgcggtcgagt

SEQ ID NO: 2726 - DNA, 199 bp, Zea mays
  Clone ID: LIB3228-004-P1-K1-G12
cgcactaagcggggcttctgacctgtctcgaccagaccgtctctaccacccctggcctctatcatgacaagaaacctcctccagtaataatagatgcactgcgatcctacgagtgcccggcatgactgctgtgtctttgattgcccttattacacggataagtaggagaagatcgcctactcctacttcggcacctgct

SEQ ID NO: 2727 - DNA, 423 bp, Zea mays
  Clone ID: LIB3228-004-P1-K1-G2
cgaccctgagtagagccaatggagagcagtttagtagaaaagaaaccaccgtcgatgtgtgctgaccgtgctgccggactatgggcagagtggtgctatggttgttgacgaggccgtggtgaacctaggcacggagtcagaggaactggagaccaaccgaatcctgcctaattcatcgtcggtgtcaggaaatctcgccgccgtgccgcgcggtatcgtgggtggaactcggaagttgcataatccgaggtcaagaacaagtaccccaggatgaggcgcatggaggatgttgcgatgagttcatgagaggtataggccgttgtctctcagtcaactatggcggtgctggagcgacaaatctttaggatggcatgatttatttatttcgtgcagaactcctattttgtaggaaaggatgtgata

SEQ ID NO: 2728 - DNA, 424 bp, Zea mays
  Clone ID: LIB3228-004-P1-K1-G3
gccgcatccacaacctgcctctctcgtcccctggcggcgtccgcggcaggatggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacctaaggcaaggcatcggtgtgggtggctttcagaagatctacggtggccgccagaggaatggctcccgcccaccacacttctgcaagagcagtggtgctgttgcacgcaacatcctgcagcagctgcagattatgggcatcatcgatgtcgatcccaagggtggacgcct

SEQ ID NO: 2729 - DNA, 412 bp, Zea mays
  Clone ID: LIB3228-004-P1-K1-G4
cccacgcgtacggccatatttgaaacagttaagaattcatatataagagtgcatatatatatatataattctgccaagacaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcaggtgcagcaccttccgtcgccgctgcatctgcactaagccgtgctaaattaacctactcccggcagctcgatggtggacgtttattctatttattggcttacttgattttttttcccctaacaataagaaaacgcacgtgctggcat

SEQ ID NO: 2730 - DNA, 422 bp, Zea mays
  Clone ID: LIB3228-004-P1-K1-G5
aaaaagaagaaaaacaaatccaaaaagaagaagggcccccttcaacagacagatcctccatcaatacctgttgatgagcttttcccctcaggagaatttccagagggcgaaatccaacaatacaaggatgacaatctgtggagaacaactagtgaggaaaagagggacctggaacgactgcaaaagccaatatacaactctgttcgtcaagcagcagaagttcatagacaggtgcggaaatatatgaggagcatcataaaacctggaatgttaatggttgatctatgtgagacattggaaaacatggtccagaaacttatcaaggagaatggactgcaagctggcattgcttttccgactggatgctccttgaattgggttgcagctcactggactccaaatgcgggcgacaaaactgtgct

SEQ ID NO: 2731 - DNA, 386 bp, Zea mays
  Clone ID: LIB3228-004-P1-K1-G7
atcatctgcgaagccggcggcgatgtcagcaccgcgaaggccaagatgctaaagggcatcggcgtggtcggaatgatcgtggtgaccccggagttgttcggtccggtaatcatcccgaggccgcacgccatcccgacggtgcaagtctctaacgcggcggggcagaagatcaaggcctacatccacaaggcgcggggcccgacggcgacgttcgtcttcaaaggggcagcgttcaacaccccaaggtcgccgatggtggcgcccttctcctcgcggggcccgaacaggaggagccgtgggattctgaaacccgacatcatcggccccggggtgaacatcatcgccggcgtgccctcgatcgaggacgtggacctgctgcgcaacgc

SEQ ID NO: 2732 - DNA, 396 bp, Zea mays
  Clone ID: LIB3228-004-P1-K1-G8
atccagcgtgccacgcgctcacgccagttcatgcacatccacacttacagagttacagttacagccaaccaaccacatcgcatatcaaagaccagaaagctcaaaccaagaccggcgtgcgcggacgaagcacagatccatcggagtgacagcgagcgagagcgagagagacagagagattgtccgcgcgtcagcgactcccggcgaagacgatggggaaggggttcgcatcctacctggcgatgaagacggggccggagggcggcgacgcggcggcggcgcagcaggctctgatcgacgcggacctgcgggagctcggcgtcgccgcgcggaagctcgccaaccacgcattcgtcctcggcggcgggctggggttcggcaccttctttcttaaat

SEQ ID NO: 2733 - DNA, 263 bp, Zea mays
  Clone ID: LIB3228-004-P1-K1-G9
tgggaagtttgacatcgccgggcacagccaccagctggtccacgtcttggggtgggccggagcctacacacactaccacgcatggcttgtgtacctcaagtggagagaccttcaaggctgctgaaagggactgcatcgttgaggatgtggatagattgtagattccgtgaattcaggcttaaggtcatggtctggtgtaaattgtaacactaatcatgaaacaattgctacaagtctaccatggtagcgtgctttcattatat

SEQ ID NO: 2734 - DNA, 365 bp, Zea mays
  Clone ID: LIB3228-004-P1-K1-H1
cgaagggagaagccgcgaggtccaaatccgagtccgaagctttgaggcacctgacagcctctgcagtcgactgtagaggatcccaaccgagctttgagaggcgcaccatcctttcttctaatttggtttagatatttatgaattcacaaacaaaaatatagaatatcaagcagtataaaagatctcaagtcaaacctaacatttttttttcatttctccggatgatttctatttgttttggtgtgtgtggttggaggggtattggaagcggaagcggaggcggagggtttgatactttaggctatttcatgcagcttactaattcttggacccatatttaaattttattatacgaacagtaaaaa

SEQ ID NO: 2735 - DNA, 60 bp, Zea mays
  Clone ID: LIB3228-004-P1-K1-H10
cccacgcgtccgcccacgcgtccgcccacgcgtccgcccacgcgtacgcccacgcgtccg

SEQ ID NO: 2736 - DNA, 318 bp, Zea mays
  Clone ID: LIB3228-004-P1-K1-H2
cgaacgcgagtggagacaatggagagcagcctagaagaaaagaaactaccgttgatgtgagctgaccctgctgacggacaatgggcagagacgtgctataataagatagaccaggccgtagcgaacctatggcgccgagtcagaagaactggagaccatcctaatgctgcgtaattcatcggctgtgtcaggagatacgccgccgtgcccggcggtatactgggtgtaaccctgaagtgtcataattcaatgtctagaacaagaactcgagtatgaggctcaaggaggctgttgatgtgagttcatgcgaggcatagg

SEQ ID NO: 2737 - DNA, 380 bp, Zea mays
  Clone ID: LIB3228-004-P1-K1-H3
aaactgtggaactgattgaaacatttatgaactatcaggagagcatcaggagatgtgtgtgcattgtctatgacccatctagatctagtcaaggcgtgctagctctcaaagccttaaagcttacagactcgtttatggatctttaccgtaacaatggtttaactggggagaagttaagggagaagaaattgtcctgggttgatatttttgaggagataccaataaaagtttccaacttagcgcttgtcagtgcctttatgaaggagctggaacctgagtcacctgttacccagtgtgacctggaccgacttaaattgtcaaccgccccctttatggaaaggaacttggtatttttgattgggtgcatggatgatctttca

SEQ ID NO: 2738 - DNA, 335 bp, Zea mays
  Clone ID: LIB3228-004-P1-K1-H4
gcggacgcgtgggttcatatttgaaacagttaagaattcatatataagaggcatatatatatatataatttgccaagacaaaggaatggagtcgtacgcatgtttcagccggccaacatcctgggggtctgctcattgggaccaccgattggcgcaggcggcggggaatgcgagaaggacagctagcgattccttggggcatgcatggggtcggacaactgcaccaacgtgtgccggagagggctctcccggagagtgcagtacctttcgccgccgctgttttgcgctaggccggctaataaactctcccggagctctttgaggacgttattcta

SEQ ID NO: 2739 - DNA, 172 bp, Zea mays
  unsure (1)..(172): unsure at all n locations; Clone ID: LIB3228-004-P1-K1-H5
gatttaaaaaaaaaaaaaaaaaaaataatgaataaaaaaaaaaataaaaataaatggtgaaggaaaataaaatagttgtttatgtgtattaaaaaagagaaatattttaaggtgagatagtttattatatatanggtatgttttattttttttgtaagtttaaatttatttt

SEQ ID NO: 2740 - DNA, 276 bp, Zea mays
  Clone ID: LIB3228-004-P1-K1-H7
atcatctgcgaagccggcggcgatgtcagcaccgcgaaggccaagatgctaaagggcatcggcgtggtcggaatgatcgtggtgaccccggagttgttcggtccggtaatcatcccgaggccgcacgccatcccgacggtgcaagtctctaacgcggcggggcagaagatcaaggcctacattcacaaggcgcggggcccgacggcgacgttcgttttcaaaggtgcagtgtttaacaccccaaggttgccgattgaggcgcccttcttcttttgg

SEQ ID NO: 2741 - DNA, 244 bp, Zea mays
  Clone ID: LIB3228-004-P1-K1-H9
ctcttattttgtgagtctattatatttctgattgttatagagtttatggaaatttaggaagggttctttgaccggaactgccttcgacccgatgcctttgccaagtggtgttccagtgcctatgagttattgtggtgatccttgtaaggatggtaagtctgtagatcatgacacctatcgacagaagtattggatgtgtgctaactttgcatttgagccaactgtggttcaacgttatatgaat

SEQ ID NO: 2742 - DNA, 329 bp, Zea mays
  Clone ID: LIB3228-005-P1-K1-A1
cccacgcgtccgcggacgcgtgggcgtcaccgacgaggcgcgcaaggagttcgccgccctccgccgtgctttcgatgacgtcaaccaccagctccagaccaagttctcccaggaaccccagccgattgattgggagtactacagaaaaggaattggatcaaaagtggtggatatgtacaaagaggcttttgaaagcatcgagatcccgaagtacgtggacacagttactccccagtacaagccaaagtttgatgctgtgattgctgaattaaaggaggctgagaaagagcatcagaaggagtcagaaaggatagagaaggaacttgctg

SEQ ID NO: 2743 - DNA, 390 bp, Zea mays
  Clone ID: LIB3228-005-P1-K1-A10
gagcacctgggcgcggtggacgacgcgttcacccggccggacagcgtcgagtgcatccgcaaggtgaacgccatggcagacaggtactgggacctgtacgccggtgacgggcccgagcgtgacctgccggggcacctgctcacctatcccgtcgccgtcgccactgacggctcggtcaatcagctgccggggatggagttcttcccggacacgcaggcgcgggtgcttggcgccaagtccgactacctgccgcccattctcaccacgtaggcgtgtgctctgagcctctcactggatcggaatgcccttcttcttctgtttgtcttttggatttactgttttcccccttctggacctgatctgggcgattatggtttggagtaagagcag

SEQ ID NO: 2744 - DNA, 204 bp, Zea mays
  Clone ID: LIB3228-005-P1-K1-A2
gcccaacctgttcatgtgatgggcctcggcgggcgggcgggctgttgcacctgtgttttgtgtcttagtgtccagagagataaaggtttttgcctctgcaagctttgctgccccgtggactgatgatttttttggatgatggtattgtattgcaaacccttgactttggtcctactagttatgagaaggctgctgtgttaaaaa

SEQ ID NO: 2745 - DNA, 395 bp, Zea mays
  Clone ID: LIB3228-005-P1-K1-A3
agcaaccgtgtgccttttggagacgcgctgtcgtccggcaacaagatcagcgtggccttgctgagcgtggccctagtggacctgctcctctgccacctcggcaccaccgcctccgaccaccagaaagacattcacgtactcggcagcgtcgacggctccagcgacggcagcagccccgagtccgaaggccgcgtcgtctacgcggacatgaaactggctgatacggaatacgatgcgccggcgccggcgccggcgccggggccgacactcggttgaactgagaagcgtgcgtccagccaagcaaggtggtcaaaaccgtgaactaattaagggctcgattgtgtgtccggctactactgttcttgccataattatatatagatacgcaaagtgtg

SEQ ID NO: 2746 - DNA, 116 bp, Zea mays
  Clone ID: LIB3228-005-P1-K1-A4
cccacgcgtccgcggacgcgtgggacttgctgtattgtgggaactctacccatggtaaggcgtgcataatggctgtgcaaagtacctttttacactatcgatcgactacactgttt

SEQ ID NO: 2747 - DNA, 397 bp, Zea mays
  Clone ID: LIB3228-005-P1-K1-A5
ccatagcgcaggtgatcgagagagagaacagaagggaggagagagggcctcgccggcgaccttcgctccggccttgatgtgggtgcccagttcctcgttgggcagtgccgagcgtacaccgagaaggtcgcgctctcgccgatcaagtttggaggacgagctgcttagaacgcgtcgttggcattgaaagaagtcatgggctcctacacaaatgcaattcgacgtcgtctacgtctagaccaacgcgtgaggttacgagccacctgaagaacaagttggtagctggaatctcaagtgctaggcaagttgtgcccttgatcacttatttttacccactcatgttctaattaatcataatgatctgcatagggtaattttgatgggtcctaataggata

SEQ ID NO: 2748 - DNA, 396 bp, Zea mays
  Clone ID: LIB3228-005-P1-K1-A6
tggaatcacaggcatcactaacagaggacatggggcgccaagttttggcatttggtgaaaggaaacctgctgagcaccttctcaaggctatagatggtgttactatgaaagatataacgtctgttgctgaaaagatcatttcatccccattgacaatggcatctcatggaaacgttctgaatatgcctacttatgagtcggtcagtggcaagttccgctcaaaatgaggagtacatgacccttcccttcattttatcaccttgtttgctggacaagttttaccagtaccttgtcattcacgtctaggccatggttcttggtcagtttcagaagaaataagcaacctcatgcagttttgttcgtgaaacctgtgatcacttcacaattattcccttt

SEQ ID NO: 2749 - DNA, 336 bp, Zea mays
  unsure (1)..(336): unsure at all n locations; Clone ID: LIB3228-005-P1-K1-A7
ctctgatggttcttatgtaaagggttacagatgtgaatcaggtggattccactcggtgtgtgtttgccttttgtgcaaaaattagttgtctaaagacaaggggagatatcttcttatgtttctatccattatttaagaatattgtctaaataattatacgatagcttagttaaatagtttgtttatttatagacaaatgtagcgctagttaactagttgtgatttttaaaatttctcagctatatgttaggaaatattttttaacacttcaataatatatctttgttctccctttattataaagttcaatactttttgtcngaaaaaaaaattaat

SEQ ID NO: 2750 - DNA, 392 bp, Zea mays
  Clone ID: LIB3228-005-P1-K1-A8
gccaccgatcggcgtgccgcgtgcgtgaggcgatcggagcatcccgtcccgaggaggaagacaaccggcgacgcggggggaacatggggaagacgccggtgcggatgaaggcggtcgtgtacgcgctgtcgcccttccagcagaaggtaatgccggggctgtggaaggacatcaccaccaagatccaccacaaggtcaccgagaactggatctccgccacgctcctcctcacccccgtcgtcggcacctaccaatacgccatgtggtacaaggagcaggagaagctttcccacagatattaaatgcgctgcccttgacagacagcactcggagttttcatgatgggtttcataatcctcccatgatgatttaacatttgtttgatcaatttc

SEQ ID NO: 2751 - DNA, 351 bp, Zea mays
  Clone ID: LIB3228-005-P1-K1-A9
cccacgcgtccgcgatcgcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgacgacgctgctgccgaggcgtccccgactccaggcggatccacctacgggtgcaacccggccacggacaagtcgtgcaagcccgagggcgtcggggtggtgctgccaggcggccgcatccaactggacttccacagagacgaggaccagctgtcgcaaatgcagccccccctgatgatcct

SEQ ID NO: 2752 - DNA, 397 bp, Zea mays
  Clone ID: LIB3228-005-P1-K1-B1
cccacgcgtccgggaagatccttgattgctaatacttgctgcttcgtcaatagagtaactggtgttaaatctaatggtacaaagaatttcattgttgttgatggcagcatggcagaactcatcagacctagcctgtatggagcatatcagcatatcgaattggtctctccccccactcctggtgctgaagtagcgaccttcgatattgttgggccagtttgtgagtctgcagatttccttggaaaagatagggaacttccaacacctgatgagggagctggactggttgttcatgatgcaggtgcctactgcatgagcatggcttccacctacaacctgaagttgaggccgccagagtactgggttgaagaggatggttcgattgttaagatcaggc

SEQ ID NO: 2753 - DNA, 181 bp, Zea mays
  Clone ID: LIB3228-005-P1-K1-B10
ttggttttttttggcaccaaattcaaatacattccagttgaatgccattccttattcaggaaaagaaaaaagaggatagactcaacacgacatgatcaacacaagatgttgaccgtataaaatagaaatattgttcaccgaatgccaccctgaacagtaacaagaattttatcaaaataac

SEQ ID NO: 2754 - DNA, 390 bp, Zea mays
  Clone ID: LIB3228-005-P1-K1-B11
gctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgatccccgacaaggagatcctcaagattgtcaaggagaacttcgatttcaggcctggcatgatcatcatcaaccttgacctcaagaaaggcggcaacgggcgctacctcaagacggcggcctacggccactttggaagggacgaccct

SEQ ID NO: 2755 - DNA, 389 bp, Zea mays
  Clone ID: LIB3228-005-P1-K1-B12
tgatgaacaagcgtaagctgaccccatccatcccccctttggaattcttcagcaccgaacctaccttgttcttctgcacctgcagttgctctttggcaaaagatggatgccacgcctcggagggtacggtggctgtggcagtgtctgtgtctgtgccgacgggccccgcgctgcctcttgtgagtatgttctttttgtgcgtccttgtttcttttcttttttccagtgagagagagagagagctggctaaagatgagggagaagctggcacgtaatagggtcgatagttaagcatgatcatcctgtgtatttgcatggagacaatctgtcggtacatgcagtgatggtttgtagtagtatctgttacatatattgcatgtgtcaatatc

SEQ ID NO: 2756 - DNA, 398 bp, Zea mays
  Clone ID: LIB3228-005-P1-K1-B2
cgacaacgaggccatctatgacatctgcaggcgctccctcgacattgagaggcccaactactccaacctgaatcgccttgtgtctcaggtgatctcatctctgactgcttccctgaggttcgatggtgccctcaatgtggatgtgaacgagttccagaccaacctggttccttacccgaggatccacttcatgctctcctcctacgcaccggtgatctcttctgcgaaggccttccacgagcagctgtctgtggcggagatcaccagcagcgcgttcgagccggcttccatgatggtcaagtgcgacccacggcacggcaagtacatggcttgctgcctgatgtaccgcggcgacgtggtgcccaaggacgtgaacgccgcggtggccaccatcaaga

SEQ ID NO: 2757 - DNA, 398 bp, Zea mays
  Clone ID: LIB3228-005-P1-K1-B4
cccacgcgtccggagtaggcgaagtagcgccgggagaggaacatggggacgccggagacgtcgcgggagccgtgcccggaccggatcctggacgacgtcggcggcgcgttcgggatgggcgccgttggcggctccgcctatcacttcatcaagggcatctacaactccccaaacgggatgcgcctgtccggaggcgcgcagaccgtgcgcatgaacgcgccgcgcgtggggggcagcttcgccgtttggggcggcctcttctccaccttcgactgcgccatggtgtacgcgcgccagaaggaggacccttggaactccatcgttgcgggcgcagccacgggcgggttcctctctatgcgccagggcatgggggccgcgggccggtccgcgctcatggg

SEQ ID NO: 2758 - DNA, 396 bp, Zea mays
  Clone ID: LIB3228-005-P1-K1-B5
gtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttct

SEQ ID NO: 2759 - DNA, 400 bp, Zea mays
  Clone ID: LIB3228-005-P1-K1-B6
cccacgcgtccgcccacgcgttcggccgtggagaagaccgtcgtcgaggaggagaagccagcggcagcagcccatgcagaggaaaaggtcgccaccgccgccgagaccacgacgacggtggaggcgaagaagaacgccgaggaggccgggaaggagaagctggcgcagcaaagctgatcgactgtccgtgcatgcgtgccaattaatataattggctgatgatgcctgatgttcagtgtgtgatactgtgatcaagcaaggagacgacacttgaattctctacagtttggcataggtcgggagagacactcttgaccggccacaccatgtaacaaactaaccttcttcgttggctcccattattttcctccacggagttcttctgatgaaacaacatgtt

SEQ ID NO: 2760 - DNA, 325 bp, Zea mays
  Clone ID: LIB3228-005-P1-K1-B7
cccacacgtccaatgtatggttcgtgaatccgtgaagcgagcatgtatacattcgtgtcatgataaaagtagtgcagtcaccacgctctgtacaacctggcaggatcctgctgttccggctcatttggtgaatcgatctagcacttgctcaagagcgtgtcaattcagaagccatttgccgctgtatggatggtcccaaaccactcgcctaaatgctccctggcgtgggggttttttgcctgtttggggagaacctttcttccaccttgaatttgtcattgtggacgcggaacaagatgaggacccctggtactttgttttggtg

SEQ ID NO: 2761 - DNA, 347 bp, Zea mays
  Clone ID: LIB3228-005-P1-K1-B9
accacgcgtccgatcactcgttcggccgtcctttaatctttcatgtggaaatgagtcaaatgagtcatgtcatggattaccatcaaacgcatcagggtattccatgaccgccgtgacagacaatggcgcgtactagtatggaccaccaccactactcgcacacgtacttctgccccatggttgtctgcatacatacacgcgtacacctgcacctaagactgcggcacacacgacttgtgctgcactcacgcacgccagaccaggccaaccatattttggagtaggaaccaggtatccagcgcggatctagcggaagaggtgccttaaggcggtattattaagggagg

SEQ ID NO: 2762 - DNA, 397 bp, Zea mays
  Clone ID: LIB3228-005-P1-K1-C1
aggaccccgaacgcctggctagagaaactgtttttaatgtgaatgaaattgaggctctgtatgagctgttcaagaagattagcagtgctgtggttgatgatggcttgattaacaaggaagaattccaattagccttgtttaagaccaacagaaaggatagcatgtttgctgaccgggtatttgacttgtttgacacgaaacacaatggaattctcgagtttgaggaatttgctcgagccctttctgtgttccatccgagtgcaccaatcgatttcaaaattgattttgctttcaaattgtatgatctcaagcaacaaggtttcattgaaaagcaggaggtcaagcaaatggtggtcgcaacacttgctgaatcaggaatgaatctttcagatgatat

SEQ ID NO: 2763 - DNA, 357 bp, Zea mays
  Clone ID: LIB3228-005-P1-K1-C10
gaccccgcctgcaccaagatgtgcaaccaggcgtgcggcagcaccgacaagggcgccgccgccggcgcgccggcttgatcgacccgggcttcatcggcgcgcgggctcagctcgatatcagcatcatatacaatcgctgctccgtcgctcacgtcagcccatgcatgatctctcgacccggcccattgaatcttctccttctactatagtatatctttgttgcaggtcttcgatctcatacatagatccactcatcttttttttaattcctaccattaagggagatgacctatatatatatatatatatatgcatgattcagctatttaaaaaaaaatgttatcgtgttgtgcctcg

SEQ ID NO: 2764 - DNA, 388 bp, Zea mays
  Clone ID: LIB3228-005-P1-K1-C11
cggacgcgtgggggcggccacgtgaaccctgccgtgaccttcggtgcctttgtgggcggcaacatcagcctcctcaaggccctggtctactgggtggcccagctcctgggctccgtcgtcgcctgcctcctcctcaagatcgccacgggcggcgcggccattggcgccttctcgctgtcggcgggcgtcggcgccatgaacgccgtggtgctggagatggtcatgaccttcggcctcgtgtacacggtgtacgccacggccgtggaccccaagaagggcgacctcggcgtcatcgcgcccatcgccatcggcttcatcgtcggcgccaacatcctggccggggcgccttcgacggcgcctccatgaaccccgccgtctccttcggccc

SEQ ID NO: 2765 - DNA, 386 bp, Zea mays
  Clone ID: LIB3228-005-P1-K1-C12
acgacgtgaagctgttcctggacacggcggaggaggacacgtggtcctgcgacgtctgctgcaagcacgccccatacacgcccgtcaaaaccacgctgctcgccaagaacaaggacttcgaggcgctcatgcgcgtagcccacgcgctcatcaagcgggccaccggtggcgccggttacgcgccggcgccggcgcccggcgcccgcgccaagattcattaatcgattattaattcgctgattaaaccgcggagcgccatacatatctcgatccatattgcatacgttggcttataggatctaattgacatcggctcgattatatggaccacactttggcattggattcggttcgctgttccaaacttttaccacagtgtttatttt

SEQ ID NO: 2766 - DNA, 398 bp, Zea mays
  Clone ID: LIB3228-005-P1-K1-C2
ctctcttcctggtccaagtgatcttgccaagttacgagcagcgagcagagatcagatcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccgccccaccggcaccgtggagcaggtggcgcatacgggccatggcgtggcggatggcgtcaaggacacgggggcgggcgcggcagttggcgtcacaaacacatgggcggacgcagcaagggtcgataggaacacggtcacggacgccaatgcgggcgtcaccaacacggggaccaggactgaagctgttataaagga

SEQ ID NO: 2767 - DNA, 396 bp, Zea mays
  Clone ID: LIB3228-005-P1-K1-C3
cggacgcgtgggcggacgcgtgggcctcgcacccctaccctccggcaccccaccacatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgtcgcctctacaccgttttcttccacggacgaggagtt

SEQ ID NO: 2768 - DNA, 176 bp, Zea mays
  Clone ID: LIB3228-005-P1-K1-C4
tgctcactccgttcttttttatttgtcggcgtttagttcagaaatgaactagcggacgacaaatattagagaacggaggtagtactatgcaagcctacccatgaaatctggttcccctattggcgtctaacagtttattttgtattccacgatataagaaatacaaaggcatgcac

SEQ ID NO: 2769 - DNA, 399 bp, Zea mays
  Clone ID: LIB3228-005-P1-K1-C5
gaaatggcaaccgttccaggggatctgatctggcaggttgtgaggaagaacaactccttccttgtgaagcagttcggcaacggcaatgccaaggtgcagttcaccaaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcggtgtaccgcagcctccacgttgcc

SEQ ID NO: 2770 - DNA, 398 bp, Zea mays
  Clone ID: LIB3228-005-P1-K1-C6
cccacgcgtccgcggacgcgtgggctgtgcaagttcatcgcagaaaaactcttactcttcttgtcagatgattgaagaactggcgaaggcccttatttcagcaaagcagttgatggtgcttgatcttagctgcaatggtttgtcggaggaggcagtccagtcactgtattctgcttgggcgtctgttccgagaggcgatggaatggctcggaaacatgtaaataaggaggtggtccacttttcagtggatggtatgaggtgctgcggcctaaaaccctgctgcagaagagacctgcaaatgtgaaccctggacgaccttccgatgctaaattatggttgcactctgtaaataaatcatgagtgaatcaactaggcgttgaagcattgtcaatgcaact

SEQ ID NO: 2771 - DNA, 390 bp, Zea mays
  Clone ID: LIB3228-005-P1-K1-C7
cggacgcgtgggcggacgcgtgggcggacgcgtgggtcagcatctatcggcagggcagagaagtgacccttgtgataggctgacagcagagacaaactcgtacacgagatcaaccaacggcatcgctgccactgcagcaggagtggcagcaactactcacagaaaggtcggcgttgttccgtttggcatgtcaaacatgtattagtgactggatcatggccgaatcatggtgaatcctctgtgcggttgctgggtctatgctgccttcaggtggctaaacaccgacaacttgaagcggccaatcaaacctttggctggatgctgcaagtttagagtgcagtagacagtgttttttctgtgtggtcaggaaaagaggaacaccgctggcgg

SEQ ID NO: 2772 - DNA, 60 bp, Zea mays
  Clone ID: LIB3228-005-P1-K1-C8
attaaatcctataatctagatgtccggatctttcaaaacaaaagtatccttttgctgtcc

SEQ ID NO: 2773 - DNA, 389 bp, Zea mays
  Clone ID: LIB3228-005-P1-K1-C9
cggacgcgtgggtccaggacaagttgtcggctgagtggaagcccatgaagctctcttggggcgccatctggaggatggacactgccaaggcgctcaagggccccttctccatccgcctcaccagcgagtccggcaagaaggtcatcgccaaagacgtcatcccggcgaactggagacccgatgccgtctacacttccaacgtccaattctactagactttgaattcccttcgattcatccggcacagcgggctatggaccttcagcagcaagctaattaagttggcagcatgcaccgctaaccttatatactactgagacttccaaattctagtatatgtaatccttttgttcgggttcatgatcgaattccaaagagtggaaaacaag

SEQ ID NO: 2774 - DNA, 398 bp, Zea mays
  Clone ID: LIB3228-005-P1-K1-D1
cttcacttcctcgctggcccataaatatatatctatctatcgccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcag

SEQ ID NO: 2775 - DNA, 382 bp, Zea mays
  Clone ID: LIB3228-005-P1-K1-D10
cttattggtcgaaagcagggacaggtacctagagcgcgctctccagctgcttatgctcgaagcaccccaagtggaacaagtatatgatgctgcggctcaacaggaagcgccttttattgagatagagatctaagtaagctcatattgtgactatggatgtaaagcttcttctgcatcatcactgagactcgttatgataatggtctgcctttgcagacgtactttgatgtagacgtaggatatataaacctgcctttttgattcattataccatgttttgagactgtgtttatattgtgatttgacgataattatatgatgctgtaagtttaatcagattgctgtcacttgattaatggaaatgcagaaattgatctgattg

SEQ ID NO: 2776 - DNA, 63 bp, Zea mays; identical to SEQ ID NO: 1786
  Clone ID: LIB3228-005-P1-K1-D11

SEQ ID NO: 2777 - DNA, 309 bp, Zea mays
  Clone ID: LIB3228-005-P1-K1-D12
cattaagccaaggaattggttgagtggagattgtcggactacgctattaccggctgcacaactagtttatttctcttacctatctatataggaacagctcagactcaagtcgaatctgaaggcccttttgggaacgcaacattttcttagtctcgaggtataatgttgtggtatttaaacaaactactagtataatgcacgtagttgcgacggcacataaccatatgaatatatgactgatattaacttacattttagtcaaaaaggccaaaaaagtataggttcaaaaggagcctggccttttttttt

SEQ ID NO: 2778 - DNA, 203 bp, Zea mays
  Clone ID: LIB3228-005-P1-K1-D2
tcgaaaaaattattagataagaacaaaaataaatatctatataatcgacatataacaaatagtactgtcgcagtatagtgaacatgatggggcaagcctcactggtcgttctactcggcgtctgggggctgctgttctacggtctcctcccgcaggcgctgagtaagggtaggggaggcagcctgcacggtggcaccttaaac

SEQ ID NO: 2779 - DNA, 305 bp, Zea mays
  Clone ID: LIB3228-005-P1-K1-D3
tgatgatccagagatcagtgacaagatccacgaaattgtcgctaatggctaaaaacaatagtagaatcgtttttttttactctttttttgttttgacttgcatgctacgggaagcttgaggggattcaattaattctagtatatgtaagtctggtttccagttgaatccatcatttgtcgcaccatcattcttcctttgacagtgcatcagtttttttttggttgatttggatctgtacaattttccttatgtactgatgcttataatagtatacgcaataatattcaggtacagttttgatggt

SEQ ID NO: 2780 - DNA, 390 bp, Zea mays
  Clone ID: LIB3228-005-P1-K1-D4
attagaggagcactgaagactgagagccttactctggttatgatctttcttcctctatattctaaattgcttttttcaatccccttgcacctggatggaattccgatcccacaccatgtggtgttcttcctctatcgaataaacgttgtttctcttgtctaatcatcaaatcgattgggcattgcaagagtcaatcctagagactctacggaaggacacaacgtgccgcactctgtttgagaagaggccgtgcgcgagaatgaagtgctcaacccggactcgtggccggcgaccagcatgcgccttgccgttctcttgtttgattcatttatctgatctttctaacaaaattgcccttgactttggcctttctgcctttttctcactttc

SEQ ID NO: 2781 - DNA, 395 bp, Zea mays
  Clone ID: LIB3228-005-P1-K1-D6
aaaaaacataaaaagaaaaaaaaaaaaaaaacaaaaaaaaaaaaaataaaataaaataaaataaaaaaataaaaagaaaaatgaaaaattatataaaaaaagtaaaaaaataacaaaaaataaaataaaaaataaaataaaggggggggtttttttgggggttccagttttctttccgcgtttttggggggttttttttttttttttggggcccttaatttaatttcttggggcgggtttttacaccttggggtttggaaaacccttgggtttcccaattttattggctttgaaaaaattcccctttttgcaggtgggtgtttttttaaaggggccccgccttttcccctttccaaaaatttgcccacccttattgggaattggaaccccccttt

SEQ ID NO: 2782 - DNA, 390 bp, Zea mays
  Clone ID: LIB3228-005-P1-K1-D7
cctcagccaaagttgacagcagcctacaagcgccagcagagctcttcccggtggccatggccaagcccccgcttcagacagcaacgatcatcctgctcgtgctcctcgtggccgcgtcgtgcctccacaccgtcgacgccgccgctttagggttctcctggggcaagtgttgcgttcggtgcgcgagggcgaccacgcggcgggcacgggaggcgtgcatgagctcctgcggcctaaaatgcgagttttgcaaatgcgggcctgcgatgccgccgcgcgacatccatgactgcccctgctaccgcaacatgctcaccgccagccccaagaagaggcccaagtacccttgagactgagactgcgaggccggctcacacgacggcattcatg

SEQ ID NO: 2783 - DNA, 390 bp, Zea mays
  Clone ID: LIB3228-005-P1-K1-D8
actacctcggggagcagttctacatcagcgtcatctcgccggcgcggtcgctgcgcgacgagtacaacatgcccgacaacgccctccgctgcggcaaggtcgtggggctgccgctgccgccatcctacgcccccgcgcgctaaagacgacgaaggcgccgttttcacctcgtgttctgaccatccagtctaactaatccattcctgtgctgctcggcgaaataaaatcatcaaaaagaacaaagacgaaggaagcctagggaagggagaagggacgttgggtgggggtgagccaaatgagaacgcacggatatatctattgatgtaatcttgagatgccctctcaaatcactgtaatggggtttaaaaaacaatcattgtaatgggagtt

SEQ ID NO: 2784 - DNA, 342 bp, Zea mays
  Clone ID: LIB3228-005-P1-K1-D9
actacctcggggagcacttctacattatcgttatatcgccgatgcggtcgctgggctacgagtacaacatgcttgacacacgccctacgatgctggatggtgcgtgctgctgccggtgtcaccattctaagccgtcgaccgctaaagtctacgaatgcgccggtgtaaccttgggttatgaccatccagtctaactaatccattcctgcgctggtcgggcatgtaaaattatcaaatagaacaaagactaaggaagtctaggcacgggagaccggacgttgagaggcagtgactgcacctgataacgcaccgatatatctatcggtgtacaactagagatgc

SEQ ID NO: 2785 - DNA, 397 bp, Zea mays
  Clone ID: LIB3228-005-P1-K1-E1
caaagaatttactgcaagggaggatattgctattgtgctcatcagtcagtatattgccaacatgataagatttctggtggatagctacaacaagccagtccctgctattctggagatcccatccaaggaccatccatatgatccagcgcacgactcggtgctgtctcgagtgaagtatctcttctctgcggaatcggtggcgtctgataggcgatgaaggcatccttgtgtagtagtaccctttggtgtatctgttttgttatgtattgaaaagaagtggcatgcgtccgagcgagacagcaaacaataataatggttgtggaaccaaaccaacacctttttttctttcataaaaggttggaatgctattttgttgctttgtactgtatttggttgg

SEQ ID NO: 2786 - DNA, 302 bp, Zea mays
  Clone ID: LIB3228-005-P1-K1-E10
gacggccacgagggtgaccagtactagacgctctactggcgcggcgtcctcgggcttgtgtgccactgatatcctgtgatctgccctgagtggctcctatcatgttatgtttctgtcggttcttatctatctgtgcgggtgtggtttacaacttacagtggaagactttattcccccgctttgctactgggttattaagtttggcgttattggtttcttgatctctgacatgctctgctttcaaaaaacaaaaataaacctatacatgaagagagttctaggagaggacaaataataagaag

SEQ ID NO: 2787 - DNA, 397 bp, Zea mays
  Clone ID: LIB3228-005-P1-K1-E2
caaagaatttactgcaagggaggatattgctattgtgctcatcagtcagtatattgccaacatgataagatttctggtggatagctacaacaagccagtccctgctattctggagatcccatccaaggaccatccatatgatccagcgcacgactcggtgctgtctagagtgaagtatctcttctctgcggaatcggtggcgtctgataggcgatgaaggcatccttgtgtagtagtaccctttggtgtatctggtttgttatgtattgaaaagaagtggcatgcgtccgagcgagacagcaaacaataataatggttgtggaaccaaaccaacacctttttttctttcataaaaggctggaatgctattttgttgctttgtactgtatttggttgg

SEQ ID NO: 2788 - DNA, 194 bp, Zea mays
  Clone ID: LIB3228-005-P1-K1-E3
attccaaagagtggaaaacaagcaaaaggttaaatatacatgccatttttggaggcattttaaaaaaaaaaaaaaaaaaaaaaaaaaaaaaaaaaaaaaaaaaaaaaaaggacggaccatctaaaaagatccaaacaaaaaaacgcgtgcatgcaacagaaaaagcttttctatagtgccccctaaattcaatt

SEQ ID NO: 2789 - DNA, 333 bp, Zea mays
  Clone ID: LIB3228-005-P1-K1-E5
cccacgcgtccgcccacgcgttcggagaggagaaccagcagcctgcaataagagccagccagagaaactaataaaactctcgccgccgccatccgagcgaacaagccaaccgaccccgtccccaaggcaatccgccgtcgacgtaccaccaccaccgcaggagcgagatggagatgaagaggatcctctttgccgtcctcgacgtaatcggcgtctcggacaccgcagtgctggcctccaccgatgccgcccgcgcggtcgcgccaactgcctcagagtcgcccgtacaggctcccgctggctatggcgctggcgctgccgttggtgccgtcg

SEQ ID NO: 2790 - DNA, 100 bp, Zea mays
  Clone ID: LIB3228-005-P1-K1-E6
gcgggagaagatgctgcatcacatccaccaagaaatcccctatgtaattgagcatcgtctgatgggctggaaggggctaaaagatggttctcttaaggtg

SEQ ID NO: 2791 - DNA, 389 bp, Zea mays
  Clone ID: LIB3228-005-P1-K1-E7
aggactataggccttacttcaatggctaatcaacatacaaataaatcttatctacacgagatagacatgtgaattgctctcttgagacggcgagttcttttgccagatggaaaatctagcatcattctgcccttttttacacataagacgtttatgagcaaatcatcaccatgtacgaaattatctattcttttgctagtttctgctcagcaggtattgggggccttcggcttccgaaggttctcaaaaacacgatttaacagtgtttctggagtataatgatgtgaacaggtatcttcggactcgtatcggtgccacagtgggagaagccccatgaatacgcaggtcgacacagcacccaagctgtgagcacgtaagcctcgccgtaa

SEQ ID NO: 2792 - DNA, 332 bp, Zea mays
  Clone ID: LIB3228-005-P1-K1-E8
cccacgcgtccgcccacgcgtccgcggacgcgtgggacttctgtgagcgattccttctctcagcaacttcaacttctctctgtttctcacgagcagtgctgataacgtgttaaactctatcacaacgctcagtggcaaatgaagattaacagagacaaagacaaatcgctgggacaatcctttattgcagagtagtgaagtatatatacaagagtttccaaggggtgtgtcccttgggaaataactgtcactacgacatatggatggattagatcacatgtataaaatgttttataacaatgtgaaaccacatctgtggaactttcagtgtg

SEQ ID NO: 2793 - DNA, 389 bp, Zea mays
  Clone ID: LIB3228-005-P1-K1-E9
cggacgcgtgggcggacgcgtgggcggacgcgtgggcggacgcgtgggcagctataaatctgcagtttacaagggcgctcatcggctggggcttccagctcatggtcctgaaaggtctgctctactcgatgggtggtggcgaggtgccactgctcgacttggtagcgtacggcggttatttattcgccgggctatcgctcgccgtcgtcgcgaggctcgtgtgggcgtactcgtactatgtgatgatgccgtggatgagcctgtgcatgggggtgttcctggtgaggacgatgaagagggtgctcttcacggagatgagaagcagcgagaggcactcgtcgcggcagcactacttccttctcttcatggcaatcgcacagttccccctg

SEQ ID NO: 2794 - DNA, 175 bp, Zea mays
  Clone ID: LIB3228-005-P1-K1-F1
cccaaatgcaaattaaaagtggtggaaccctgttgggactcgctgtcctaagcgggggcacctataaagtggcgcattacaagggcgctcatcagctggggctttcagctcatggtcctgaaaggtctgctccattcaatgggggcggccgaacaacaggtactaagcttaaaaa

SEQ ID NO: 2795 - DNA, 392 bp, Zea mays
  Clone ID: LIB3228-005-P1-K1-F10
cattcatcggtcaaagacaaaagatgattgctgtgagcatcatgtggtcattagtgcaggtgcaggtgctggcggcgatggcactagcatttctggtaggcggtgcctggtgtggtcctcccaaggttcccccgggtaagaacatcacagccaactatggtagtgattggctagatgccaaggcaacatggtatggcaagccaacaggtgccggcccggacgacaatggtggcggatgtgggtacaaggacgtgaacaaggcccctttcaacagcatgggcgcatgtggcaacgtccccatcttcaaggatggtctaggttgtggatcctgcttcgagatcaagtgcgacaagccagcggagtgctctggcaagcccgtggtggtgtacatt

SEQ ID NO: 2796 - DNA, 396 bp, Zea mays
  Clone ID: LIB3228-005-P1-K1-F11
cattcatcggtcaaagacaaaagatgattgctgtgagcatcatgtggtcattagtgcaggtgcaggtgctggcggcgatggcactagcatttctggtaggcggtgcctggtgtggtcctgccaaggatcccccgggtaagaacatcacagccaactatggtagtgattggctagatgccaaggcaacatggtatggcaagccaacaggtgccggcccggacgacaatggtggcggatgtgggtacaaggacgtgaacaaggcccctttcaacagcatgggcgcatgtggcaacgtgcccatcttcaaggatggtctaggttgtggatcctgcttcgagatcaagtgcgacaagccagcgtactgctctggcaagcccggggtggtgtacattacag

SEQ ID NO: 2797 - DNA, 397 bp, Zea mays
  Clone ID: LIB3228-005-P1-K1-F2
cagtcagaaaatagtgggatcgagttgtttcactgcacgagcacatcctccggcgaccaccggcctccctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggggcacctcgccccgaccggcctgatcctgggaggcaccaagtacatggtcatccaaggcgaacctggagctgtcatccgtggcaagaagggatccgggggcatcactgtgaagaaaa

SEQ ID NO: 2798 - DNA, 288 bp, Zea mays
  Clone ID: LIB3228-005-P1-K1-F3
cccacgcgtacgcccacgcgtccgcggacgcgtggggtggagcgaagactcattgaacgtctgcggttgctgcttattaagcgtgcaaatggggccaggaacatgctggccgaaaaggaggaatacgtccaaacaactgtacacagagagaccatggacaatctatgtgagacccaggacatagtcagcgaacatggtgacatatgacaactgtgacgtgtgaaccgtatgcaacagcaaggggtagacggtctattttgactaggacctgacataagctgcatatct

SEQ ID NO: 2799 - DNA, 397 bp, Zea mays
  Clone ID: LIB3228-005-P1-K1-F4
caccaatgtgggcggcgccggcgacatcgcggcggtgtcggtgaaggggagcaagcgtgtcaagtggacggagatgaagcgcaactgggggcaagtgtggcagaccggggaggacctcacctgcgagtcgctgacgttccgggtgatgaccagcgaccaccgcaaggccacctcatggcacgttctccccgctgactggaagttcggtgtcacgtaccaggcatccaagaacttctaagtagccacttttcctcctcttcttcaacctgcatatgcccacaagcaaccatgcagatgataacatgcatcatgcatgcatattcattctttcgctcatgcattccgatatggtgccggagttaaaaaaatgtaaatcaatgtgcaaactcaaatgaca

SEQ ID NO: 2800 - DNA, 403 bp, Zea mays
  Clone ID: LIB3228-005-P1-K1-F5
gaggaattgtctcctttgattctcccttacaatttgagtattacaagtctgcaccataaaaaggttgtattgcaacatgattctcccggattaccacgttggggcttagatttacagacttcaagatgtgcaacataaactggcgataaaatcaaacacccaactgtggacctaagagtagccttgacacaaccgctctccttaaattgatctaagctcctttaacactcagttagttcttgcttcaaaacattcattgatcaaagtccggggcaccaaaataagaatagcctggatctgctgatgattctagcagaggaatgtactctgaacctctcacatgaacactgaagcaagcattctcaatttttactacactttgcagcatgacctccattttctt

SEQ ID NO: 2801 - DNA, 393 bp, Zea mays
  Clone ID: LIB3228-005-P1-K1-F6
cttttggaagacttgctcaaagaacctgatgagctaaccataaagaggaagcagatacgtgaaaatcttaaggtccttcaacaagcttacaaaactttggatgagataccacttgacgcagaggcagtagagaggggtggtggatactccctcgattctgatgcgattggtctaccaagggcccatgggctttcttcatccctccacggattcaatgatggaagctcatcatattcaaccccgaagcagtcaaggtcaaggaggccaaaccattctggcgagcaacttcctttcaaccccgcaacgagtggcaatggtttttgatgccaccctacacgatggccacccagattggttatggaaccaaccaaatgtgcagcaagcacaccttac

SEQ ID NO: 2802 - DNA, 387 bp, Zea mays
  Clone ID: LIB3228-005-P1-K1-F7
cggacgcgtgggcggacgcgtggggccccgtcaaggacctacgattccctcaccgacgaattcagctacgcgctgcttctaatcacgatcgcagtcctggttgctgccatcatcgtcacatggatttggtccgagaagaaggagttgggggacaagtggaggtgagcgaggtctcaaagttgtgacgcggaagaaaatttcgggccccagtcagctagctcccttgttttggtcccccccttttttcattttagtgctagagttcacttcacctttgactataggcattttatttatgtaaccattcgacaagaagaaagcctatctactgtgaatcgacacactgccgaagcagccacctgtgcagctgaaaatttctggagatgg

SEQ ID NO: 2803 - DNA, 401 bp, Zea mays
  Clone ID: LIB3228-005-P1-K1-F8
cccacgcgttcgcccacgcgtccgcccacgcgttcgcggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaagggggggcggttttaaaaaattaaagtttactttggggggttttcaattgaatagtttttttttggggtacattaaattaaattaaggggcgggggttttaaaatatggggattggaaaaacctgggggttccaaaatttaatagtttttaaaaaaatactttttttcaaagttggagtaataacaaaagggcccgaacttttttgtttttaaaat

SEQ ID NO: 2804 - DNA, 307 bp, Zea mays
  Clone ID: LIB3228-005-P1-K1-F9
cccacgcgtccaggcgccattctggataagacagtatttcctactggtgaagcagaggaaaatgtttttacaccggttcatttcgagccagtagacctgtggattcattacaccggggagcaagcttaaacgaactatataacccaacttaattgaatgaaaaagaatgttcttgatcgaatccagctttaacggaccggcggtcacggggctagcacctcataaaagcagcagctggaatgcctaattgtactctccctgcagcgaagtactaaacacagggggtgttgtgataacaaggaacttg

SEQ ID NO: 2805 - DNA, 258 bp, Zea mays
  Clone ID: LIB3228-005-P1-K1-G1
agctagctagcaagataaacattagcaggtagctaggtttaaacttttttatgccatatatatatggtgtgtgtgagtgtgtttggaacttggtttaatttgtgctatcgctaagtcgtcgtcgttcactttctaaagggatttgatagtgttaatttgcctgtttgggccgataaacaaaaaaaaaaacagataacaaaaacaaaaaaaaggaacgaaaaaaaaactctacacaaaaaccaataaagaaaaacaaaa

SEQ ID NO: 2806 - DNA, 397 bp, Zea mays
  Clone ID: LIB3228-005-P1-K1-G10
cgtgagacagatgccatcctaccagagtttctgaataacctttgtcagtttgaaatggaatacgctccggcagaagaaatggtatccaaattaaaggattacgcccggagtgttgtggaaagtaaagctaaagaggaatctagcaaagtattgatccatatgaaggagaggttcacaacagtgtttagccatgacaaggattcaattccaagggtctggacaggaaaggaagatgttcgtgcaatagcaaaggaagctcgatctgcggctctcaaacttctgtctgtaatggcggccattcgctgggatgacgagccagataggattgaaagcattctcacttcaacacttctggaaggctctgttgtatcaaagattgcaagtgctgcttctgctg

SEQ ID NO: 2807 - DNA, 388 bp, Zea mays
  Clone ID: LIB3228-005-P1-K1-G11
cgtgagacagatgccatcctaccagagtttctgaataacctttgtcagtttgaaatggaatacgctccggcagaagaaatggtatccaaattaaaggattacgcccggagtgttgtggaaagtaaagctaaagaggaatctagcaaagtattgatccatatgaaggagaggttcacaacagcgtttagccatgacaaggattcaattccaagggtctggacaggaaaggaagatgttcgtgcaatagcaaaggaagctcgatctgcggttctcaaacttctgtctgtaatggcggccattcgctgggatgacgagccagataggattgaaagcattctcacttcaacacttctggaaggctctgttgtatcaaagattgcaagtgctg

SEQ ID NO: 2808 - DNA, 271 bp, Zea mays
  Clone ID: LIB3228-005-P1-K1-G2
attgaatgcatccaaacacaggccttgctctacgaggtagtcaccgagcctctcaaccaccatgttgcactgtccaggggtcatgggctcgtcgtagatgccgatcaccagcgcctgtccggtcttcttcacagttatgcctccagatcccttcttcccgcggatgacagcgccgggctcgccttggatgaccatgtacttggtggggccaaggaagaggccgatcggggccagaaacccaggctcgtcgaagtccttaatgatgttggtc

SEQ ID NO: 2809 - DNA, 384 bp, Zea mays
  Clone ID: LIB3228-005-P1-K1-G3
cccacgcgtccgcggagcagagagagacttcctcgcctccatcccatcccgccgccgccgtctctacggtcgctaataagcagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacg

SEQ ID NO: 2810 - DNA, 381 bp, Zea mays
  Clone ID: LIB3228-005-P1-K1-G4
cacagcagcagcagcagcgacagcgactgatctcgcctcgccgagcgccgtacgcacaaatgcaccgcgcaggttataatacgagctgtccgccgaacaccatgcgcatatattatacagtactcgccaagattgttgttctgcaatcttcgggataaaaaggttctttttttgttttcgtttgcctgtggttttcatctttgctggatggatctgaagaacgaagtcgatgttggattcacatgtatgcattgcttggaggatactcaccggatatcggtgctgatgtgatgatgaaaaaacagtctcagagatagctagcatgtatgcgctgtttgccatgtaataattaatggtaatgcagaaatcgatctgcttgat

SEQ ID NO: 2811 - DNA, 439 bp, Zea mays
  Clone ID: LIB3228-005-P1-K1-G6
cggcccgggatcccgggccgcgacccacgcgtccgtgctttgcctgctccgccaatgcctggcatgggtggccctccacctccgatgggtgggatgggcatgcctccaatgggtggaatgggtatgccgccgatgggccctggtccgatgccagcattcgggatgccagcaatgggaagctactgagatgtttttgcagagagcttagacgatgatttgaatcgtccctgtgtaagcgaaggtggaaacttcattggagttgtagatggttacagtttggaattaatattctttatggtaccagaatttttttggcaagtgaaaccttagccagagtctgagaattgcaacctgttataccgtacgatcggataggatgagggtgattaggttggttgagcgagctgttgaaagctggtatcatttgtatagtgtgatg

SEQ ID NO: 2812 - DNA, 366 bp, Zea mays
  Clone ID: LIB3228-005-P1-K1-G7
gtttggtttaatgtctcggaataatatgaattggctgcaaaaaaacagctttgcaaagccaccggatcggaatacccgtcaagtattggaagttataaaccacgacgctgtaacagggtatgttttttgtatactgaggtaatgctaagctactggtgggaagtaaaccttggcgctactgggaaatgcctgcttactgccagctgaataagcttgaataacagtgctgctgatgccagctgtctgactatctgaacggttcgaaccgaacgcgcttgtcctcactggagcactctaaatggaaattggtccgcgctctgtattggaggattattggcggagcttgtggagaattctctcaaattg

SEQ ID NO: 2813 - DNA, 383 bp, Zea mays
  Clone ID: LIB3228-005-P1-K1-G8
caggcgtgtaaggtttatgatgagtatcagtcagagttagacaacactagtgctttacagcttgaatcttatgacgagatgtgagatccagctgaagtgatctgaacagtacgttgaaacgaattacgcatgttctactagaaggcagtttgaggagggatgtcggtttataagtttcatgcaaacttacatttgcctaccgaaagacaagtctattatggtgtagcggaacactagatgctggccggccaaaaatattgtatcgactgttaatgcttgttgcataccaaacttattggtgtgtgagctactccccttgtaggcagatgtcatgatatagaataggttcgttatactggacttatttaacagttgaataaact

SEQ ID NO: 2814 - DNA, 224 bp, Zea mays
  Clone ID: LIB3228-005-P1-K1-G9
gatgtacagtacagtcgcttgtgttgaagtggagagaataaaagtgtttgtacatataataacatcctgcagttgttaatcttttgttacacatctgatgccgcccgcgcactcagctcagttgactggaatattgactcaaggatcgtattctgcacaaaaaaaaaaataaaaaaaaaaaaaaaataaaaaaaaaaaaaaaaaaaaaaaaaaaaattaaaacc

SEQ ID NO: 2815 - DNA, 396 bp, Zea mays
  Clone ID: LIB3228-005-P1-K1-H1
cgactggcacctggacgctcgacaccaaggccccgctcaagtaccccctttgcatccgctttgctgtcaagtccggcggctaccgcatcgccgacgacgtcatccctgccgatttcaaggccgacaccacctataagaccacactcagcatctaatcaatctctggtgatgaattagatttcaaaagagctcatctagcgcacatgttagcaagacaatattattttttctatggttattttgtggaaccaaaccacccaagaaataagtgatgctagatgtaccttctgaccttggtgtattgggttgatattattacataaactaaatacattatttatttaagattttaggagaaaaagaaaagtatgatctaaagacgggcggccgctctag

SEQ ID NO: 2816 - DNA, 234 bp, Zea mays
  Clone ID: LIB3228-005-P1-K1-H10
gtaaactgcatcactgcgtacagccactgggcaaagctgaagtgaaataggcgtatccacatgtgccccccgcctgctgtctgtactgcctcacaaatttcagtacttgtcggtggagactggagatggagagcagcctgtagtagtagtactgaacaaactgaatgtcagatgtaaccatagaacctacgtctcctagtttctgcaaaatgcacaaagtttccgtttctaaaa

SEQ ID NO: 2817 - DNA, 265 bp, Zea mays
  Clone ID: LIB3228-005-P1-K1-H11
ggctatggcggcggcggctatggaggtggtggctacggaggtggcggcggctacggaggtggtggctatggtggtggcagccaaagctatgatgcttgaggggggcaggatcctattaggtgcattatcaaccaagatatttgaaataatgaactttaggacttggtatgacgttttatgttaagcgttgtcaggttttgctattcgtgttatgctgaattgttggaactcctagatgcagaatcttacgtattggttttggttc

SEQ ID NO: 2818 - DNA, 413 bp, Zea mays
  unsure (1)..(413): unsure at all n locations; Clone ID: LIB3228-005-P1-K1-H12
cccagcttgctcaatcgccgngaagcaccatattgaccagcgcacaccacttattcacgtacagggagctcgagcgcgcgctccacctgctccgacgcgatgcggtccaagtggaacttgaagagaatgctggggctcatgatgcagcgcccctaaatgaggctgttcatctatcaatgcagcctcttgtgacgaggatggcgagcttctcctgcatcatggctgaggctcgttgggatgatggtctccctttgcagacgtcctttgctgtagacgtaggcgatgtaaaccgtcctttttgattcattctagcatgttctgagactgggtttatattgtaatttgaggataattatatgatgctctaagttaaatcagattcctggcactcgaatatgtttgatgtccttcct

SEQ ID NO: 2819 - DNA, 192 bp, Zea mays
  Clone ID: LIB3228-005-P1-K1-H2
tgaatgggagctggatgcttgttacgacctgaatgcttttgcagccaaggtagagggtgtggagtgtgaacacagggatcatacggactatattctcgatcttctgcgcaatgttatatgccaactgcaacatggcatgccattgtgggaagctcgctgggtatttgaaatgggctagtattgtataaagct

SEQ ID NO: 2820 - DNA, 106 bp, Zea mays
  Clone ID: LIB3228-005-P1-K1-H3
cccacgcgtccgaaataaatagaaacgaaaaaaaaagctaaaactcccaagaataaaaggtggattaagtggcaaaagcaggaaccaaaccgatcaatatactgct

SEQ ID NO: 2821 - DNA, 348 bp, Zea mays
  Clone ID: LIB3228-005-P1-K1-H4
cagcccaaagaacagcatttctgaaacaattataagctgcacgtgatgtttagacgcgaccttcttttccgtatgtacaagcaagtatcccgtatcctcctagacacagtacaaaaccatttaaaacttggcaacttgctgcggtgtcacatgtaaaagaagggttgtccaggaaggaaaatataggttggcaatggctgctgctccaacaactccctgcttttgtggacctccgtgggagccttactttgtacttggcttcacgtcgacatggatgaaggcttggaaaacatatgccatggggagggtgcctccttgggtgagtccgatgcggagcacgcgacggag

SEQ ID NO: 2822 - DNA, 371 bp, Zea mays
  Clone ID: LIB3228-005-P1-K1-H5
tcgggctatggcggcggtggttatcgtctgggccgagcacaattgggtaagatggccgccggcgctccacaaaattgctaggatttgggccttggcgagtctctcggctgaggtgtctgggggccggggatcgttccgggtgaattgtgcgcgcggcggaggccttcccaccattgaattgctcgccggagcaattacttcaccaccgggccgcacttgctcatggacggacttctttgcctcttgaccgccaacgagttagccactgaggaccaggtgttcagcaggcggagactgctgagtatgagctcgttgaaggtgaaaagcaggtggccaagaggagttctataatggggagtacgaggtgatct

SEQ ID NO: 2823 - DNA, 400 bp, Zea mays
  Clone ID: LIB3228-005-P1-K1-H6
tgctgaatacgcctggaagcaccatattgaccagagcacaacaattcttgacgtgcaaggagtggggatgaagcaattcactaaagctgcaagggagctcattggcatgcttcagaagattgatggtgacaattatccagagaccctgtgccgcatgttcatcatcaatgcaggccagggattccggcttctatggggcaccgtcaagagctttcttgacccaaagaccactgcaaagattcatgttctgggtaacaagtatcagagcaagcttctcgaggtgattgatgctagtgagttgccagaaatttttggtggaacctgccgatgtgaaggtggttgcatgaaggctgacaaaggcccttggaaggaccccgaaatcatgaagatggttcaaagt

SEQ ID NO: 2824 - DNA, 164 bp, Zea mays
  Clone ID: LIB3228-005-P1-K1-H7
cccacgcgtacgaccacgcggccgcaagtacaagaacgcgggcgggggaactagaggaagcaaacttacaaacacgtacaaccgaagtcaaaacaaagcaaacgaacacccaaaacaaagaaacaggccgacgaaaaacaacaagagagcgcggggaaacccag

SEQ ID NO: 2825 - DNA, 235 bp, Zea mays
  Clone ID: LIB3228-005-P1-K1-H8
accggcgtcaccatggatgacgtcaacgtcgagtatagcggcaccaacaacaagaccatggctatatgcacgaacgccaagggcagcaccaaaggttgcctcaaggagcttgcatgcttctagaccctccgtcgactgacccatctctctagttataatttttctctcgtccttgcattgcccattacatgctatccattggtaacgcacaacagtaaaacgacagacatccgac

SEQ ID NO: 2826 - DNA, 388 bp, Zea mays
  Clone ID: LIB3228-005-P1-K1-H9
cccacgcgtccgctccggtggtaccactatgttccctggcattgctgacaggatgagcaaggaaatcaccgccctggctcctagcagcatgaagatcaaggtggttgctcctccagaaaggaagtacagtgtctggattggaggatccatcctggcatcgctcagcaccttccagcagatgtggattgccaaggctgagtacgacgagtctggcccgtccatcgtgcacaggaaatgcttctaattctttgggcccaagagatgcaaagccgagaggagccattatcgccagcctcccgccccgtttctttctccttttgttgctgtttcttcattagcatgaacaaagttttctgccggtctatcggcggccggtctagaggatcca

SEQ ID NO: 2827 - DNA, 396 bp, Zea mays
  Clone ID: LIB3228-006-P1-K1-A1
caacttttagtttgtctgtgtggctcctcaagtttctacgtgtccaaatagtggaccggattcttcttctactcgcttggttcattttaggagacactgcacaaattggtattcctcggcctagcatgggtccaatggagctcaaacaagtgtctggtaagacaccggtgcttgacgtggggacgatagcacagattaagtccggcaacattaaagtatttcctgcaattcgaagtttccaagaatatggtgtagagtttacaaatggtaggattgaatcatttgatgttgtgattcttgccacaggttataagagtaatgttccttattggttgaaggagaatgaatttttttcacagcaaagtggatttccaaacaaaccaaatgaatggaaag

SEQ ID NO: 2828 - DNA, 128 bp, Zea mays
  unsure (1)..(128): unsure at all n locations; Clone ID: LIB3228-006-P1-K1-A10
cccacgcgtccgcccacgcgtncgcggacgcgtgggcttgcccccaaccatttatctgattttgattccctaacgaatacaatgaacacttccattttcctgaaaactgatctctttccagcacaaaa

SEQ ID NO: 2829 - DNA, 383 bp, Zea mays
  Clone ID: LIB3228-006-P1-K1-A11
cggacgcgtgggcttgtgatggaatatatatgatatttccttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaagaatcaaagtttacttacccgtgtttggaaagaaaaagttttttttttggggcacataaattaaattaattggccggggtttaaaaaagaggggattggaaaaaccttggggtaaccaaattaaattgtttttgaaaaaatacactttttgcaaggtggggtaataaaaaaaaggcccgaaccgatcgcctttccaaaa

SEQ ID NO: 2830 - DNA, 402 bp, Zea mays
  Clone ID: LIB3228-006-P1-K1-A12
agctgctctcgtccctagaaataaagcagctcctccgcggggcggcgaactactacccatcgccaaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgacggaggctacttcaatgcaataatgaccttcccccagaactatcccaacagcccgccatcagtaagatttacttctgggatgtggcatccgaatgtttatccggatgggcgtgtttgcatttctattcttcatccac

SEQ ID NO: 2831 - DNA, 407 bp, Zea mays
  Clone ID: LIB3228-006-P1-K1-A2
cccacgcgtccgattctcttgggtggactttttgtgtatgacattttctgggtgttcttcactccagttatggtcagtgtggctaaatcttttgatgctccgataaagcttctgtttcctactgcggatgatgcacgaccattctccatgcttggccttggtgacattgtaatacctggcatttttgttgcacttgccttgcgctttgatgtctcaagaggcatcaagaagcgttacttcaacagcgcattttcgggatacgccgtgggtatgacggtgaccatcattgtaatgaactggtttcaagctgcacagccggctctactgtacctcgttccaggtgtgatcgggttcgtcgccgtacactgtctctggtacggagaagtgaaacagctgctggagttcga

SEQ ID NO: 2832 - DNA, 225 bp, Zea mays
  Clone ID: LIB3228-006-P1-K1-A3
gcaaacactaaaagaactgcttggtgatgccagcactctgggagcacgtcaaagagctgcaaaagatgcattttcgattatgtcagatggagttgtgaaccgcgtatgggatttagtctgcaggctgggcattgattcccaaacaaatacgttgagcagttgacttagctgaggcttattcttgtaatctctgtggtacgctcgtgaaaccaaaatttctctgaa

SEQ ID NO: 2833 - DNA, 355 bp, Zea mays
  Clone ID: LIB3228-006-P1-K1-A4
cccacgcgtccgggcttgggcaagcacaacatcatctgcattgaggatcttgttcacgagatcatgactgttggcccacacttcaaggaggccaacaacttcctctggccattcaagttgaaggcgccgctgggaggcctgaagaagaagaggaaccactatgtggagggcggcgatgccggtaaccgcgagaactacatcaatgagctcatcaaaaggatgaattaggttcacgatcaagctcattgatagtaccctgtgctctaagtgacttcttgtgctgtccttattttatattagaaagttggatcgtcgatgaatatgcatgcaggtttgatgtttcgaactagatgtg

SEQ ID NO: 2834 - DNA, 253 bp, Zea mays
  Clone ID: LIB3228-006-P1-K1-A5
aagaaactatgtgcgaatgatgtgtctatgcctggattaataaagtgtagcctatcattttgcacaatgtatctgcagcaccggtcgtggcagatcagagtaaaatctgagtactctgctttcaaaaaaaaaaagaggcgacgataaacaaaaggaaagactgtgaaaaaccggggggggaccctaaatgggtggccgctttagagatccaagtttaaacaggttggcttttgattagggagccctaaattaa

SEQ ID NO: 2835 - DNA, 342 bp, Zea mays
  Clone ID: LIB3228-006-P1-K1-A6
cggacgcgtgggaagatttttggtgtgctctcttggtgatgtgtgtatgaaagcttggatatttggtttgaaaaggtggagtcggtagcttttttgctgagagaaacatttgtcctcaaaattttcacatcttttggagggagctgcatgattagtttattccaagatttagttcatatagccttttatatcttgtgtatatgcagggagtatgaaaaaacagcctttcacatttaagtgataaatatatgtacctgaagtctgaacatttttgttgactacgaactgaacagctctaaatggttcttgatttctcaatactttttgtcccagacaatatct

SEQ ID NO: 2836 - DNA, 189 bp, Zea mays
  Clone ID: LIB3228-006-P1-K1-A7
gtttgttgatgcgcgcatgcatgctagcagacatctttcctaaaaaaaatttaaataatttccatctcgcattattttagtagctaccattcatgttttctgagtagttgtataaatgctaccaccgtcatcttttgtacccggccggaacaaacgaaaaacacactatctatgctgtgttgtgaattc

SEQ ID NO: 2837 - DNA, 369 bp, Zea mays
  Clone ID: LIB3228-006-P1-K1-A8
tgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaagcggccgaggtcaccaaggcct

SEQ ID NO: 2838 - DNA, 408 bp, Zea mays
  Clone ID: LIB3228-006-P1-K1-B1
gtactatattggatattggggaaaaccctaaccctagctgggttgggagatgtatttataataagagcatctgggcctaggcccattacagagggacgagactaaaccctaatacagttctaacactaattattaattggatttggacaccaatacttatgattggagcaaaaaggtcaaagttttagaccaatgcatcctctttgttcacaaccagtggcactgacttgatgccctttaccctaaccgagaagcaatcgaggcaaaggacgatccattcaacactctgaatcaagaataagacaatcaagtgttggtgagaaactaaaaccggacctaaagcgatggtgcactatgttctctgtctctatgatggtgccacattcgagcccagtcgatgctaatgga

SEQ ID NO: 2839 - DNA, 398 bp, Zea mays
  Clone ID: LIB3228-006-P1-K1-B10
ccggtttgctaatggtggtgcataccctccggaccttagtctcatcacaaaggcaaggcacaatggtcagaactatgttttcgctcttcttactggatatcatgatccacctgctggtgttcagattcgtgagggtctgcactacaatccctacttccctggtggtgccatagccatgccgaagatgcttaatgatggagctgttgagtatgaggatggtacacctgcaactgaagcccagatgggtaaggatgtcgtatcattcctttcgtgggcagctgagcctgagatggaagagagaaagctgatgggagtgaaatggatctttctactatcactagcgcttctccaagctgcctactaccgccgcatgaggtggtcagtcttgaagtcccgaa

SEQ ID NO: 2840 - DNA, 205 bp, Zea mays
  Clone ID: LIB3228-006-P1-K1-B12
cacttttatttaagattttttggggagaaatatattgatctggtccaccttcattatccagatgcttgttcatttgattttccaatgtttggatacttatgaaatgctttgttgcttttgtttcaaaaaaaaaaaaaaaaaaaaataaaaatgtattataaaattttgaaaaaaacgaaaatataaattaaaaaaaattaaaaat

SEQ ID NO: 2841 - DNA, 409 bp, Zea mays
  Clone ID: LIB3228-006-P1-K1-B3
gaaatatagggctgcctctcgcggagctccgcaggggactgcaattctgctaatttgtgacagatcatgcaggaataggaggtcaagagagtttctgcaaccccaatgaagatggcaccaggacgatgaaaccctgtccaccggattttgtagctccttgaatgttgctctaggcaagttcaagaggcgggggacgcaaatactaagtggtggattcctctcggggcaccgcgggcgggcagccgcctgtggaacctgctaagatgaagggccttctcaagggcctccgatacatctcgcagatttttgatgcgaaggagccggagatgcagatcgggaagccgacggacgtgaagcacgtcgcgcacatcggctgggacaacgcctccgtcaccgcgcccagctggat

SEQ ID NO: 2842 - DNA, 170 bp, Zea mays
  Clone ID: LIB3228-006-P1-K1-B4
cccacacgtacgtggacgcgtgggcagacgcgaaaaaatacctgggccagcagacacgggcacatccgccaactctacaccctcttctgtcatggagcaataattttttattttgctggcgcccctcaccagggaagcgtccttcttttaaacaaattatatattttttt

SEQ ID NO: 2843 - DNA, 404 bp, Zea mays
  Clone ID: LIB3228-006-P1-K1-B5
cccacgcgtccgcggacgcgtggggtgatccccacctccgcgcggttagtaaatcccattgatagattcgagcgcgctgttgatgaggtcgccgtggctgcgcatgtgcctcttgccgcgcgcccctcctgcggcttccacctacaccgggtgttctccgccgcgcatccgccaccaccggcggcgccgaggacatccccgtcgcttcaatagccgcgcgaggacacgtgtcatctgaaaagcaagttggtaactggaatctcaagtgccaggacaagtacaggtggttcaggaggagccacaaggcgaggagtttgttctgatctaggtggcgttcccagttgactttggcgccgatgatccttagttcgttttatgtttattcttttattttgtaataagtc

SEQ ID NO: 2844 - DNA, 311 bp, Zea mays
  Clone ID: LIB3228-006-P1-K1-B6
cccacgcgtccggtttcgagtttcgacttccaataatagtaacaacaaagcaaaggccttcctcccggcgtatttgctttggctcttctcctccacgccataagatatctagcaattggtcactcgccttaattagttcgctttgcttttgaggttgattcgaccattttgctgtagcgtgaattgcatgcatggacatgcaacgctccaatggcctttggaatgtggaatttttttccccattttctgtatttttcctataaaaaatgaactggttcttatataattcctctcagatccctgttgttcaa

SEQ ID NO: 2845 - DNA, 409 bp, Zea mays
  Clone ID: LIB3228-006-P1-K1-B7
gcaaggggctggtgcagcggatgccgcgctgccgtcacggcttcttccacgtggtgaacaacgactacacgcactggctcatgtacgccatcggcggcagccggaaccccaccatcatcagccagggcaaccgcttccgcgccgtcgacgacagcaggttcaaggaggtgaccaagcgggagtacacgcagtacagcgagtacaagaactgggtgtggaagtcgcaggacgacctgttcctcaacggcgccttcttcaaccagtccggcggccagaacgagcgcaagtacgacaggctcgacctcatccaggccaagggcggccagtacgccgagtcgctcaccaggtacgccggcgcgctcaactgccgcgtcggcaggaagtgctagtgcgtgtgcagctctaggct

SEQ ID NO: 2846 - DNA, 395 bp, Zea mays
  Clone ID: LIB3228-006-P1-K1-B8
cgcccctcctctcttttccttgcagccaccctccctctttcccctttgctggtcatcctccctctcccctctctgctggccgccctccctctccctcctatggtgctgttacccaaaatcaggagcccggtgggcccttccatggtggcttggtgagaggaagaaggaaggggaggaaggaaaagtgaggagatcaagagggatttcgttttcctttaggtggtagtgctccggatcgtgcctagcgccattttgattcccggcgaaggtacttgatgcttgttgagggagtaggaagtagcgacatgtccaccttcacaccaaaataatattatttatccacagttaataatttaattggaacatctaatttttgaggatgttatttaataaac

SEQ ID NO: 2847 - DNA, 323 bp, Zea mays
  Clone ID: LIB3228-006-P1-K1-B9
ccaaattatattctactttttatttggaacggggggagtaccttttgaggtaaaagtggactttgtggaacatggacctgattttccaatcaaagaatgaataggtgtagtttacaaataagcaccctccaccaatgccatccgaaatttggttttttaacatataataagtctgcatcatccgtgttagtgggctcacatgtatttagaaagattaagaagtttcaaagattttacccccctgcacggtgaatgggtggcgccctatgtgtctttatttgacttgggaggggccgtgggttttcattccctgacgagctcct

SEQ ID NO: 2848 - DNA, 400 bp, Zea mays
  unsure (1)..(400): unsure at all n locations; Clone ID: LIB3228-006-P1-K1-C10
ggaaattagagagccggatctcttggtcggagaacctgcgaggaaggactaaggagtcgaagatgactgcggcggtgctgtccgtgcgcacgacgacgacgtcgctgctagcagcagtcatcctgtgcctctgcatcgtctccctctccccccgcggcgccgctgccgcgcgggtctcccccggcgccagcccgatcgtggccacctgcatgacgggcccgtacccggagctgtgcgtgggggagctgggacagcggctgctggacgtgcagacgtcgatcgcgtncgcggcgcccgaccagcgcgcggccaggatcgcgggcgccccggggcaggtggacgtcaaggcgctggtggccgtggcgctggaggcggcctcggaagccggcgccgtcgcggt

SEQ ID NO: 2849 - DNA, 400 bp, Zea mays
  Clone ID: LIB3228-006-P1-K1-C11
cgcaagcaccgcacggagagcaagcaagaaagcaaccaccgcactgccactacctaacaatggcccgcgcctacgtgtttctcgtcgtgctcctcctggccgctgtcatcgtggcaccgttcgcgggagcgacgcgtgtcgacgtcgttgagggcaggtccatggcgtccgccgacgcgccggaggccgccgcaccatcacccgggcctgactccgcctcgtcaccggactcctcgtcggatgcgccctccagcagcagctcctcggactagatagctagccgctcgacgcacgatctcgctctccatctacacggcgatcgagttctagctttgtcggcatgcaatgcaaaattccgattcttcgggaataatcaagcaccaaaggaatgtgcttgcat

SEQ ID NO: 2850 - DNA, 70 bp, Zea mays
  Clone ID: LIB3228-006-P1-K1-C12
gaaaaaaggggcgacccacgcgaccgcgcaagcaccaaacaaagagcaagcaataaaacaaccaccgcac

SEQ ID NO: 2851 - DNA, 404 bp, Zea mays
  unsure (1)..(404): unsure at all n locations; Clone ID: LIB3228-006-P1-K1-C2
attggccataggtaattcgattcttaagcatggttatgcaaaaaatcatgctacctttgtcggtagcgtgtatatttctgtgtgacccatgcacagaaacgagattgagtgtgctaaacagcaaactttaaacactgaatcggggtttgttctttttttcatcaaactctctgcagggccccggatacatcgagggtgagaagcaagatgctgtacgcgagctccaaggaccggttcaagagggagctggatggcattcaggtggagctacaagcaaccgacccgagcgaaatgagcatggacatcgtcaagtcgcgagccctctgaaacagccccggccgctgcacctgcacgctgcangggcgcatcggctcctgcatgcccgtgggtcgtcgaatccttgc

SEQ ID NO: 2852 - DNA, 359 bp, Zea mays
  Clone ID: LIB3228-006-P1-K1-C5
cgcaagcaccgaacggagagcaagcatgaaagcaaccaccgcactgccactaccgggcaatggcccgctcctacgtgtttgtcgtcgcgctcctcctggacgctgtcattgtggcaagtcatcctgtgcctatgcattgtctacctctccccccgcggggccattgccgcgcgggtctcccccggcgccagcgcaccatgacgcgggcctgactccggctcgttaccggactcttggttggatgcgccctgcaccagcagtgtttgacactagatagctagtcgcttgacgcacgatctacctctgcatctacacggtgatcgagttctagctgtgtggggatgcaatgcaaaatttcg

SEQ ID NO: 2853 - DNA, 376 bp, Zea mays
  Clone ID: LIB3228-006-P1-K1-C6
gctctctgtgatggacaggatgggtgatcatgctggctgcgctgatacggctagtggtctcatggagaaacgtgataacaatcacactagatgcatgtacctctatccggcctggcggcaccgatcttctggggagcacaattggcagacactgagtgcacgcatttgaattgtggccgcacctctgtaaggactttctgtatcaatgatacattgactacgatcgtcaggtccttgcgttgtgtgtagacctcgaggcagagcacacgcgggacgcgataaattgatgcttgatcgacgtggagaaggtcaaatataagctggcatgtgtaacaagaagaaaagggtgcattgcaaatgctgcacaagaacttga

SEQ ID NO: 2854 - DNA, 396 bp, Zea mays
  Clone ID: LIB3228-006-P1-K1-C8
gatggcccaaaacaagatgattgtgatggttctcctcctttccacctttcttgtggtggcaagatcgttgtgggttccagaagaaccctcaaatgcggatgacataagaggtgcttgcatcgaggagtgcaccaaagaaaataaggctcctggcgacaagaagacatgcgaagtgttgtgcaccaagctcacaaaaaagcctagcgaagaaggcaaacatgattgatgaagtagaactccgataatatatacactagtggatcagtggtcatctttgtagccatgtctaccacacgatggccttgattatattgccttattgttttgtttttggtttccaatagtatcctaattccttgttcatgtaacctaatgtcactcaaagcattttatatg

SEQ ID NO: 2855 - DNA, 275 bp, Zea mays
  Clone ID: LIB3228-006-P1-K1-C9
gctggggatatatagaatattcagtaaaaccagaataagctgaatgagaggccttcagcttcagttggtatggtacgatcaacgcttggcaataaaacaagttacctggaggggctataggctgactagtttgtagttcctactttatcaattccggaataatgtttgttgaagacctttattatcatgtaaagagattctatctaggaagacttttttggtttcgagtaaaaaaattgtttcttaaataaatagctcctgccgatcttcattca

SEQ ID NO: 2856 - DNA, 246 bp, Zea mays
  Clone ID: LIB3228-006-P1-K1-D10
gtcatatgcatgcatcgcttctcttccttgtcgcattaattttcatgcgtccaatgattcatatctctatatgcatatctctctgctctgccttgttggctggctcttctcatcattccctagcagatcgcatagtattagttgcatgcattatattgatgatgcaggtatttcgtcgagcaacaaggcgtactatcaattgtttttgtaatacccaaaattagtgaataaagggaaactggttat

SEQ ID NO: 2857 - DNA, 341 bp, Zea mays
  Clone ID: LIB3228-006-P1-K1-D12
gcgacgcgtacatcaacccgtacgttgtggcttgggaccattatttgatcgaggagcgcgatctgaatgatgtacccatgcatccgtgcctgggtgtgaaaacagattgctgtctctgacacgtgatgactaatgatacagagatatctgatgtataagaagagaaggataagacggttgaggaacgtatgggcgcagatgaagttggtgattaagtagtggcgctaatatatagcctacagggcgaacggtctagacgagccaaggtaacttacgcctgcaggcctgttcataggtcctatataagtacatggtggtgcccggcacttcttttttttttt

SEQ ID NO: 2858 - DNA, 306 bp, Zea mays
  Clone ID: LIB3228-006-P1-K1-D2
gccaaggtgatagtcgcgcctagaagcaacaacgagatggacacgtcgaaactgaaggccgagttccctcagctgctgtccatcaaggattctttgatcaagtacgtctttgagcccaacaggaaggttcctgttaattgaggatttacgttgcgtggatgcggaggttatttgtgttggttattggactctaaattagctaatgttgcaccgtggtgcgtactagttgtgttcgattcttttgggacaatagcaagcatacctctttctggtcgtgtgttaaaacaccaagcaaaaaggcatcac

SEQ ID NO: 2859 - DNA, 411 bp, Zea mays
  unsure (1)..(411): unsure at all n locations; Clone ID: LIB3228-006-P1-K1-D4
cgcgtncatgaacgaggtcctgatctacctcgaaacgctggtgtcgacggcgcaggagatcctgcgctctggaagctctgtacaaggtggtttctggtgccatgagccacatctcggactccataatgaccacgctcctgaacgacggcgtgaagaggttcaccgtcaacgcggtcttagggatcgatattgacctgaagacgctggaagcattcgcggacgacaagttcgacagcacggggctgtcagatctgggcaaggagacgactttcagggactgtttggttgagatcaggcagctcacgaatctcctgctcagcagccagcctgagaacttcatgaacccggtgatcaggcagaggaactacgggtctctggactacaagaagctggccatcatttgtgagaagt

SEQ ID NO: 2860 - DNA, 400 bp, Zea mays
  Clone ID: LIB3228-006-P1-K1-D5
cccacgcgtccggactaaacatttggagcaagtgcaaagttctcttgctgctgctaaaaggcatttgacacagcgcattgaaaagttggacgataaattggatcagcaaaaggctctatctggacaaataagaaatgatgttactgatgcacgtctgaagcttgagaatattggttcagaaattaagaacatcaaagaattagtttggggtctggatgggaaaattgattcaatgggagctaaacaggacttctcatgtgctggtgtgatgtacctctggcaattcatagagcaaaatggtggaaagctttcggatcgcctggaaaggtccaaagtgactacaaagcgttttggaggtcaaaagttcttgcagggattgcaactggcaatagaatcaagg

SEQ ID NO: 2861 - DNA, 403 bp, Zea mays
  Clone ID: LIB3228-006-P1-K1-D6
ggaatgctcttgcgtgctgggcgaagggcattgctgtgtcgatcaaaatttggggaggggaatactgcaccgagagttaagtacgaaaaggacataatttgctagatggcgcgtgccaagcaagaccgtcgcaagagcactggaggaaaggctcctagagaagcgactcgctacaaaggcagtccggaagtctgcacccacaactggaggtgtgaagaagcctcaccgagtccgcccagggactggtgctcttcgtgagatacacaagtaccataagagcactgaatcgctgattaggaagctgccgtttcagaggcttgacacggaagattggtcaagatttcaagacggatctggggcttcagagccatgccgtgcttgctctgcatgaggcaggagaagc

SEQ ID NO: 2862 - DNA, 352 bp, Zea mays
  Clone ID: LIB3228-006-P1-K1-D7
ctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaagtctgccaggaggagtgcgacaaggcgtacg

SEQ ID NO: 2863 - DNA, 254 bp, Zea mays
  Clone ID: LIB3228-006-P1-K1-D8
ctcgtcaggggttgagcaggcgtttaagctgtagagcagtataccgtctcggctcgtggttggagttttcttgagaatagaatagaataatgtacctgtttataatattaacttcccaaaacagcactggaggatcaccagggagaggattcggtgccttctcctatttggcgcgtaagataaatgttttgtctcatggctttcatgagaagatgaaattgactcatcttggtatatatttacaaatcttgaat

SEQ ID NO: 2864 - DNA, 369 bp, Zea mays
  Clone ID: LIB3228-006-P1-K1-D9
cggacgcgtgggcggacggtggggtcgggaagacgtcgctgatgaaccaatatgtccacaaaaagttcagtcagcagtacaaagctacaatcggtgcagatttcgtcacaaaggaggttctgatcgaagacaggctagtcacgttgcagatatgggacaccgcggggcaggagagattccagagtcttggggttgcattctacagaggggccgattgctgtgtgctcgtctatgatgttaactctaacaggtcatttgatacactcaatacatggcatgatgaattcctcaaccaagctagcccatcagatcctaaaacttttcccttcatcttactcggtaacaagattgatgtagatggtggaaaaa

SEQ ID NO: 2865 - DNA, 336 bp, Zea mays
  Clone ID: LIB3228-006-P1-K1-E1
cccacgcgtccgctccagcgatgaatgctgatgcttgcagcttccattctaaggctttccaagattgtctcaacaactatggcagcgagatcagcaagtgccagttctacctagacatgctgaacgagtgccgccgtggtggtgtgtctgtctaagctgcctctgggattattcatggattttctttccggatgggggtatctcattaataaggcaccgtgaaacttcgaccatctccacagcttgaaaccaaacttcctgggattaatttattttgttatcctatggtgttggaacagactttttgtctcttgatcataaatatttaaacgaacc

SEQ ID NO: 2866 - DNA, 338 bp, Zea mays
  Clone ID: LIB3228-006-P1-K1-E10
ggattggttcggcggcgggtcgacggcgccatcgccggggccgtcatcggccgtcaccgacgaagagtttaacctggagatgcagcagttcatgtcaatgctaccactgtctgacgagcacggctggaacgcataatgcggccgggtaaaatggaaatcgaaaactgtgtagagcgtgtgtctccttgcttctgcgacgagaatggtgtgcgcattgtttttgtaatgtgcccactcttggatctttatctgttctagacgtcgattgagtttcaaacattgataatgctagggcaccatcggcgtgggataaacacaaaataatccaagaattcact

SEQ ID NO: 2867 - DNA, 242 bp, Zea mays
  Clone ID: LIB3228-006-P1-K1-E11
gacaggcccgcgagcgagctatccacaagctcctccggcgatgcgtgggcttccttcgttttccgcgggaagaagagaggatcgaggaaagggaaacatgattgtgtgttcgatactacgattacgaacttcgttttcccttcttttttgtttgtttggaaggggaaatacttctcttctattctacaacaatgtcacgtacatgcaatgtaataataaaaaatgtatgtgatatatttaac

SEQ ID NO: 2868 - DNA, 379 bp, Zea mays
  Clone ID: LIB3228-006-P1-K1-E12
ggcccgatcggataagtatttctatgtaattaatttattcattggagataagcgatccatctccttataattcgtaaacgaagtactgtatttcaagggaaaaaactttaaagcaataactatgaaaaaaaccaaacagacacttttttaataaaaaattaaaacaaccccagactcctggacaggtaaaacaaaaaaaattaaaggggggggcggctttcatggatcaaaaagtccttccctttggatgcatccaaacaactgctctaacggcgacattaattaaattatagtccccatgccctgagattgtgcgtgggcgatccccttaacaccacccaaccttcgttcggcattttttaccccctgtttatataat

SEQ ID NO: 2869 - DNA, 405 bp, Zea mays
  Clone ID: LIB3228-006-P1-K1-E2
ggctcgggaaggaggagctgaggtgctgtcgaaggatgggtatcgaccttccaagggggtccaaccggcagctggatcttcatctaatctggacagtgatactagttccaacacaaaatcatctggtgcaaaagataacataggcaagggaggaggcaataagcaaccgaagaagacagcaaagtttctcagagctcgtttaggtgacaactcattagccacacttgatttaagtcgtccaagtgcaagccctgaacgtccagaaagggaattacaaggccctgagacagggttgccagcgcgaggtgcttggaagaatggcggggggcagaaactcttttcgagcaatggacggaaataagtcattccaactgcatagccgtggggacggggttgacagcgcca

SEQ ID NO: 2870 - DNA, 354 bp, Zea mays
  Clone ID: LIB3228-006-P1-K1-E3
ggataatatatattcggaggcatgcaatagcatgcatgtgggtaggcttggccacactttgcgtatctatatataattatggcaagaacagtagtagccggacacacaatcgagcccttaattagttctcggttttgaccaccttgcttggctggacgcacgcttctcagttcaaccggacgacggccccggcgccggcgccggcgccggcgcatcggattccgtatcagccagcttcatgtccgcgtagacgacgcggccttcggactcggcgctgctgccgtcgctggagccgacgacgctgccgaggacgtggatgtctttctggtgggcgtttagatcgcgatctacaac

SEQ ID NO: 2871 - DNA, 286 bp, Zea mays
  Clone ID: LIB3228-006-P1-K1-E4
aattacaaggtgtgagccacgcgttcggtcacgcgtccgctgttctgatcatgagtattgggttcgtagccgtcgttgctgtgctggatgtattcgggaagctgtaccgcacctccaactaggttggcattgccatatacaagacagctgagttcaccaagagaggattcctggagaacaaatttaaaagggtaggaagggaatattaagactctttgaggaagtttattaatacaaactgggaatggctgggaggggtattttaataaaaaaaaaaaaaataaaa

SEQ ID NO: 2872 - DNA, 250 bp, Zea mays
  Clone ID: LIB3228-006-P1-K1-E6
atacaaaacaggcccgcgagcgagctatacacaagctcctacggcgatgacagtgggcttccttcgttttacgcgggaagaagagaggatcgaggaaagggaaacatgattgtgtgttcgatactacgattacgaacttcgttttcccttcttttttgtttgtttggaaggggaaatacttctcttctattctacaacaatgtcacgtacatgcaatggaataataaaaaatgtatgtgatatatttaac

SEQ ID NO: 2873 - DNA, 335 bp, Zea mays
  Clone ID: LIB3228-006-P1-K1-E7
caagtagtccgtccggtgaatgccaactacgtaaaagattactgctatttccagtggattcgccttgagaggtcattaatcttttaccatgtgggttgctatgcacaacagttagataattggcatcagcggatcagcacttaactcacacgtgctgctaggtgattcgagcgtaggacctgtgcttgttggtttgttgctggcaatgtaaatataagtgttaggtaatgcaaatattagcatgacagtgcatattcttgtaaatgggaatttaccatgttattggaaatccaaagttcaaactatctcaagcttgttggttgctgtgctgaaat

SEQ ID NO: 2874 - DNA, 396 bp, Zea mays
  Clone ID: LIB3228-006-P1-K1-E8
cagcctttctttctcaaagatggaaagaagcaatagccgccgatcacgtgaaacttgttgtgtcctgaaaactaaaggaatggcagaataaagaaattctgttgagggcaacagcatggaagctccggccgacttgtcgccggatcccacagccctacaacataggtggttcttatctagcctgcagggtgctatgaaagtttggatgtcaagtttgtgttgcggcatgaatggttgtaaaatggcaggtgcattttgcagctgatttgagattgaagcagagggttctagttttacaaggggacagcttgtgtgatgggatctgtttttggtaaggaaaaaaaagagtgatttgaataatggtttggtcgcacaagttcctaatcttttgtactc

SEQ ID NO: 2875 - DNA, 339 bp, Zea mays
  Clone ID: LIB3228-006-P1-K1-E9
gcacgaacgccaagggcagcaccaagggttgcctcaaggagcttgcatgcttctagaccctccatcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaatttcttctccaaataccaaccaaattcaggggttacctctaaaaaaaaaaaaaaaaaaaaaaaaaaaaaaaataaaaaaaaaaaaaaaaaaaaaaaaaaaaaaaaaaaaaaaaaaataaaaa

SEQ ID NO: 2876 - DNA, 353 bp, Zea mays
  Clone ID: LIB3228-006-P1-K1-F1
ggcagttcaagccctggtggtggtcgctgatttttctgagctggtgggagtgatcctatcagcacaatttttttctgtcacttgacacagttctgataggcctttacaatgtgaataagaagctgtggcctctgtagagaagccgtggcgagggtggttttctctaccatcagaataagagagcattgatcggttacaagcaagctcgattcacctgcaattttttgcgttgttccgttcgtgtccaaaacgggaaaaggaaggttttttttttggatgtcaggttctatagcatgttgggcgcggttgtgaggctccaggtccattccctcggtaaataattctggggcaag

SEQ ID NO: 2877 - DNA, 398 bp, Zea mays
  Clone ID: LIB3228-006-P1-K1-F10
ctttgataatcttgaaaaggtgcgcagctcatgagtgaagtgccctcttctctgcaaggagtttgtcattgacaagtggcaaatctataatgctcgctctaagggtgctgatgcaattctactaattgctgctgtgctaccagatcttgacataaggaaatttcttcagatttgcgaagagttgggaatgacagctcttattgaggttcatgatgaaagagagatggaacgtgtgctgaagataaatggagttaagcttattggtatcaataaccgaagccttgagacatttgttgttgatacttcgaacaccaagatgttgctcgagaaacatggggatatcatcagggagaagggaattttggttgttggtgaatcaggtctgtttactccggatg

SEQ ID NO: 2878 - DNA, 383 bp, Zea mays
  Clone ID: LIB3228-006-P1-K1-F2
cgttgtctccaagatcgccgacgaaaccggcatggagtggttctccatcatcaccacccccaacccaatctttagccacttggcgggccggacatcggtgtggaaggcaatatctccggcggtcttgcagtcgtcgttcaacaccacgccggagatggagaagctgttccgtagcaagaggcttgactcggagatcttctttgcgccttcaaactgattcattcgccggtggaaaatggtccatccatctcgagtaaacttggtgtcctgggtgtgttctttagcagcttcagtttagaataatcaggttatgtcttcatcatcagttttttagatcggttcatgtaataataaacttgagatggtacacatgtttcttaatt

SEQ ID NO: 2879 - DNA, 404 bp, Zea mays
  Clone ID: LIB3228-006-P1-K1-F4
gccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccctggacagtgcaacatggtggttgagaggctcggtgactacctcgtagagcaaggcctgtgattgaatgcatccaaacaacgacaccaacgccaacattaattaattagtagtctccatgccctgggattgtgcgtggccgctccgttaaacaccacccatccttcgttcggcattttttcccccttgtttatataat

SEQ ID NO: 2880 - DNA, 401 bp, Zea mays
  Clone ID: LIB3228-006-P1-K1-F5
cccacgcgtccgcccacgcgtccgcccacgcgtccgcccacgcgtccgcccacgcgtccgcggacgcgtgggttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatgaacggcgccatcttcaatccgtccggcggcgcccccaagcaggtcgacaccaacgagtgggtaaagcccaagccaggaacctacgt

SEQ ID NO: 2881 - DNA, 121 bp, Zea mays
  Clone ID: LIB3228-006-P1-K1-F6
tgaattgaggcggaatatttataattcatgaaacacaggtttggttctagggtggggaaaatgctaagaaaaaataaaaaaaaaaaaaaataaaaaaaaaaataaaaaaaaaaacaataaa

SEQ ID NO: 2882 - DNA, 383 bp, Zea mays
  Clone ID: LIB3228-006-P1-K1-F7
aacttcaagaagggatgaaaaagatggaggggagtgaggacagcgaggagcaacttatgaagagttttgaggagaaaaaagatgccatgctcagctcgctttggaaaatcaatgtggttgatatcgagtccacgctctcacgtgtctgccaagcagttctgagagatagcatggtctccaaagatgtcctgaagctgcgagccaaagcgttgaaaaagctcggaacgatattccaaggcgcagagtctatgtaccgtcgtgaaaacagcctgcgcgttgaaacgagcacagaccaacaagccgcttcgtcacactgaagccacctgtggaccaccgtgtaggaatggatttggtgttttgggggtgtgtgtggctttcttctt

SEQ ID NO: 2883 - DNA, 404 bp, Zea mays
  Clone ID: LIB3228-006-P1-K1-F9
agagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaaaggcatcacggcgccggccatgaaagtctgccaggaggagtgcgacaaggcgtacgtggtgaatgcggccgaggtcaccaaggcctgcagcgtcacctgcgccaaggagaagaacccgcgcctc

SEQ ID NO: 2884 - DNA, 408 bp, Zea mays
  Clone ID: LIB3228-006-P1-K1-G1
caacccctacactcccggcggcggcgcaggagcagcagcaccagcacccgaggatggtgaagttcctcaagcccggcaaggccgtgatcctcctgcaaggccggttcgccggcaggaaggcggtgatcgtgcgcgtgttcgaggagggcacccgcgaccgcccctacggccactgcctcgtcgccggcctcgccaagtaccccaagaaggtggtccgcagggactcggccaagaagacggcgaagaagtcgcgcgtcaagtgcttcatcaagctcgtcaacttcacccacctcatgcccacccgctacaccctcgacgtcgacttcaaggacgtggccaccggcgggcccgacgcgctctccacccgcgacaagaaggtcgccgcctgcaaggccgacaaggcgcgcc

SEQ ID NO: 2885 - DNA, 227 bp, Zea mays
  Clone ID: LIB3228-006-P1-K1-G3
tacgatttggacggcaggagcatagaaatggaagctgaacaatgccattcatgttctgcccaatttttcttccccttgcatggcgttgtaaaccaatcaaaaaatttaacctttttttttgtgttggcaataaagaggaggacacgataatttgaccaaataaactaatgaatgaacctaagcttgatacatatgctcttctgatactaaccgtgggcttaaattag

SEQ ID NO: 2886 - DNA, 341 bp, Zea mays
  Clone ID: LIB3228-006-P1-K1-G4
acgctggcttctcctccccctcttaccaagtcctcttcgggttcgggttacttacggttttgtggaggggcgatggcggcggctgatgtggagtaccgttgcttcgtcggcgggcttgcctgggccaccagcaacgagtcggtggagaatgccttcgcctcctacggcgagatcctcgactccaaggtcatcaccgaccgtgagacggggaggtctcgcggcttcggcttcgttaccttctgctccgagaactacatgctcgacgctatcgagaacatgaacggtaaggagctcgacggtcgtaacatcaccggtaaccaggcccaggcccgtggcggtgg

SEQ ID NO: 2887 - DNA, 394 bp, Zea mays
  Clone ID: LIB3228-006-P1-K1-G5
gtcccgcccttttcctgcgacatccacaaggggggaggggaaaacacgtacattcacccggcggcaataatggcctcggttccggctccggcgacgacgaccgccgacgggatgctatgcctatgcgtcgtgctctcctgtgccgcggctgacgacccgaacctccccgactacgtcatccagggccgggtgtactgcgacacctgcacgagccgggttcgtgaccaacgttaccaactacatcgcaggcgccaaggtgagggtggagtgcaagcacttgggcaccgacaagctcgagcgcgccatggacggcgtaaccgacgcgatcgacacgtacacgatctagctcacggacagtcacgaggaggacatctgtcatgtggtgctggtggcc

SEQ ID NO: 2888 - DNA, 121 bp, Zea mays
  Clone ID: LIB3228-006-P1-K1-G6
cgcacgccgtacgcctacgtgatcggcatgacgtctgggaagggcaagcttacgtacacgggcttcccacggtacatgtcctatatggcggcaggtaaagccatgtgactggccctggacc

SEQ ID NO: 2889 - DNA, 335 bp, Zea mays
  Clone ID: LIB3228-006-P1-K1-G7
gagaaaatgcagggtactttcatttttagtgccggctgttagcattaaatggaactgcaaaagattcaaactgacaacaactagcagagaaagggaaaatcaacgcatgatggccacatacatgcacgagctggatgaacattgcgagtataggatcaacgtccaaagctatcgatatcttatgttcacaacggtgcaatgcggacgcgcgcacaggtacacaaaacgggcatgtgatttcagggaagcattggcaccagtgaccttgtgctacttatgtctgcagagcaccttcctcaccttcgttgcaagctgtatgatcgaatcatcttagt

SEQ ID NO: 2890 - DNA, 308 bp, Zea mays
  Clone ID: LIB3228-006-P1-K1-G8
cgcttttatgattggatgatgatgttattcttgagagatgttcggtgtgtttgggggcgcttagcccccctttgatattcattcgtgttgggagttaggtcaattcattgcttttatatgtgttatatactgtgattacaatgcaagattctaggttgtattaatgatgccttgatcaaaaaaaaaaaaaaaaaaaaaaaaataaaaatatagaatcaaaatcaaaagtttatcgatatcttatgttatcaacggttccttgtggacgcgcgcactcggacacaagaggggcatgttatttcagggaa

SEQ ID NO: 2891 - DNA, 402 bp, Zea mays
  unsure (1)..(402): unsure at all n locations; Clone ID: LIB3228-006-P1-K1-G9
cgaggacatcgaggaggccgtggcgcacctcagcgccctctcccgcgacttctccgacgccaagttcctcgaggtcaagtcctggctctcctccacgctcggcggcacctccacctgcgacgacgcatgcaaagacgcgcccgtcagcgacatcaagaacgcctgcatcaccaagagcttcgagtttgagaagctgctgcgcgtcacgctcgacctcatcaccgatgcctcagggtccatgtcggccgaggtcgcactgcctccgtcggcggcatcgggcgccagcgggccggcaccggcgccgttcggaggttacggctcgtccgctggcgccccggcctacggcgcgccgtctnctgctggcgacccagcttatggcgccagcggctcggcggcaccaac

SEQ ID NO: 2892 - DNA, 404 bp, Zea mays
  Clone ID: LIB3228-006-P1-K1-H1
cctccatgcccgcgctctcctaccgtgagccggatgggtccaggatgctgccagcccatggcgccgggagcgacggcgacgtctcctcgctggggcaatgccctccgggacaggacctccaccgtgaataggacgaacacgaacgtgcgtacacgcggcacaaacacgatgatcatcgtctcaccatgtggttgcatgcatcgggaaaccaatgcgttttcagcggccgtgaagccggcgaagaggaggacggcgagcgaggtggggttctccgacatgttcgccgtcgcaccgccgggggattggttcggcggcgggtcgacggcgccatcgccggggccgtcatcggccgtcaccgacgaagagtttaacctggagatgcagcagttcatgtcaatgctacc

SEQ ID NO: 2893 - DNA, 341 bp, Zea mays
  Clone ID: LIB3228-006-P1-K1-H10
cccacgcgtccggagtttattgatggtagaatcgaatcattcgatgttgttatttttgcaactggttataaaagtaatgttccatattggttgaaggaaaatgaattttttttcacggaaagatggatttccatgtagaccaaatgagtggaaaggaaagaatggtctatatgctgctggattctcgagacgtggtctacttggtgtttctatggatgcaactaaaattgcaaatgatattatacaatcttataataacataatattgtaagaataaatgatattgattattttattaataaacttagcatcaaaagaaaaaaagatcctctatttttttt

SEQ ID NO: 2894 - DNA, 194 bp, Zea mays
  Clone ID: LIB3228-006-P1-K1-H12
cgagtcagtcagacagtcagccgcgtgccatgggccatggcatagcatgccttgctctatctgctccatcttcttttacccatgccttgttctagggggggtactggggggggaacgaaatattgtacccagattttggcgccgtgttctgtccggtcgtgaacctgactggccttcctgggggcctcatttta

SEQ ID NO: 2895 - DNA, 393 bp, Zea mays
  Clone ID: LIB3228-006-P1-K1-H2
cccacgcgtccgcccacgcgtgctttgatatgtgggctggcacatggccagtggctggtgttcttgctgtctctcgcgcatttggtgataaactcttgaagcagtatgttgtcgctgaccctgaaatcaaggaggaggtggtcgacagctcccttgaattcctcatccttgctagtgatggactctgggatgttgtcactaatgaggaagctgttgccatggtcaagcctattcaggacccccaggaagcagcaaacaagcttcttgaaaaagcgttccgaaggggaagctctgataacatcaccgttgtcattgtccgcttcctatattgaactaccggtgataaatcaggcgcagacaaagagaccaccaatgaccaaaactcctaatacc

SEQ ID NO: 2896 - DNA, 404 bp, Zea mays
  Clone ID: LIB3228-006-P1-K1-H4
cccacgcgtccgcccacgcgtccgcggacgcgtgggtgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaagggcaagggcacatctcttttctaagcttctcgtccacctgtctggttgttgagttgaagctgtgggtctactactactgtgataaaaacatgtcggcaaatttcaatgttaatgtagcaatgaaagcagaccatgctatgtatccaaattccaatgcctgacatttgttctggggtgttggtcgacttttgggtaaatgaaa

SEQ ID NO: 2897 - DNA, 372 bp, Zea mays
  Clone ID: LIB3228-006-P1-K1-H7
ccctcaccttccaggtgaggggggtggtgcacaaaccaacaacgaatagcgcagccagcatcaccatggtgagcaggatggaggacctggaggccattgttgacgactaggtatttaatcttaagcacttgcttatttgtacctttacgctccacaccaatgaccttctaaagtaccacctttgcatacgctttgctgtcaagtccggaggctaccgtatcgccgactacgtcatttctgccgatttcaaggccgacaccacctataagaccacactcagcatttaaataatctttggtgatgaattatatttaaaaaaaactcatttagagcacattttttaaagacaatattattttttttattgggatt

SEQ ID NO: 2898 - DNA, 398 bp, Zea mays
  Clone ID: LIB3228-006-P1-K1-H8
aaagaattgaggacgcagggggctttgttatgtgggctgggacatggcgagtgggtggtgttcttgctgtctctcgcgcatttggtgataaactcttgaagcagtatgttgtcgctgaccctgaaatcaaggaggaggtggtcgacagctcccttgaattcctcatccttgctagtgatggactctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcct

SEQ ID NO: 2899 - DNA, 439 bp, Zea mays
  Clone ID: LIB3228-006-P1-K1-H9
ggccggaaataactggtcgagccaacccacgcgtccccccacgcgtccggccacgcgaccaacattaggcgtgattgaggtcatctaagctaaatcatttcttctgtctcacacttactggggggctacacagttctccggacaattactaacattgcaccaccaggtgccccgatataaaaaaagcaccactctctggacggcggcgatgcccggcaccgcgagaactacattaatgagctcatcaaaaggatgaattaagttcacgatcaaactcatttatagaaccctgcgctctaagtgacttcttgtgctggccctattttatattaaaaagatggatcgtcggtgaatatgcatgcagggatgaaggttctaactcgatgtgtatggaagaaatatgatcttttttgcggcgggttgggattattattttaag

SEQ ID NO: 2900 - DNA, 420 bp, Zea mays
  Clone ID: LIB3228-007-P1-K1-A1
atcaaacaatccgcctccgcctccgcctccctagggttttgctctcggctcgtcggatccagttcgggggatcctccatggcgtcgcgtccgtcgctgaagtcgaagcccaagggcaagggcgggaagaaggccaccgctgacgacgaggacgccaccgcggcggcgaccacggtgaggctcatgaaggagtggaccacgtggacgatgaagaaggcgaaggtggtggcgcactacggcttcatccccctcgtcatcgtcatcggcatgaactccgagcccaagccctccgtcttccagctcctctcccccgtctgatcggatcatgacagggcccggatgaggtcggtccgtagtagtttgtagctggtacttcatttgcttacatatgtccgagatcgagttgaagaaggtggatcat

SEQ ID NO: 2901 - DNA, 412 bp, Zea mays
  Clone ID: LIB3228-007-P1-K1-A10
tgcgtcagtgataaagaataatctcggtgtcaccatcattacaggcactttcatccttcaaaacaatgccgtgcctcaggaccagcgaggcgctgcgaatggactgtccatgactgggatgtccttttttcaaggcacttgctccagcaggagcaggcattgtgttctcatgggcgcagaaacgccagcatgcgtttttcttcccaggtgaccagatggtattcttcctcctgaaccccgtcgagctggtcgggcttctcctcacgttcaagcccttcctggcagtaccagagcagtacgatacgagatagttagacgatctatctatctatacaagttctggaacgttcaagacgattcatcgtgtgcggctgtaccagtgaaggagaagcgccaaagcgtgtgcccttta

SEQ ID NO: 2902 - DNA, 404 bp, Zea mays
  Clone ID: LIB3228-007-P1-K1-A12
cccacgcgtccgggtcatgctaggctcaaacccaaacttgatgaagtcctgcctaaagctgctgcggttgtctttgttgttgatgctcaagatttcttgtctagcatgcaagctgctgcagagtacctttatgacattctgacaaaggcaactgtagtgaagaaaaaggtccctgtgcttatattctgcaacaagacagataaagttaccgcccactcgaaggaattcatcaagaagcagttggagaaagaattgaacaagcttagggaatctaggaacgccgtatcgtcagccgacatctctgatgaagtccagcttggggtccctggagaggcattcaacttcagccagtgccagaacaaggtggctgttgcggagggtgctggtttgacaggtgatgtttc

SEQ ID NO: 2903 - DNA, 215 bp, Zea mays
  Clone ID: LIB3228-007-P1-K1-A2
tgcttgtatatctagaactcgccgaattgggaaaggttttttaatacaggtcgagtggttcaaacagccttgtggttccatcaacatatttttattgtttttagcaaaatgtcaaggccggctaacaccatttactgtgctcttacgacctcggatttgcgtcgaccagcgttagtctcatgaaggggtggatcttcaaagcttgctggagcaat

SEQ ID NO: 2904 - DNA, 432 bp, Zea mays
  Clone ID: LIB3228-007-P1-K1-A3
ctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctgcccttggaagtggagctgccatcgccggcgttgccgctgctgttgctaccatgatcttcttctactaaactcaccgacgatggtcgtgtcgcggtgagacattaaggtggacacgtaat

SEQ ID NO: 2905 - DNA, 397 bp, Zea mays
  Clone ID: LIB3228-007-P1-K1-A4
cctttgcggaggatcaactgggtttttcgtgtacggctactgcctgtactactactatgcgcgatccgacatgtctggcttcatgcagacatctttcttctttggctacatggcctgcatctgctatgcattcttcttgatgctcgggatggtgggcttccgcgccgccctgttctttgtccgccacatatacaaatcaatcaagtgtgaatgagctgttgctggggagacgaagagcagcagagttgtacccgtttttggtgccccaccgagaggtcccagatatagaaaaggttagctctcgcatgcgacaggagcagctagagattgccatgtttcagagtaggccaattatttataggaacaggtaatgaacctataaaattggtcttgtttt

SEQ ID NO: 2906 - DNA, 395 bp, Zea mays
  Clone ID: LIB3228-007-P1-K1-A7
tgcttgtagaccttgggcgcaatgatgtcggaaaggtctccaaaccaggttcagtaaaggtggagaaattgatgaatattgaacgatattctcatgtcatgcacatcagctcaaccgtcaccggtgagctacgtgatgatcttacgtgctgggatgcactacgagctgcattgccagttggaacagttagtggagctccaaaggtgagagcaatggagttgatcgacgagctagaagcggacatgcgtgggccgtacagcggtggcttcggagggatttccttcaacggcgacatggacatcgcgctcgcccttcgcaccatcgtcttccccaccgcatcccggttcgacaccatgtactcctacgcgaacgggaagtcacggcaggagtggatc

SEQ ID NO: 2907 - DNA, 409 bp, Zea mays
  Clone ID: LIB3228-007-P1-K1-A9
gaaaaggcagttgctgcaccttcaaaatcaagtccggattccaagaagagcaaggatgacgacgattctgatgaggacgagactgatgattctgatgaggatgagacggacgattctgatgagggtttgtctcctgaagaaggcgatgatgattcaagtgatgaagatgataccagtgacgatgaggaggaagacactccaactcctaagaagcctgaggtaggcaagaagagagctgctgaaagttccgtgctgaaaactcctctatctgataagaaagcaaaggttgccacaccgtcatctcagaagacaggtggcaagaagggcgccgccgtccatgtggcaactccacacccagcaaaaggcaagaccattgtaaacaatgacaaatcggtcaagtctccaaaat

SEQ ID NO: 2908 - DNA, 404 bp, Zea mays
  Clone ID: LIB3228-007-P1-K1-B10
atctctaactcagtatcaggtcccagctgatcgatggtggtcttcactttacaaagtgatcgaaggcctcgccacaatgagcagattgggccgcaaccgtctgcagcaaccttcttataattttgagaacaacaattctattgactgggaccaaatgtagatgtagaattctggatcacaacagcattgtggagtaggctggaggtgtagttatttctggcggatttgattcctgcggtgtgtaaacgctgcagcaacacgtaacttgcgaataaggaacgagttttgccacagcaggacgatccttgtaccgtcgtccgcaagggttgtaatttctcagggaccgttacgacacgattgtatgtcaagttttgacagtttgagccaatgcaattcttctaatg

SEQ ID NO: 2909 - DNA, 382 bp, Zea mays
  Clone ID: LIB3228-007-P1-K1-B11
atctataacttagtattaggttctagatgcgcgctgttgttcccgactctacaccgtgccccacctgctaggagaggagacttcatcgcgaagctcaccatgatctcacccgagaggagctcgtgacaaaaccagcggtctggggtggcaccagctccagacctggcaatctgcgtcacagctcccgtgaagatgggtgccggcgtgcagttctacatgtcctaccgcgttatcagcagagaccaaactcttgaatttcacggaccaggcgaatttggtactcggcgctatacagaatgtcgatggttgcatcgtcggcttgctgggaggtacaaaggcatggacctaccccacactactgagaagaatgcttttgcagaat

SEQ ID NO: 2910 - DNA, 395 bp, Zea mays
  Clone ID: LIB3228-007-P1-K1-B12
cgttatttgttgcaaaagacgagagcctctggaaatgcgtgaacgttacaaatacgaaatcaaagaatcccatagaggagctaggaacagtttataactacatttcatctccagacggccgctctgcaatgatgaattctcagtcaaggtaccaagctgcaatgatcttgaagaggtcgtgcatgcagcagtatgcactgggcgacattctccaggttctgcatatcgttgttgttcgaaagaaatggctcgtgcctcattcttcaggctggcagccgctgtccttaaaacgcaacagcggatcctgcaactactgatggtacaggaaaagttaaatcttcttttcctgtggccgtctaggattctgcaactactgatactactgaactactgat

SEQ ID NO: 2911 - DNA, 432 bp, Zea mays
  unsure (1)..(432): unsure at all n locations; Clone ID: LIB3228-007-P1-K1-B2
ttcgantaacacaggtgagcgcgacgatgggatccctcgctaataacatcatggtcgtgggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatcttcaaggacggcaagggctgcggctcatgctacgaggtgagatgcaaggaaaaacctgagtgctcgggcaatccagtcacggtgtacatcactgacatgaactacgagcctatcgctccctaccacttcgacttgagcggcaagg

SEQ ID NO: 2912 - DNA, 378 bp, Zea mays
  Clone ID: LIB3228-007-P1-K1-B3
cggacgcgtgaacgattgtgtgtacggctactactgttcttgccataattatatatagagacgcaaagtgtggccaagcctacccacatgcatgctattgcatgcctccgaatatatattatccgactcgatcctgccaaattgtttcgtcgacttcattatatatatcccatccctttaatttaatggagaagtgtgactgctgttaaacaaaaaaaacaagcggaatcaagaacgtgaacctgccaccctacaaaaacatgacaagaaaagcggaaacaaacccatataaaaagaacaggggggggggcgttttagaggatccaagtttacttccgggtgcatgcgacgtaatagctcttttataggggcacctaa

SEQ ID NO: 2913 - DNA, 331 bp, Zea mays
  Clone ID: LIB3228-007-P1-K1-B5
cgtctttgtcactggcaatggacggtggtgcctagcgcaactcagcgcacaactgtgtgtgttgatttttcttctgtttataacggcattagtgccatgccgttttatgttacagtgttgtgtgctcgcaagcatccgaaaatatgcgtctgagtttagggttgggtcaaacttgtcgaatttggggttctgttataatatgttgagcatgaataaagatggatgctggtgactctgtcgccatcgccgtccatcatgagtgtcctgtaattcaacttatatctatcatgtatgtatgtgtgtatgtatgtatgtttgcaagctaaatacc

SEQ ID NO: 2914 - DNA, 287 bp, Zea mays
  unsure (1)..(287): unsure at all n locations; Clone ID: LIB3228-007-P1-K1-B6
gaggtgaaccagcagcctccaataaaggccagcccatccaaataaaaccgggagacctcagccctcaggcaagccgaccgccgacgtaccaccgcgccaacccgagagaaaagatggagatgatcaagaggatcctcatcgccgcgctcctcgtagtcgccgtctcggccaccgcagtgctggccttcaccgaggccgccgncgncggcgccccagccgncttcgagtcgtcggcgtccgccgaagcccccgctggcgccgccggcgccggcgccggcaccggcacc

SEQ ID NO: 2915 - DNA, 402 bp, Zea mays
  Clone ID: LIB3228-007-P1-K1-B7
caaaaggccaatgctcttctggggttcgagaagcttgtgaaggccaagacacaagttgttgctggcacgatgtactatctcactattgaagtgaaggatggcgtagtcaagaagctttatgaagctaaggtctgggagaagccatgggagaacttcaagcagctgcaggaattcaagcctgttgaagagggtgctagcgcctaaggatctgtcgtctccctgtgcaatttgctgcctgaagcgcaaaactaagttacagaataaggagctgcttcgtaacatgccagagcatgcaccctcgcgtaatttcataaaatcacagggctcttaatgtaatatcttgaattgccgtgccatgtgtaataagtaatatcatgaataacagttgctattatgggttct

SEQ ID NO: 2916 - DNA, 421 bp, Zea mays
  Clone ID: LIB3228-007-P1-K1-B8
cggacgcgtgggcagtcagaaaatagtgggatcgagttgtttcactgcacgagcacatcctccggcgaccaccggcctccctctccgtcctctagcgaccgaccaacgcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggggcacctcgccccgaccggcctgatcctgggaggcaccaagtacatggtcatccaaggcgaacctggagctgtcatccgtggcaagaagggatccgggggcatcactgtgaagaaaacaaggcagtcac

SEQ ID NO: 2917 - DNA, 241 bp, Zea mays
  Clone ID: LIB3228-007-P1-K1-B9
aaacaattggcatcaagtaagcgaatgaatcccatggtctcagaccaccagagcattcgttacctctccatggaaatggaatggaacaggggccgcgagaccatcggtgaccgcagccttgcgctcggggcagctacgctacggctcgggctcgggcttttcttggtccatcggagaggcagcatgacactgatagggaggatactgtaaagacaccccaaaaggaaatgtgttcgacttt

SEQ ID NO: 2918 - DNA, 418 bp, Zea mays
  Clone ID: LIB3228-007-P1-K1-C1
gtcctccagatgtgtatgtggcggcaccctcaaaatgcacctctgccttacaaaggatacagggatgaagattgggaagacaacgatggggctttgaacacaatctctatgacacacccccgcattcccatcgagcatccacaccattttgtagtcgatgattctgactgccatcctttgcaacctgggatatggtattacaagattattgaagctgaccacattctattcattgtgaaccgggaaagagctggagtgcagtttgatttgctgtacgatggcatttttcagcgctgcaggaaacatgcctttaggaagagcccacctactgtaccaaacgaaacgagccgatagcaaaactaagctgaagtatgtgtaggtagtacataggaagaaacaaggtgccacgacattttca

SEQ ID NO: 2919 - DNA, 317 bp, Zea mays
  Clone ID: LIB3228-007-P1-K1-C10
cggacgcgtggggcatccgcttcgctgtcaagtctggtggctaccgcatcgccgacgacgtcatcccctccaatttcaaggccggcaccacctacaagaccaccctcagcatctgattagcctcttatgacgaataatattttgagagagctcatctggaccatgtgccagcgagctaatatttaatttttttctttggttatattgaggcaccacatgagccaagaaaaaagttatgctcaacaaaaaaaaaaaaaagaaagaaaaatggaacacacactgaaacaagacaataaagcgcgaaaaaagtgagagga

SEQ ID NO: 2920 - DNA, 148 bp, Zea mays
  Clone ID: LIB3228-007-P1-K1-C11
cggacgcgtgggcggacgcgtgggtttttttgttattttgttgttagatttttggttttatttgttcggtagtgaataagtagaatgcatgatctactatgcatatttgtattttgtttttagcattgagctagttatgatttttttc

SEQ ID NO: 2921 - DNA, 343 bp, Zea mays
  Clone ID: LIB3228-007-P1-K1-C2
cctccacctgcaccatcatcacctccaccgtcggcacctgaggagttcatcttgccaccaatcatggcgcagcagtatgcgtcgccaccgccgcctctgttccaaggatactaagcggtgatcacagcgcgctctactgacgatgagagtaatcgcgacgagggaggccaggagaagcagtgacaagtcgatcgcaccatgcaatgctctagcgacctgaattgaatgctatcggataagcgcatgtacgtttgtgcgtaagggtataacagcataggtaatgtaacgagtgtgtgcacatgtaacatgatgaccgagaagagaaacatgcaaatggagaagg

SEQ ID NO: 2922 - DNA, 178 bp, Zea mays
  Clone ID: LIB3228-007-P1-K1-C3
cggaatcccgtgtcgagcaggcgtacgcctccacatatactattatcaccttcaccgtcgtaacctgaggagtttaacataccacggaggatttcacattagtgtgactacacaccgcctccttacatttaaggattctaacagactagcacagcgctctctaatgaccatgatagta

SEQ ID NO: 2923 - DNA, 346 bp, Zea mays
  Clone ID: LIB3228-007-P1-K1-C4
gccgtggtcgtcggtgctgaggtggtggctgccgctggtgaggctgccccttgcagaggtggttgcctccgctgccgggaccatcaaggccacctgccgctgagtccctgactctttggctttaatggcctcactgctccccctccgcaggaggatgggggcgaggccctattcgtagcagcgcttgccatgaggcgatcgctgctgctgtctagctgcccggggcggaggtcgttgtcgctgctaatgcagaggtggtcgccgccgctggtgaggcagcccggagcagcttctagcgcgactcttgttggtgcaacgtagtccattcctgcagagatggagctgg

SEQ ID NO: 2924 - DNA, 422 bp, Zea mays
  Clone ID: LIB3228-007-P1-K1-C5
tgcagtcatctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaagg

SEQ ID NO: 2925 - DNA, 186 bp, Zea mays
  Clone ID: LIB3228-007-P1-K1-C7
ggcagttcctgcttacatattattactcgtgcttccaaaggagaaacaaaagattgaggaagaggaaaaagaaaacttaaagctgctattgaagaaactaggggcgccctctttagaggatccaagtttacttgcacatgcatgcgacaaaatatactcttttatggggtaacctaagagcaattt

SEQ ID NO: 2926 - DNA, 408 bp, Zea mays
  Clone ID: LIB3228-007-P1-K1-C8
aggcattgttttactcgctatgtcgagtaccacaggtgtttgaatgccaaaggggatgatgctggtgtttgcgaaaaatttgccaagtactacaggtccctttgccctggagaatgggttgagaaatggaacgagcagagggagaacgggacgtttccaggacctctctgaatgtaccgcccgagacctccagttggaccagtcaacaagttggccaggcagtcctactgttccattctgcattcctacttcccgaatcgtaaatgccttttgtcccttgctcttcaaccagtcaccacaaaactgttagtgatgcctctcgtacgcagctctaataatttggctacagttgccccacatgcagccttgttttgtgtgtggactgtggacctcattttgttcactttt

SEQ ID NO: 2927 - DNA, 402 bp, Zea mays
  Clone ID: LIB3228-007-P1-K1-D1
cggacgcgtgggttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaggtccacgct

SEQ ID NO: 2928 - DNA, 400 bp, Zea mays
  Clone ID: LIB3228-007-P1-K1-D10
gcgacgacgaggtggccttcctcacgcgcggggacgccaacgacgagaagaacgggctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcggcgccatctgcaccaccaagaagggcgccatcccggcgctgtccacggtcgccaccgcccaggaccttatcgccaaggccaactagatggtcgtacgccccgccgt

SEQ ID NO: 2929 - DNA, 412 bp, Zea mays
  Clone ID: LIB3228-007-P1-K1-D11
cccacgcgtccgcccacgcgtccgcccacgcgtccgcggacgcgtgggttaaaatatgttaatactagttagaaccgtacttatcgcacccacccataaattcaccattaggactcacaataatagccacaattgaattaataagtatttacgcgattagtacgtaattaagatatgattagtgcgataggttaatgtgtgtttaatgacgtattggtgtatgtttatgaatggtgcatgtttatttattggtgtatgttttatttttgtatgtgcgctatgcgactctattagaagcggattgtgcggtagacgatccgaactcgttcgaggacgatccacaggactcgcttgagcaaggcaagtggattctccctctgcatattctgtttgtacctattcactgcatata

SEQ ID NO: 2930 - DNA, 412 bp, Zea mays
  Clone ID: LIB3228-007-P1-K1-D12
gaaataattgcgaataaatagttcgtgaatccctgaagcgtgcatatatatattcctgccaagataaaggtaatggagtcgttacgcaggttccagccggccgtcatcctgcttgtgctgctcattgcgtccaccgatatggcacaggcaagggaatgcgagaagtacagtgagcgatttgttggggcatgcatgatcgcagacaactgcgccaatgtgtgccgcggtgagggcttcttggccggcaggtgcagcacctttcgccgtcgctgcatctgcactaggcagtgctaaacaagatcgctcgatcgctcggcatgcatcgacaacctattcttaataacgttcattatctagatcttatttatgacgaatgtcatgtatgttctggtgactgtcatgtatattctga

SEQ ID NO: 2931 - DNA, 351 bp, Zea mays
  Clone ID: LIB3228-007-P1-K1-D2
cgctcgcttcaattcactagtgctcatcctgcgcattaggagacaggtagctcgagcgcgcgctacacctgctccgacacgatgcgggccatgtggaagaagaagaggatgccgatgctcaagaggaagcaccgcataatgaggcatagatctaagtgggcgcatcttgtgacgagcatggcgagcttctgctgcatcatggctgaggctcgatgggatgaaagtctaactttgcagacctgctttgcgtgctacgcaggcgatgtaaacgcgcctttatgatccattctagcatgttctgagactaggtttatatcgcaatcagaggataattatatgatgctctacgtg

SEQ ID NO: 2932 - DNA, 325 bp, Zea mays
  Clone ID: LIB3228-007-P1-K1-D3
cccgcctgcaccaagatgtgcaaccaggcgtgcggcagcaccgacaagggcgccggcggcggcgcgccggcttgatcgacccgggcttcatcggcgcgcgggctcagctcgatatcagcatcatatacaatcgctgctccgtcgctcacgtcagcccatgcatgatctctcgacccggcccattgaatcttctgcttctactatagtatatctttggtgcaggtcttcgttctcatacatcgatccactcatcttttttttaattcctaccattaagtgagatgacctatatatatatatatatatatgcatgattcagttcttt

SEQ ID NO: 2933 - DNA, 397 bp, Zea mays
  Clone ID: LIB3228-007-P1-K1-D4
ccaagcgttccgcggacgccttggggtccacccaagaaaaggtggaaaatccacccgggtggctacctgtttttaatggtttgggccatacttttgcttgcactttgaggcatatcagcttgggttggcaccagtatacatggcttttctacgatttatgggtgacgaaaatgattctaggaattacagctatagccttgaagttggtgcaaatggcaggaagatgatatgggagggaacgccccgcagcattcgggacagccaccggaaggttagggacagccatgacggcctaataattcagcgcaacatggctctcttcttctcaggtggagataggaaagagctgaagctgcgcgtcacaggccgtatcttgaaggagcagcagaaccctgac

SEQ ID NO: 2934 - DNA, 409 bp, Zea mays
  unsure (1)..(409): unsure at all n locations; Clone ID: LIB3228-007-P1-K1-D5
cccacgcgtccggggacgcgtgggctgcaacccaagagaggtngaaaatgcaacctggatgctaactgtttttcattgttttgggcagtacttttgcttgcactttgaggcatttcagcttgggttggcaccagtatacatggctttcctacgatttatgggtgacgaaaatgattctaggaattacagctatagccttgaggttggtgcaaatggcaggaagatgatatgggagggaacgcccctgaaaattcgggacagccaccggaaggttagggacagccatgacagcctaataattcagcgcaacatggctcttttcttctcaagtggagataggaaagagctgaagctgcgcgttacaggccgtatctggaaggagcagcagaaccctgacttgggggcctgc

SEQ ID NO: 2935 - DNA, 370 bp, Zea mays
  Clone ID: LIB3228-007-P1-K1-D6
gaagcccaacacacacaaaaccaaaaagcataatcacattaatggcccgcgcgtgtgtgttcctcgtggtgctcctcctggccgccgtcgcggtggcgccgtttggcggggctgcgcgtgtggatgtcgtggagggcaggtccatggcgtccgccgacgcgcctgaggcggcggctgacgcgcccgctcccggtcccgactccgcctcatccccggactcgccgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatat

SEQ ID NO: 2936 - DNA, 327 bp, Zea mays
  Clone ID: LIB3228-007-P1-K1-D7
ccataccgcgcggaccgggccgggagaaacaaaactgacaaggacgatatggtgcgtagcctcgtcgcgctgatcctcgtcgccacggccgtagccgccgtggccacagccgcaccctcgccggggtttgtcgtcaccggccgcgtctactgcgacaactgccgcgccgggttcgagaccaacgtctcccacgccatcgaaggcgcgacggtggagatggagtgccgtcacttcgagtcgcaggaggtccacgacaaggcggaggcgacgacggacgccggcgggtggtacaggatggagatcagcggtgaccaccaggacgagatc

SEQ ID NO: 2937 - DNA, 334 bp, Zea mays
  Clone ID: LIB3228-007-P1-K1-D9
gcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcggcgccatctgcaccaccaagaaaggcgccattccggcgct

SEQ ID NO: 2938 - DNA, 270 bp, Zea mays
  Clone ID: LIB3228-007-P1-K1-E10
cccacgcgtccggtacataaaaccgatcagcgaaagtgctaagagcaatggcgggagtgctaagagcaatgacaccatcaatgctaatgtgaaatccaacactggtattgttgcaaacactgatgccaagagcactgatgaacagactgacactggaagtgttgactgcagcggtgattacagcgctgtctcaaaacaaaacattgggcgggttgctgtatgcattcagaggttggagagcaccatgagttaaggtgcaaatctgggaaa

SEQ ID NO: 2939 - DNA, 258 bp, Zea mays
  Clone ID: LIB3228-007-P1-K1-E11
ccaaaacaagatgattgtgatggttctcttactttccacctttcttgaggtggggggatctttgagggtttcagaagaaccctaaaatgcggatgacataagaggtgcttgcatcgaggagtgcaccaaagaaaataaggctcctggcgacatgaaaacatgctaagatgtttgcaccaagctcacaaaatagcctagcgaataatgcaaacatgattgatgaagtataactctgataatatatacactagtggatca

SEQ ID NO: 2940 - DNA, 412 bp, Zea mays
  Clone ID: LIB3228-007-P1-K1-E12
ggcgatattaggcagtacaacattgaggatcccgcaaagcctttcttggctggacaagtatgggttggtggtcttcttcagaagggcagtgatgtcgtctatgttactgatgatggtcaggaacagcagtataatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgcagatcgatgtcgacaccgagaaaggaggcctggctgtcaaccccaacttcttcgtcgattttggcaccgagcctgatggtcctgccctggcccacgagatgagatatcctggtggggact

SEQ ID NO: 2941 - DNA, 261 bp, Zea mays
  Clone ID: LIB3228-007-P1-K1-E2
acgcgtccggaatgaaccatgcatgcatgcatgtatgcatgcgccggggtgacgtggcgttcagctcaggcgctgagcgagtctatacgtacgtcgtcaccggctggccacgcatgcgataaccatctgatatggacggaactatatattggattcctattaatctggcattttctaagctaattggtttttttccaaatataccgttgatggaactccaaatgtaatgtcacgcaaatgtgtgtttttaatgattgaatg

SEQ ID NO: 2942 - DNA, 411 bp, Zea mays
  Clone ID: LIB3228-007-P1-K1-E5
tcgctttagggttctgttggggcaagtgcatagttcggagcgcgggggctaccgtgcgggaggcgctagccgcgtgcatgagctcttgcggcctctgctgtgaggcatgcaactgcgtgccgcgcgacatccatgactgcccctgctaccgcaacatgctcaccggcggccccaagaagaggcccaagtgcccctgagactcgagactgctaggctgactcacatggtggcattaatgggactgcgactggtgcctgcaactgcgattcaattcatgctgagcctgacaacctggtatgttatggatccagatatctatatggttggtagatttttttttggtattttgatgttagattattggttttctttgtgcgggtggggataatgagaatgcgggttctactattc

SEQ ID NO: 2943 - DNA, 308 bp, Zea mays
  unsure (1)..(308): unsure at all n locations; Clone ID: LIB3228-007-P1-K1-E6
aaaaaaagaaaanaanaagaaaaanaaaaaagaaaaaaaaaaaaaanaaaaaaaaagggggagaaaannaaaggaggagaaaaaaaaaaaaaaanaaaaaagaaaaaaaaaaagaaaaaaaaaaaaaagaaaaaaaaaaaagaggaaaaagaaagaaagaaagaaaaaaaaaaaaagaaaaaaaaagaaaggagaaaaagaaaaaaaaaaaaagagagaagagaaaaaaagaaaaaaaaggaaaaaaaaaaaaaaaaaaaaaaaaaaagaaaaaaaaaaaaggaaaaaaaaaaaaaaaaagaagaang

SEQ ID NO: 2944 - DNA, 286 bp, Zea mays
  Clone ID: LIB3228-007-P1-K1-E7
cacaaaagcaaaaagcatcatcacaataatggcccgcgcgtgtgttttccggggtgggggtcctcctgggcggcgtggcagttgctcctattgcgggggctgcgcttgtggatgtcttggagggcatgtccatggcgttcgccatacgcgcctgatgcggttgatgacgcagcccgctcccggtcccgactccgtctcattcctggactcggcgtgggaggcgcgctccatgtggagcttattcggctagccgtgcacaacgcagaggttgggatgattctattta

SEQ ID NO: 2945 - DNA, 313 bp, Zea mays
  Clone ID: LIB3228-007-P1-K1-E9
cccacgcgtccgatttaaccttcagtcggcaggacatatttcttattccggggggagggcacgacgactggacaaagattgagtatggaacgtactcgtgcatgctaggcatgatccgtgatcagatcctgtcatggccggcaaggtcattctcgaagaacctcttggagcgtgactggctgaggagctcatcgaggatctgggacatggtgaagaagtcccccgtcatttcggagtactgcaaggtgcttcatagcttaagatgggtttaagaagtaacctgattagtgtgtagcaactacttgttgggatg

SEQ ID NO: 2946 - DNA, 387 bp, Zea mays
  Clone ID: LIB3228-007-P1-K1-F1
ccacgcgtccgcccacgcgtccgcccacgcgtccgatggagtggttctccatcatcaccacccccaacccaatctttagccacttggcgggccggacatcggtgtggaaggcaatatctccggcggtcttgcagtcgtcgttcaacaccacgccggagatggagaagctgttccgtagcaagaggcttgactcggagatcttctttgcgccttcaaactgattcattcgccggtggaaaatggtccatccatctcgagtaaacttggtgtcctgggtgtgttctttagcagcttcagtttagaataatcagggtatgtcttcatcatcagttttttagatcgggtcatgtaataataaacttgagatggtacacatgtttcttaatt

SEQ ID NO: 2947 - DNA, 306 bp, Zea mays
  Clone ID: LIB3228-007-P1-K1-F10
atcacgaagtgtcttccgcctcttcaatgttcctgcacaatggtacccatggattttgctagtgctatttcagtttctcgcaagcaatgtttcattgctgggacacctttgtggcatcttgtcaggatttgcatacacttacgggctgattaactacttgcttactgggccatcattttattctaaaatctgaggcttggcaccattatctcgttgagtgaggcgagctagctttattatgtgtactgcgggcactacttatagtcaggttgctacatactctaacacgactggtggaccaagtgc

SEQ ID NO: 2948 - DNA, 420 bp, Zea mays
  Clone ID: LIB3228-007-P1-K1-F11
cccacgcgtccggtgcaaggaagcaggcggccaccatggtgaagggacgcacgggacagcgcgtcaggctctacgtccggggcaccatcctcggatacaagaggtccaagtcgaaccagtacgagaccacgtcgctcgttcagatcgagggggtgaacaccaaggaggacgtcgcgtggtacgctggcaagcgcatggcgtacatctacaaggctaagaccaagagcagcgagacccgctacaggtgcatctggggcaaggtcacccgcccgcacggcaactcgggcgtcgtccgcgccaagttcaagtccaacctcccgcctgagtccatggggcgcaaggtcagagtgttcatgtacccgagcagcatctaaggtttttgttgaagtaaaggtggactccaaatggccatgcttattt

SEQ ID NO: 2949 - DNA, 251 bp, Zea mays
  Clone ID: LIB3228-007-P1-K1-F12
tcggccacacatactgtgcaagctagtaaacctcccacaactttaatgtactgggggggccctccatggggttctaataatacaacaccattctggttttcaaaaggttcacattaaacccattccaaaacactttctttgttctgctttgcggttttaacaaccctagatttacgtaccgttttacttctagcaaattcattttttttagtttcatatcaaattattagatttcccgtattttttaaatt

SEQ ID NO: 2950 - DNA, 423 bp, Zea mays
  Clone ID: LIB3228-007-P1-K1-F2
ggagggcaaacctgcatggcttgaaggagctccagttgctcacgttcgggatggccaactccaaccttgctgacatctatagcttcctcaagacctgcccgtgtcctcgtttggagcgcctctttgtgcagctcccgacaaacaccggtgatgcattcacggagaatttcttggaggtggcggaggaggatccaccaaaaggtggattagaaaacctttgcttagccaagctgacaaatttcaaggggcaccgcaatgagatgcaactagtaggatttctgcttagaaagtcttgtagtctgaagaaactatttctgattgctcctaaggaggatcaccctcaaggactccgcaagacactgtcagatacgctgcctgattttctaaaaaaagaaatattgcatctggaaagagcttcaacag

SEQ ID NO: 2951 - DNA, 342 bp, Zea mays
  Clone ID: LIB3228-007-P1-K1-F3
cccacgcgtccgagcagatcgagcagaggtcgacaagacgagacaagagaatgcctgtgagcaggatcgccgtgggcgctccgggcgagctgtcccaccccgacaccgccaaggccgccgtggccgagttcatctccatgctcatcttcgtcttcgccggctcaggatcgggcatggccttcagtaagctcacggacggtggcgccgccactcctgccggcctcatcgccgcgtctctggcgcacgccctagccctcttcgtggccgtctccgtgggtgccaacatctccggcggccacgtgaaccctgccgtgaccttcggtgcctttgtgggcggcaaca

SEQ ID NO: 2952 - DNA, 417 bp, Zea mays
  Clone ID: LIB3228-007-P1-K1-F4
ggtcttcacagaatgttttaacactctacctgtggctgctcttatcgatgataaaatattatgtatgcacggtggactctctcccgatctagcacacttggatgagataaagaacttgcaacgtcccaccgatgtaccagatcaaggtctactgtgtgacttactttggtcagatccaggaaaagatgttcaagggtggggcatgaatgatagaggggtctcatatacctttggtgccgacaaggtttcagaattcctgcaaaagcatgatcttgatcttatttgtcgtgctcatcaggttgtcgaggatgggtatgaattctttgctgacagacagcttgtcaccatattctcggctcccaattattgtggtgaatttgataatgctggcgcaatgatgagtgttgacgaaacttt

SEQ ID NO: 2953 - DNA, 420 bp, Zea mays
  unsure (1)..(420): unsure at all n locations; Clone ID: LIB3228-007-P1-K1-F5
cggacgcgtgggtaatggaccaactcaccgagctcaccantaaaggttgtggttgtctgcttgtggttgatgaagagcatcatttgattgggaccttcactgatggtgatctccggcggacactgaaggcaagcgggccagctatcttcagtctcacagttggagagatgtgcaacaggaacccaaggacaatcactgcggaggcaatggcagttgaagccatggagaagatggaggcaccaccttcacccgtgcagttcttgcctgttgtcaacgagaacaacgtcgtgtgtggaatcatcacattgcatggattggtctctgccggattgtagacttgtgtggcaccattacctgttagctagctgttaccgctggagtatttatgtggagcctgaactcttcagtgtacccttatgt

SEQ ID NO: 2954 - DNA, 406 bp, Zea mays
  Clone ID: LIB3228-007-P1-K1-F6
tccaccaccaccggcaccggtcagctcaccaccacctccagtgaagtcaccgccacctccagcaccggtcagctcaccaccacctccagtgaagtcaccgccacctccagcaccagtgagctcaccaccacctccagtgaagtctcctccgccaccagcaccagttagctccccaccacccccaataaaatctcctcctccaccggcaccagttagctctcctccaccagcaccagtgaagccaccatcactaccaccaccggccccagtaagctcacctcctccagttgtcacccctgccccgccgaagaaagaagagcagtcattaccaccaccagcagaatcccaacccccaccatcattcaatgacatcatccttccacctatcatggccaacaagtacgca

SEQ ID NO: 2955 - DNA, 438 bp, Zea mays
  unsure (1)..(438): unsure at all n locations; Clone ID: LIB3228-007-P1-K1-F7
aaaaaannaaaaaaaataaataaataatattattttaaataaattatatatttaatatgggaggaaaaaaatctcttttttaataataaaatatatatataaaattatttttttttttttttattttattttttttttttaatttaaaagggggccctttttttgatttaaaattttttttcctttttttttaaagaaatatttttttttttttttgcccttaatttaatttaattgcccgcctttttaaaaaccggggtttggaaaaaccttgtttttcccaaatttattgtttttaaaaaaatccttttttttcaattttggttatttaaaaaaaggccccgaccttttttttttttaaaaaattttgcaaccttattttgtaatttgaacccccttttttttttcaattttaattcgggggtttttttttttttt

SEQ ID NO: 2956 - DNA, 368 bp, Zea mays
  Clone ID: LIB3228-007-P1-K1-F8
ctccattcaatagccatggccacaaagtgtttgtccaaagcccattgatacccggtcatggcgatggatctaatgtgccagtcatggatgacacaggttgcgacaggcaggcaagaacagtgcccgaccaaggagttccagtgatcacagaaaacgcaatgcttgattttatgtacaacaaagatcaagccggtaatatcgacgccacagatcctagtgatgctacatacattgctaggcttcaagatgatgatgacatgaaagagcaagcatgaatggtacatacaaatgtgctattccatgcattaaggaatgatgctcaaaattttgcatattcttctgaagggaaatattattgtgccgatact

SEQ ID NO: 2957 - DNA, 416 bp, Zea mays
  Clone ID: LIB3228-007-P1-K1-F9
cgatcgtcggagcagagagagacttcctcgcctccatcccatcccgccgccgccgtctctacggtcgctaataagcagccgcatccagggatggagatgaagaagatcgcctgcgccgtcctcatcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcgggggcagtggcacaccttcgtcttccttttggtt

SEQ ID NO: 2958 - DNA, 415 bp, Zea mays
  unsure (1)..(415): unsure at all n locations; Clone ID: LIB3228-007-P1-K1-G1
ctcgaataatagccgcaaaaccctaaccttggcaccgtataaacgagccaacctgtccaccccgcgccgccgccactccgncgctcctctccgcttccaagatgtcgaagcgaggacgtggaggttctgctggtaacaagttccggatgtcactgggtctaccagtggcagccactgtgaactgtgctgataacactggagccaagaacctttacatcatttctgtgaagggaatcaaggggcgccttaacaggcttccttctgcctgtgttggtgacatggttatggcaactgtgaagaaagggaaagcctgaccttaggaagaaggtgatgccagctgtcattgtgaggcagcgcaagccatggcgccgaaaggatggtgtctacatgtactttgaagacaatgctggagtga

SEQ ID NO: 2959 - DNA, 372 bp, Zea mays
  Clone ID: LIB3228-007-P1-K1-G10
aacaccgcaccacactacccagcggaatccgcccacccgcacccggagcagaggagatatgtcgcaggggaagggaggagcgtcgaggaaggaggaggtggtcaccagggagtacaccatcaacctccacaagcgcctccacggctgcacattcaagaagaaggcacccaacgccatcaaggagatcaggaagtttgcacagaaggccatgggcaccacggacgtcaggatcgatgtgaagctcaacaagcacatctggagcagcgggatcaggagcgtgccgcggagggttcgtgtgaggatcgcccgcaagaggaacgatgaggaggatgccaaggaggaactctactcccttgtcaccgtcgcggagat

SEQ ID NO: 2960 - DNA, 308 bp, Zea mays
  Clone ID: LIB3228-007-P1-K1-G11
gacacgcgtggggatgaagcgtggtgattgggaacaactcaatggatatatacgggctttagatgcaggcgctgtaacatcactgtactctggtgctgaaggcactagatgaactggcatggatatatataagctcatctcacgatgcctttacaccagcactcatgcaaggactttctgcttaccacgattgggaaagagcaccctttatcagaaaaaaagtaagggccggctgctttagatgatcaaggctatctggcgcaggcacatcaggactctatcctgtatcgatgcaggtaaggtcaact

SEQ ID NO: 2961 - DNA, 181 bp, Zea mays
  unsure (1)..(181): unsure at all n locations; Clone ID: LIB3228-007-P1-K1-G12
gggagagagactcggtcaccttgtaaacaaaacaaacctttgatgtctcccgttttccctccatggggttctgaaaatacaacatcctggggcttattgaatgngaaaaaaaaaaaaaaaaaaaaaaaaaaaaaaaaaaaaaggggggcgctttaaaagaaccaaacttacgtacgcgtgc

SEQ ID NO: 2962 - DNA, 421 bp, Zea mays
  Clone ID: LIB3228-007-P1-K1-G3
cggcctcttgggcagtctcgcgtacggacgccttcttccggtgactcgcctcacgcctgggccagcccctgctggcgggggcgcattcttttccatatccatgcctactcgcgcgtgctggcgatttacaaatttttgcttcgtggcgccactccttgatccatggccactggccctcaaccgctcggcgcgtgactactctgtcataccccgcgtgattcgcttgcagcacagtctcgtctgggcactttgcgtgatcgccaagaggcctgtacacatgctccttctcaacagctgaccgagctgcatggtaaatgagacgcgccctgtggctcagcactaatcgcatccttggcgatggttacccgcagtgtgacacgtacctttgcctcctctctacggcccgatcgtttccctattt

SEQ ID NO: 2963 - DNA, 378 bp, Zea mays
  Clone ID: LIB3228-007-P1-K1-G4
cgtccgaatcccggtcgccacgcgtccgcttccaacatggaatcccaggaggaaggtggtctttggtggcttttttttggggctcggtctgcatgcagaatacgctctaaccaaggggggctataacaactcctttaattccattctgcaaagcggggatgtgcaaggcggagtgttggacgggggctaagttaactgggggcaaagtcacgcaacagaaagtgcatgagaggtgggatcaagggctggtgttactgcgaattctgcatttaattttgcaaaggagaaggatcaccatttctttgcttggtcttgccttggtcaataacttagtgtaataatgctagttaagtctttaggcagactaagctagatcga

SEQ ID NO: 2964 - DNA, 412 bp, Zea mays
  Clone ID: LIB3228-007-P1-K1-G5
acatcacagacaatgaataccaagaagaatgttgttctttgctgccttcttttcgtgcgggttctgcatgcagatcacgctctagccaagtgtggctatacaactcctttaattccattctgcaaagcgtggatgtgcaaggcggagtgttggacggaggctaagttaactggaggcaaagtcacgcaacagaagtgcatgagaggtgggatcaagggctggtgttactgcgaattctgcatttaattttgcaaaggagaaggatcaccatttctttgcttggtcttgccttggtcaataacttagtgtaataatgctagttaagtctctaggcagactaggctagatcgagttgtttgttgttggtagctaggcattgctagcgtctgctattgttttaagatattttatt

SEQ ID NO: 2965 - DNA, 369 bp, Zea mays
  Clone ID: LIB3228-007-P1-K1-G6
tatcaagaaggcccgtggcctagatcaatggcccacattgcacttggtggatgcgttggcttaccatctccccaagtgggagagtggacgtcataatttgtgaagtgggagagtggacgtcataatttgtggtagatggggtacgcgacgcagttcaggtctcgggttgctgcttcttgatcagttcagatctcggtttgctgcttcttgatccagatcagggtttctgatccatatagtctgtactttgttacaaaaatcatgtaatttttaaactttttcccatatctgggttcctgatttatgaagtctacagttcaattcacaatttgatctacgaaaagcagcttctttagcagcattacggac

SEQ ID NO: 2966 - DNA, 282 bp, Zea mays
  Clone ID: LIB3228-007-P1-K1-G7
ctcgcaaggcggcttcaaacacttggccatgccagccttgaagacaagtgtttgaagccgtcttgcgaggaagctcttagcgagtagggcaaaaacacttctgttcaaggctggcatggccaaaatcattcaccatgctcgtgtcttgatcaagcacaggtatatgatggttggtagtcaattagttcacatcccatcattcatgttgaggatccagatcaggaagtacattgactatttactgtcaatttcattcaaaaagatggtcctctttaaaggttt

SEQ ID NO: 2967 - DNA, 341 bp, Zea mays
  Clone ID: LIB3228-007-P1-K1-G8
atcggagggcgcccttttttttttttttttgaaggaacggcgatcatttctcccaatatataaaaataacgaatccattctcttgacatggtagttaagagtcacaggtaactctgaacgaaaatgcaaaattaacccaggtactacaaaggtggctttggtgaggtctcagaatgacacttcgttccttttcagcgtttgccaccgccgccgcccaacttggggcccttggaacccttctggacagcgcccttcgtctgcgccttctgggacttggacacctcagccttcttcgccttcttctcatccttggtcttcttaatgcgctccttgatctcacg

SEQ ID NO: 2968 - DNA, 354 bp, Zea mays
  Clone ID: LIB3228-007-P1-K1-G9
gcgtacccggagatcgtgacgtgcgcgaacaagttctgggcgccgacggcgaagccggcgctggcagcggagccctgcacggggcagctgaacccgctgaaccccaagacgtaccgcgtggcggaggacgtgctgcgcgacctggcggccttgttcccggacccgtacctccacgcgggcgccgacgaggtgaacacggcgtgctgggaggacgaccccgtggtgcggggcttcctggcggacggcggctcccacgaccgcctgctggagctgttcgtgaacgcgacgcggccgttcctagtccacgagctgaaccgcacgtcggtgtactgggaggacgtcctcctggggccc

SEQ ID NO: 2969 - DNA, 266 bp, Zea mays
  Clone ID: LIB3228-007-P1-K1-H1
accggccgtcgagcgaggcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcatgcggttccgtcg

SEQ ID NO: 2970 - DNA, 73 bp, Zea mays
  Clone ID: LIB3228-007-P1-K1-H10
aaaaaaaaaaaaaaaaaaaaaaaaaaaaaaaaaaaaaaaaaaaaaaaaaaaaaaaaaaaaaaaaaaaaaaaaa

SEQ ID NO: 2971 - DNA, 238 bp, Zea mays
  Clone ID: LIB3228-007-P1-K1-H11
gtgactgctcatcatggtaggaggccccgaccgaccgtgcaaccgtgtgccgacgctgtggctgtgcgccaatgaaatcacgtgaggtcgtgagtcatctgaggatcatcctggtaactggaatctcaagtcccaggtcaagaacaggtaccgcaggatgaggcgcatgaaggatgctgtgatgtgttcgtgagagatctaggtcgtcgtctcccagtcaactttgggttgctggacc

SEQ ID NO: 2972 - DNA, 413 bp, Zea mays
  unsure (1)..(413): unsure at all n locations; Clone ID: LIB3228-007-P1-K1-H12
gcggcgtcgtagaatccgcaggcgcgcgcacgcttcaaccactgnctggagcagtacggcggcgccgccgacctcctccgcgacgcgctggacaacctcaaggccaagatctacggcaaggccatggagcagctgaccgcggcgatgggcgcctccgagagctgcgaggacgcgtggaagggcgaggaagatgtccccgtcgccgcgcacgacagggagtacgggcggatggcgcacatcgccttcggattcacacaccacgccgncgncgncgcatgaatcatcatgtcatatgcatgcatcgcttctcttccttgtcgcattaattttcatgcgtccaatgattcatatctctatatgcatatctctctgctctgccttgttggctggctcttctcatcattccctagcag

SEQ ID NO: 2973 - DNA, 325 bp, Zea mays
  Clone ID: LIB3228-007-P1-K1-H2
ggacgagtgtccgaactccacccaataactaataacatctggtggggcgccaggttccttggaccactatatccaggagcgacgaaatgatccacccgccagccatggagatgaagaaggtcctttgcgccgccctcgtcgccgccgccttggccaccgtcgtgctggccttggtcgtctccgaggcgccctccgtggtgcctgcctattttatcttaattgtttttatctattttttcttaattgttattgttttttttatttttcacttttatttttaattcttgatgtagtctttttattaaggttttctatttgtatataa

SEQ ID NO: 2974 - DNA, 314 bp, Zea mays
  Clone ID: LIB3228-007-P1-K1-H3
cacgaggtgaagccggtgccgagggtggacagcaagggcgaggtgtgcggcacgacgtacacggtcgacgcaaccgccaggaaggagaccagcatcccaagggtcggcagcgccgccgattggtcttcgcagtactaaaattcgttatctttctctgtgtgtgttgaacgggttcgagcgcaggtagcaggtgacacgggcgtgggccgtgtttgttcgtatggaaaccgtgtctggtgtttgttcgtatgatttccgttgctgctttgctgcacgcctgtactgtgacaagaattactgcctttgctatcagg

SEQ ID NO: 2975 - DNA, 411 bp, Zea mays
  Clone ID: LIB3228-007-P1-K1-H4
cccacgcgtacggatcgagctttcgttatcctcctcgatcttaattacaggtcatagctgagcaggtctgacaggatgtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgaccccc

SEQ ID NO: 2976 - DNA, 416 bp, Zea mays
  unsure (1)..(416): unsure at all n locations; Clone ID: LIB3228-007-P1-K1-H6
cgtccgggccccgcccccgtcgtggaagcccgccaagtccggcggtggcaagcagaagaagaagaagtggagcaagggaaagctaaaggagaaggtgaacaacgcggtgctgttcgaccaggctacctacgacaagctgctctctgaggtgcccaagtacaagcagatcaccccctccatcctatccgagcgcctcaggatcaatggctccctggctcggagggctatcaaggacctgatggcgcgtggcctcatccggttggtctcggttcactcaagccagcagatctacaccagggcaacaaatacctaaggatgggattcccttgtttgccctctctgtaggagctcgtcttctttagaacagttgccatctctgtcaagagtttgctaatgctatgttagatgagtntctc

SEQ ID NO: 2977 - DNA, 220 bp, Zea mays
  Clone ID: LIB3228-007-P1-K1-H7
aagtagaaaaggagctgaattgagtgaattgttgcttcatctgcccccgtgatgcctctcgaattgggactgggagctcgtgacttacagcacttgccacgaatgggaaaccctctgctccaaaggaagcagttcaagcaaaaaaaaaaaaaaaaaaaaaaaaaaaaaaaaaaaaaaaaaaaaaaaaaaaaaaaaaaaagaaaaaaaaaaataaaagggc

SEQ ID NO: 2978 - DNA, 194 bp, Zea mays
  Clone ID: LIB3228-007-P1-K1-H8
aagtagaaaaggagctgaattgagtgaattgttgcttcatctgcccccgtgatgcctctcgaattgggactgggagctcgtgacttacagcacttgccacgaatgggaaaccctctgctccaaaggaagcagttcaagcaaaaaaaaaaaaaaaaaaaaaaaaaaaaaaaaataaaaaaaaaaaagaataaaaa

SEQ ID NO: 2979 - DNA, 64 bp, Zea mays
  Clone ID: LIB3228-008-P1-K1-A1
cggacgcgtataaggacgcgaggagtgatacaagggaaaccctcaatgcggtggaggctcccta

SEQ ID NO: 2980 - DNA, 101 bp, Zea mays
  Clone ID: LIB3228-008-P1-K1-A10
gggggaccatcaatcatcgtaaacaagtcagaattctaccgagcttgaattattgtgaaggttgttcattttacagagcgctatacaggcgaccgaatatt

SEQ ID NO: 2981 - DNA, 102 bp, Zea mays
  Clone ID: LIB3228-008-P1-K1-A11
agaataattttactaatcaaattcttgttgggatatattcctccaattcccctcctcctcccaacaaggcaacaacaattgttccggccgccaaacaaaacc

SEQ ID NO: 2982 - DNA, 236 bp, Zea mays
  Clone ID: LIB3228-008-P1-K1-A12
gccggtccggaactttccgggcgggccaaccgacccgtcctgttatgatggcgcgcacctagcaaggtatgttagctcatatatatatgaagatacgtacctgggcagtcacattcttgtccactcaaaaagtgattcttgattgatggcatgcattaggttctggcgaagctctttaattatcaaatatttgctgactggttgatggaaacatagaaatttattatatacatatt

SEQ ID NO: 2983 - DNA, 333 bp, Zea mays
  Clone ID: LIB3228-008-P1-K1-A2
ggagacgcgccgggagaagggggaagagacgcggcgaccatgtctccgatctgggtgttcgggtacggctcgctgatctggacccaggcttcgcctacgacgaccgcgtcgtcggctttgtcagggactaccgccgcgtcttctaccaagggagcacggaccacaggggcacgccgcagtttcccgggaggaccgtcacgctcgagcaccagcccggagcgacttgctggggagttgcttacagaataaaggaggcagataaggggatagctttggagtatcttgaggtcagggagaagcaataggatgagaagggttaccttgacttggata

SEQ ID NO: 2984 - DNA, 337 bp, Zea mays
  Clone ID: LIB3228-008-P1-K1-A4
ggaaaccttgccatgcttgctgagcgcttcctgcacgaggtggcatttaagctctggaaagcgcctaaatatggggcttgagggggtatccagcgttgactgacttggcgtcgcggataaataatcgaagcaccagatgagttgtcgctttgtaacggaaatgacttgagtgatgccggacactgtggcgtgtgagctttttatgtgaagtgttacgtggacaggccctgatgcgataatactgtttgacatcgttactggttcagccaatgagaacctggagcaaaacaatatgaagttttcttatggtagcttggaattggatggggttacatgc

SEQ ID NO: 2985 - DNA, 408 bp, Zea mays
  Clone ID: LIB3228-008-P1-K1-A6
cggacgcgtggggccgcaccaggcccatcttctgatggcacctccagcgccccagcaccatcgtccggcgacgattctgattcgacgacgatgggtcagcttgagcctgaccgatgacgcgggtttgggttaccggtgccactcaaaatacgatcccttttattgtaaaagagggatcccttctttgcattgcattcttgcaatccggttcttcttgactatgtttcttcttgactatagaacgataataacatgagaaaattatctgaatgacattatattttttctaaaagaaaaaaattcattaaaagattgcttcattcttgcgttactacatatataaatagggcgggtcgctctataggatccaagcttacttacgcgggcatgtgacgtgttagctttttt

SEQ ID NO: 2986 - DNA, 238 bp, Zea mays
  Clone ID: LIB3228-008-P1-K1-A7
aaagaaacaggcacacaagaacaaatacctcgccaccaacaatggcctgcaggtcctccatcctacttgcaacggcgtgctggttgcgctgtttgcggttggtttgtgcaccaccccgctcaccttccaggttggcaagggatccaagcctggccacctgatcctcacccccaatgttgcaaccatatctgacgtggagatcaaagagcacgggggcgatgacttctcccttacgctc

SEQ ID NO: 2987 - DNA, 316 bp, Zea mays
  Clone ID: LIB3228-008-P1-K1-B1
accaaaggtagactcatttcgtcatgagtatagctcaatggcatgcacagtcgaatttgttgatttgtgcgagcagctatgatcacataaatcgttatggtagtgcacacacagactgcatcatcacaactgatagaagtgctgctgaggcctttctgcagcaagttgatagagccgctgtgtttcataatgcaagcacaagggtttgtgatgggacgcgtcttgggctaggtgctgaggttggcataagttcatagcgctttcattcccttggacctggtggaattgatggctttttaatcttggttcatttttt

SEQ ID NO: 2988 - DNA, 398 bp, Zea mays
  Clone ID: LIB3228-008-P1-K1-B12
cccacgcgtccggcaagtacggctccaaggtcaccttccaccttgaaaaggggtgcggccccaactacctggcgttgctatcaagtacgtcgacggcgacggtgacattgtggcggtggacgtcaaggaaaagggctccgacacgtacgagcccctcaagcactcctggggcgccatctggaggaaggacagcgacaaaccgcttaagggacccctcaccgtccgcctcactaccgagggaggcaccaagaccgtctacgacgatgtcatccctgccaactggaaggccaacaccggctacaccgccaaataattaactttagtgctgacaatactttaagtcgggctatgctagctatactagattggggtggattccaagcaatgcattacacatg

SEQ ID NO: 2989 - DNA, 256 bp, Zea mays
  Clone ID: LIB3228-008-P1-K1-B2
gccacttcagagcttgcgatcgcgtcggccacgatctcttgcgaaaaagcttagcctgggtctgtctgtacgaccggcagtcgtctaacaattgatttccatgacgacctccccgcgcgtgtggctgctcgccatggcactggcgctcgcctgcgtgctgctcgtgaggtccgccgacactgctgtcgaggcgtccccgactccaggcgggtccacctacgggtgcaacccggccacggacaaatcgtgcaaaccc

SEQ ID NO: 2990 - DNA, 196 bp, Zea mays
  Clone ID: LIB3228-008-P1-K1-B3
cggacagcgtgggcggacgcgtgggtttttttttttttttttttttttttttttttttgggttttttttaagagatttataactctttttttttttctttttcatttttttttctttctttttttattcttttttctttttttgtggctccttttactaattttttattcctctatccctttattttttttttgtt

SEQ ID NO: 2991 - DNA, 260 bp, Zea mays
  Clone ID: LIB3228-008-P1-K1-B4
gtcatgttatgatgtagcgcacctagcaaggtattttgacacacataaatctgaacatatgtacctgtacagccatattctcgtccacttgaaatgagtttcttgattgatggcagcattgtctctggtgaatctttccaattatcaaatatctgctgactgcttgaaggaaacatataaattaatcatatacatgttgtactgttgacttccccctagtgccaattgctaatctagtaagagatttacttgaggctgaa

SEQ ID NO: 2992 - DNA, 405 bp, Zea mays
  Clone ID: LIB3228-008-P1-K1-B5
ccaaggatcctgagcctcaacaacaacccatacttctccggaccatacggggaggacgtcgtgttcgtctgcaacgactggcacccggccctctctcgtgctacctcaagagcaactaccagtcccacggcatctacagggacgcaaagaccgctttctgcatccacaacatctcctaccagggccggttcgccttctccgactacccggagctgaacctcccggagagattcaagtcagccttcgatttcatcgacggctacgagaagcccgtggaaggccggaagatcaactggatgaaggccgggatcctcgaggccgacagggtgctcaccgtcagcccctactacgccgaggagctcatcttcggcatcgccaggggctgggagctcgacaacatcatgc

SEQ ID NO: 2993 - DNA, 341 bp, Zea mays
  Clone ID: LIB3228-008-P1-K1-B6
aaaaaaaaaaaaaaaaaaaaaaaaaaaaaaaaaaaaaaaaaaaaaacctttcaaaaggggagaggaacccaataaaaaaaaaaaaaaaaataaaaaaaaaaaaaaaaaaaaaaaaaaaaaaaaaaatgggggggccctttttaaagatccaaatttttttaccccttctttccaaattttttttttttttttttggcccccaaattaaatttacttgcccgggtttttaaacggcgggatcggaaaaacctcggggttccccaaatttattgtcttggaaaaattccccctttttgtcggtggttttaaataaaaaaagcccccaacaaattctctttttc

SEQ ID NO: 2994 - DNA, 307 bp, Zea mays
  Clone ID: LIB3228-008-P1-K1-B7
cccacgcgtccggcggcatttcgaataacacaggtgagcgcgacgatgggatccctcgctaataacatcatggtcgaggcgccgtccttgcggcgctcgtcgccggcgggtcgtgcgggcccccgaaggtgccacccggccccaacatcaccaccaactacaacggcaagtggctcaccgctagggccacctggtacggtcagcccaacggtgccggcgctcctgacaacggcggtgcgtgcgggatcaagaacgtgaacctgccaccctacagcggcatgacggcgtgcggcaacgtccccatctt

SEQ ID NO: 2995 - DNA, 303 bp, Zea mays
  Clone ID: LIB3228-008-P1-K1-B8
cggacgcgtgggggctatgaagatgggcaaagaaaagaaaaaagagaaagttgagctactcaagaagagaaaaaagacgctgattctggcgcttcttccaagaagcggcactgatgtgtcacaaatcttcatcgcattggtgtggcatctctagtagaaatgttaccatgatcagctcatctgcgtgccaatccctaatgatgggttggttgccttttgatatctgctatgtatgcttaagatgagctcaaggatatgtaacatgaaacttgaatagaaaagttttgatctgtcttacgaagc

SEQ ID NO: 2996 - DNA, 248 bp, Zea mays
  Clone ID: LIB3228-008-P1-K1-C1
aaagaaacaggcacacaagaacaaatacctcgccaccaacaatggcctccaggtcctccatcctacttgcaacggcgatgctgttgcgctgtttgcggttggtttgtgcaccaccccgctcacctctcaggttggcaagggatccaagcctgaccacctgatcctcacccccaatgttgcaaccatatctgacgtggtgatcaaagagcacgggggcgatgacttcttctttacgctctaggagggcc

SEQ ID NO: 2997 - DNA, 72 bp, Zea mays
  Clone ID: LIB3228-008-P1-K1-C12
cccacgcgttcgtggacacatgttcggtcgcgtggtttgactcatttttttggaggtgagcttccttttttt

SEQ ID NO: 2998 - DNA, 96 bp, Zea mays
  Clone ID: LIB3228-008-P1-K1-C2
cccacgcgtccgaagaagatcgcctagcgccgtcctcgtcgccgcctcggcggacaccagtggcgctcgccgcggagacttctgtacgacccccac

SEQ ID NO: 2999 - DNA, 302 bp, Zea mays
  Clone ID: LIB3228-008-P1-K1-C3
ggacaacaccatcaggtacaacgccaagcgcaggcactggcgccgcaccaagctcggcttctgagcgcgcggatcggccggccctgcgtcggaattctagggtctctacctttcctttggttttatcgatgtctcttgtgtttctgtaagctagcaaacggttccagaaagcttttgttaagattttgatgacgctaagaggattgatgctactatgctgtactcaggattccatgctgcattgcgatgctaaattaaagaacctctgctaccttactttatgtgtagagttgcaatgattg

SEQ ID NO: 3000 - DNA, 347 bp, Zea mays
  Clone ID: LIB3228-008-P1-K1-C4
ggatatggctccgacaagaagaccaggcactaccttcccaacaagttcaaaaaggttgttgttcacaatgtctccgagctggagtgctgctgatgcacaacaggacttactgcgctgagattgcccacaacgtgtccacccgcaagcgcaaggagattgtcgagcgtgctgcgcaaatggacatcgtggtcaccaacaagcttgccaggctccgcagccaagaggacgagtgaaatgttgggtagttttgattgtgctctgctggtgttgaagatgttactgagattgatgttcttctgtaccatttctatgcttatgatagacttttcatatggacaaaaatatgc

SEQ ID NO: 3001 - DNA, 384 bp, Zea mays
  Clone ID: LIB3228-008-P1-K1-C5
cccacgcgtccgccttcttcgctttccccatgccccattcctgctgctagcataatccatgcaccgtcgcttgccaaccatcgtgctgggccaattcgacgccgtcgagcctccctcgctgccagcaacagcttacccagcatctcctcgcctctgttctactcgcctgccgctgctcgctgtcgtcgccgtcattgctgctgcatcgcttgacgtcgccggtgctccccaccgaagagcctcgtcgcattcctacacgttcttctccgcgcctgctgctgccgtcgcgccatcgccacacctaacaccgtcatcatcacgagaaagatccgtccctgcgcctagcttggccgcaccgctaaaaccggcgatccgctccatgta

SEQ ID NO: 3002 - DNA, 392 bp, Zea mays
  Clone ID: LIB3228-008-P1-K1-C6
cccacgcgtccgcccacgcgtccggccccacacacacaaaagcaaaaagcatcatcacaataatggcccgcgcgtgtgtgttcctgtggtgctcctcctggccgccgtcgcggtggcgccgtttgcgggggctgcgcgtgtggatgtcgtggagggcaggtccatggcgtccgccgacgcgcctgaggcggcggctgacgcgcccgctcccggtcccgactccgtctcattcccggactcgccgtcggaggcgccctccagcagcagttcatccgactagccgcgcacaacgcagtttttgtcatgatctatctagcaaataaaaagatcatatgtctcgtgagattctctggaataactaatagtatatttgctgcgcccggatgattttt

SEQ ID NO: 3003 - DNA, 306 bp, Zea mays
  Clone ID: LIB3228-008-P1-K1-C7
cggacgcgtgggctacttcaagaggctgcctcatccggggcagcgtcgacttcatcttcggcttcggccgcagcttctcgaggactgccgcatcgagtcggtggtcaaggaggtggcggtgctgacggcgcagcagcgttccaagtccatcgagggcgccatcgacaccggcttctcgttcaagaactgcagcatcggcggcgtcaagggcggacagatctacctgggccgcgcctggggggactcctcccgggtggtctactcgtacaccaaaatgggggaggaggtggtccccgtgggctggga

SEQ ID NO: 3004 - DNA, 373 bp, Zea mays
  Clone ID: LIB3228-008-P1-K1-C8
cggacgcgtgggcgccgccggcgccgccgttttgtcgtctccgccgcatcgtgggctccgccgcagcgatgccgtcgacaagaccttccggatcaagaagaagctggcgaagaagatgcgccagaaccgccccatcccctactggatccgcatgcgcacggacaacaccatcaggtacaacgccaagcgcaggcactggcgccgcaccaagctcggcttctgagcgcgcggatcggccggctcctgcgttggaattctagggtctctaccttttctttggttttatcgatggctcttgggtttctgtaagctagcaaacgggtccagaaagcttttgttaagattttgatgacgctaagaggattgatgcttc

SEQ ID NO: 3005 - DNA, 374 bp, Zea mays
  Clone ID: LIB3228-008-P1-K1-C9
gcagaaagccgtcctattgtccctagaaagtttgacaaagataggaaattcacaactgataggatgggacgccagcttcatccatgggtatggatcctagtgctgccatgaatagaattcacagtcagtctaggggtcgcaagcgtgagaggtcagtgagcagagctgcagcggatggtgacggtatggagatagatggccagcaaagcaacaagaaattgcgtcggacatcaaagtctaggtctaggtctaggtcacagtgctcctgaagaagtcctttctggagaaagattcaaggactctgagcagaaaaaaaaggctatcaagaaagcaaaggccgctactaggaacaggaacaaagaagcttgtcgtgg

SEQ ID NO: 3006 - DNA, 332 bp, Zea mays
  Clone ID: LIB3228-008-P1-K1-D1
gaagatgatggacatcactaaggatgccttgtggttctgaaaataagaatctgatgaggcagatgagtccatcacacttctttttcttgaaccagactgcacggcatccttgtttatgaacagacatttggccatcaagcgggtggtagttaatcacctagggattttgtccagacaaaagcttattgagatttgacccatgcatttctttaagagcatcatcgaataaaagatgactgcatcagattgctttcttttgttaccgtatggccatcgggtgtgatggacatgtaatattcagtcatggaatggaacagacccatttcttttaa

SEQ ID NO: 3007 - DNA, 343 bp, Zea mays
  Clone ID: LIB3228-008-P1-K1-D10
caaccctactgaatcttatgtgtaattaaaggccaaccttcaaacagcactggattggtgaattgtgttggtacctttttttggagtggatgcgcactaaaccttgtatcagaaaggtgttccagtctcggctaataatttccaaatcgctggagtgtatgctgtgggaggtgctcttgtttaggccctgtttggtttctttagtcactagactaaattttagtgactaaagcttagtcgctaaagtaccatgtttggttccagggactaaaccagactaaagagcgattattgctttgaataatgactggtttacccctattaaattatggatgggtgcttt

SEQ ID NO: 3008 - DNA, 118 bp, Zea mays
  Clone ID: LIB3228-008-P1-K1-D12
aaaaaaaaaaaaaataaaagaaaaaaatataaaaaaaaaataaaaaaaaaaaatagagaaaaaattaaaaaaataaataattggtcaaaaaataataaatattaaaaaattcgataaa

SEQ ID NO: 3009 - DNA, 350 bp, Zea mays
  Clone ID: LIB3228-008-P1-K1-D2
ccagccatctcacacaatggctggagctgttgaaatagttggggcacctggtggtgtggaccagcatccccaagctcacatgattggggaagttactgataggccatgattattgtttctttgactttgggtgtccatgacaacacatttggcagaggtgttcaagttttaacaaaggtgaacttgatcaggagtgtatatatgttctcagcatagctgatctgcagggcgggttattgctttcagaagcttccagattgttgtggttgtatttggaacagataatgggcatggaaattgggtgagcttatttactcaaggtccttaatacaattttaggcttctgggcc

SEQ ID NO: 3010 - DNA, 326 bp, Zea mays
  Clone ID: LIB3228-008-P1-K1-D3
agcaaatcggtctgccctggtttcccccgtcgagaagcagaaacctctctgctggcattaccgtgctgcgcgccgtcacggtaggcttggccacaaccgtggaactgtctccatatggcgtaggcggcgtaccgagcttcgcctgatggatttgcagtccagtgggcccataatttctcgccggaccgcgagcagcaacaacctctcctcgccgggcatgacctctacgcacttcaagctctcctccgaggaccgttatcttcttgcatgtaggcgagtaaaggcacgaggatctgataaatcaccctggattctggaatctcaag

SEQ ID NO: 3011 - DNA, 326 bp, Zea mays
  Clone ID: LIB3228-008-P1-K1-D4
cccacgcgtacgggcggcgcctacattctgcgctgcgccatcggcaactcgctgaccgaggagcggcacgtccgggaggcgtggacgtggtgcaagagcacgccaccgctatcctgtctggcgcgaccgagacggcgcgcacgaacgggctgacggttcgccaggcgcactgtgacacggaggccaatagcagcgacgtgcccacgccccaggaatcttttgctctttggtagacgacggacggcctatgaatctgaaataagaccaatacgtggtgtggcaatcaggaatgccatttagatataagcgggcacatccgctcaaac

SEQ ID NO: 3012 - DNA, 181 bp, Zea mays
  Clone ID: LIB3228-008-P1-K1-D6
ataccattgagaccttcaccaggggcatccctgatgcacggacttacttgaatactcttcaacagctcagaataaagagtggtctatagatcatattggaatcgaacctttgatgatggaagctcttgagaagattgagaaggatattaagaaaccacttttaagggtggccatgttcttc

SEQ ID NO: 3013 - DNA, 260 bp, Zea mays
  Clone ID: LIB3228-008-P1-K1-D7
cgagattctacgcgtggacaaccttgtcatcaccggcaagggaaagctcggcgggcaggggccagccgtgtggagcagaactcctgcgtcaagaagtacgactgcaagatccttcccaactcgctggtgatggacttcgtgaacaacggggaggtgtgcgggatcacgctgctcaacttcaaggtgttccacatgaacatgttcaagtgcaaggacatgctgatcaaggacattaatgtgacagggcccggtgacaggcc

SEQ ID NO: 3014 - DNA, 89 bp, Zea mays
  Clone ID: LIB3228-008-P1-K1-D8
ctgagattcatgcatgctctcgatcgaagcaaagctgttgtatgttgttatggtgtactattctatttttttatttataagttttgatt

SEQ ID NO: 3015 - DNA, 200 bp, Zea mays
  Clone ID: LIB3228-008-P1-K1-D9
cccacgcgtccggcgtttgaatggatttgagaataaggctgagttgttgccattaccgggctgcacacggtcgcgggaggcttgtcacataccgggaactgggtccataatgcgttatgctgatttcctggtaccccccttgctttaaaaaaaaaaaaaaaaaatggcggtcggtctagacgatccaagcttacatactc

SEQ ID NO: 3016 - DNA, 63 bp, Zea mays
  Clone ID: LIB3228-008-P1-K1-E1
cacatatttaaaaaaaaaaaaaaaaaaaaaattaaaaaaaaaaaaaaaaatatatgggggggg

SEQ ID NO: 3017 - DNA, 359 bp, Zea mays
  Clone ID: LIB3228-008-P1-K1-E2
atcaggaaggacttgtatggtaacattgtgctcagaggtggcacgaccatgttccctggtattgcggaccgtatgagcaagggatcactgcccttgcgccgagcagcatgaaaatcaaggtggtggcaccgcctgagaggaaatacagtgtctggataggaggatccatccttgcctccctgagcaccttccaacagatgtggatctcaaaggctgagtatgacgagtcaggacctgggattgttcatcggaagtgcttctaagctcttggtcccccttcggctccattttatttattccttgagtggtttttatataagctactatgtttgggattgcatgccttttgagcaggcaat

SEQ ID NO: 3018 - DNA, 344 bp, Zea mays
  Clone ID: LIB3228-008-P1-K1-E3
cacacgcgggcgatcccagctgagatagggaggtacctgctacgactagctagatggcacgcgcgatggcgcccaccaggatcgtgtagccttgctgagcttggcgctggcggggctgctcatatgtcacctcatcaccaccgtctgcgtcggtgagtacagaatccgcatccttaacagcggcgtcgactcggtcgaagacaacatcagctgcgacgcttagggcgtggacaacagcaccgactccaaggcggtaagccgcgtaggctattccggcatggagctcgctgttgagacgggatctgcgcctggttcggcaccggcgccggagccgacgtccaggt

SEQ ID NO: 3019 - DNA, 333 bp, Zea mays
  Clone ID: LIB3228-008-P1-K1-E4
cgagttcagaagggtgcggtgcaagtaccccgctgggcagaagatcgtgttccacatcgagaagggctgcaaccccaactacctgccgtgctggtgaagtttgtggcggacgatggcgacatcgtgctgatggaaatccaggacaagttgtcggctgagtggaagcccatgaagctctcttggggcgccatctggaggatggtcactgccaaggcgctcaagggccccttctctattcgtctcaccagcgtgtcctgttagaaggtcattggttaagacattattccggcgatctggagtaccctttctcgttacactttcaacgttcaattt

SEQ ID NO: 3020 - DNA, 217 bp, Zea mays
  Clone ID: LIB3228-008-P1-K1-E5
cccacgcgttcgtaaaaaaaaaaaaagaaaaaaataaaatataaaaaattatataaaaagaatataagaaataaaaaaatgggggggcctttagagaatccaagcttacttacgcgggcttgcgacggaatagtttttttatagagtaacctaaatttaattcattggccggggttttaaaacgtctttactgggaaaacctcggggttacccaatt

SEQ ID NO: 3021 - DNA, 354 bp, Zea mays
  Clone ID: LIB3228-008-P1-K1-E6
gtggcgcaaggcggtggtcggaggcggaggacgtgttctacgcgggagtgaagcgccggaaggtggccgaccttggaacggtgcggtgctggtgcgcggtcttaaggacgctggcaaggggcgagcggcaaggcgggtggttgttggtttgtgcaagaagtttcccgagatgttcgacgggccgtggagggagcttgaggtggcggccgggctgaactcctccgggaaggaggatgatgatgttgaagacggagccgtcgagaagcttgcgatgacaagggccaccgtggcgtgagcgttcgtggcaactggggaaattggttttgaaatggaagcgttgcttcatcattcaaa

SEQ ID NO: 3022 - DNA, 330 bp, Zea mays
  Clone ID: LIB3228-008-P1-K1-E8
cacgcagccgctgctctctccacgtcctctgttccttcccctccccgatctccggcaatccgaccaaaccggcagagcagggggcggcgatggcgctgcgacgggcgctcctcagatcggcagagatctctttcgaacgcaaggctgcaattgagtacattcattctttatcaagggcacagcctgctcgttctctcaaaggtgctggcctttgtcctgctagtagatcacttagcacccaagccggcactacgttaagcacaccacagtctccggcttccccacccccttcagagaagactcactttggtgggctcaaagacgagggtc

SEQ ID NO: 3023 - DNA, 387 bp, Zea mays
  Clone ID: LIB3228-008-P1-K1-E9
taggaattttgatgaatcttggattaattgaggagtccaaggtttcaaggccattaccttggaggccagcgactaatgtttccgtgttaaagaggatgttcgacctatattctgggccaacagaccaaagagctatcttaaaaggacattaggttgggatcagtatccccatggacggtggggtgattctcggaacccatcatatggagcacttactgaccaccagttcacaagaccaccaggccgtggttagaagctccaagaggaatgggctgttccactgaaatctgtggaggacattagtgagcgcttcacaaacttctgtcaagggaaactcacaagcagcccatggtcagaattggacggtcttcaaccagagacatagat

SEQ ID NO: 3024 - DNA, 342 bp, Zea mays
  Clone ID: LIB3228-008-P1-K1-F10
cgcgtccggtgggatcgagttgtttcactgcacgagcacatcctccggcgaccaccggcctggcctctccgtcctctagcgaccgaccaagcgccgagcgaagatgtcgtggcagacgtacgtggacgagcacctgatgtgcgagatcgagggccaccacctcacgtcggcggccatcgtcggccacgacggcgccacctgggctcagagcaccgcgttccccgagttcaagcccgaggagatggctgccatcatgaaggatttcgacgagccggggcacctcgccccgaccggcctgatcctgggaggcaccaagtacatgggcattcaaggcgaacctgg

SEQ ID NO: 3025 - DNA, 396 bp, Zea mays
  Clone ID: LIB3228-008-P1-K1-F11
gtcctcgctccatggcgggcatgcccacggaaagcgcgacccggcgcttcgccggcgcgtgcggcgtgctcagccagtacgccggacgaccggcggcgcgcgaggacccttcttcctcttcctggctcgcgctcggcagcatgtgctccatgcacggccgctgatgagggagccagcggtggttattagtagtgcagacaagagctcgggcgccatgggaggcgttgcagcagcaatttatgtgctacctacgtactagtatttattataattgttattactaacaacaacgactggtagtatcgatcagagaccgacgctattcgatccgtggttcgtttcattggcctttccttccttgctagctggtggtgtatcgaccatctaaatctaaca

SEQ ID NO: 3026 - DNA, 181 bp, Zea mays
  Clone ID: LIB3228-008-P1-K1-F2
accacaggtaccttgctgagttcaagtcaggtgcatagaggaaggatgcttcggggaggaccctgaatgcctacaaagctgccaggatattgctcttgctgatctagcttcaacccaccccatcaggctggggcttgctcttaactgctcaatattctactactagatcctgaacttccct

SEQ ID NO: 3027 - DNA, 360 bp, Zea mays
  Clone ID: LIB3228-008-P1-K1-F4
cccacgcgtccgcccacgcgtccgaggagctcaagaacggccgcctcgccatgttttccatgttcggcttcttcgtccaggccatctcaccggcaagggcccgctcgagaacctcgctgaccacatcgctgacccagtcaacaacaacgcatgggcctacgccaccaacttcgtccccagcaactaagctcaacggctatgctatgcaacttcattgtctttcggatcggagagggtgtacgtacgtggattgattgatgctgcgagatgcatgtgtgtctcttgtttcacgttgcattgcataggcaagtcgagatgatgaagtggcggtgtacactaagatgaaccatgtttgtgcaa

SEQ ID NO: 3028 - DNA, 220 bp, Zea mays
  Clone ID: LIB3228-008-P1-K1-F6
cccacgcgtccgcatcgtcaaccgtcacataaaccaactcgatcgatcgcgtgcgacggcgagccgtccgtccgtcatggcggactgctggtgggctccgagcgccgtgtcctcatcagcggctacgggtacggtctttccccgcagtccccgcccccgccgccgtcggcagagagccagctgctcggccgtcttgatcagatcgatctacggctgcggc

SEQ ID NO: 3029 - DNA, 325 bp, Zea mays
  Clone ID: LIB3228-008-P1-K1-F7
acaacggcaagtggctcaccgccagggccacctggtacggtcagcccaacggtgccggcgctcctgacaacggcggtggtgcgggatcaagaacgtgaacctgccaccctacagcggcatgacggcgtgcggcaacgtccccatcttcaaggacggcaagggctgtggctcatgctacgaggtgagatgcaaggaaaaacctgagtgctcgggcaatcctgtcacggtggtcatcacatacatgaactacgagcctatcgttccctaccacttcgacttgagcggcaaggcctttggcttcctggcaaagcccgggctcaacgac

SEQ ID NO: 3030 - DNA, 272 bp, Zea mays
  Clone ID: LIB3228-008-P1-K1-F8
ggagcggatgctccagatgcagaagatccgcgaggcgcaggagaccaaggtcaagggcggcgcctccattggcctcatccggccaccgccaagctcgcctgatacgggtcccagcccgatccgcttgatttaggtctgtttgttggctatagcaacgtccagaggcgttgcgccgtgcaaggatccttaatgttttgtgtgtgaacagagatacgcgtttgaattcggcataaagttaactgtagccttctttttccctgtccccccttctt

SEQ ID NO: 3031 - DNA, 283 bp, Zea mays
  Clone ID: LIB3228-008-P1-K1-F9
tgaggatactccctctgtcacagaaatagtgcacctatggattcacgctggttaaacccttttttaaattgactagattgtagaaaacattagcaatatttgtatctctaaataaatttaatgatactaattacgtacacttcagaagccatgagtctggaaactgggaaaccagcgttcaaagctggagtctgaaagggaacattctatactattacaagcataccaaatctcagcaaccttggtctgttggataccatgacatttctatggttgacctttt

SEQ ID NO: 3032 - DNA, 250 bp, Zea mays
  Clone ID: LIB3228-008-P1-K1-G10
gccacactgccgtgagaaaaacagactagtccgcgttctcctaccaaccgaaataggcgcacatggtgggcgggcgctaggattattccgatcggcgagttcacgctagtggagattgaccgatggcgcggaaccttccacgcacataaagggtctcctctacacgatcttactgttcgccggatgtcatccgaggtgtttcgccattttctgaggtgcgatgatagaaatttgcgggggtcgtttttaa

SEQ ID NO: 3033 - DNA, 112 bp, Zea mays
  unsure (1)..(112): unsure at all n locations; Clone ID: LIB3228-008-P1-K1-G11
agcccacgcgttcgaggacgcataaatcaacacgtggnttattataaaataagagaagagaatattatgaggggagggtctgtgaggcggccgttctagtagatccaagctt

SEQ ID NO: 3034 - DNA, 161 bp, Zea mays
  Clone ID: LIB3228-008-P1-K1-G2
ggctagtgggttgagtacaggatgagcgcaaccggtagtgtgtatatcacgttctttgtactcaagaattttgtacagacagaagcggtgcggatagcatgccttgcatacataataatttcaatacaggttgaaaacttgaaatcaacacaccttgcgac

SEQ ID NO: 3035 - DNA, 267 bp, Zea mays
  Clone ID: LIB3228-008-P1-K1-G3
cccacgcgtccgggggcaggtgaggaccgaaagagacgccaaccaagcaaggagggtgtaatcgaagatagggagcacctgacatgacctttgctggactgctgctctttttatatgaatgaggataagaggattcaatatggttagcagcactattaactttctatttgcacgctgttgtgcaatgttagaacaacttatgcctgctacacagaggtgaatagccacttatttgtaaaattggttagacaaggttcgaatgttcca

SEQ ID NO: 3036 - DNA, 288 bp, Zea mays
  Clone ID: LIB3228-008-P1-K1-G4
tgagttcagaacggggccggacacggtgtcgcaagagctgtacacgacgctgacatccattcagatgggcatggccgccgaggacgcaagggatggacagtagcagtagagtagattaataaggttggggaatgccatcgccacgacattggatcctacatcagtattgtcatccggtagaatgcatactcggttgatcagcatatgtagtgttgcagcaaattgaagaataaaccgtgtgtgttcgatggcgatcaatgacgaggccattgagcagccattgatttg

SEQ ID NO: 3037 - DNA, 216 bp, Zea mays
  Clone ID: LIB3228-008-P1-K1-G5
cggacgcgtgggctgcactagtatatagtttaatcttttggtgtctaaaaaaaaaaaaaaaaaaaaaaaaaaaaaaaaaaaaaaaaaaaaaaaaaaaaaaaaaaaaaaaaaaaaaaaattaaataaaaaaagggggggccgctttaaagaatccaagattacttacgcgtgcatgcaacgttatagcttttttatagggtcacctaaattaaattt

SEQ ID NO: 3038 - DNA, 396 bp, Zea mays
  Clone ID: LIB3228-008-P1-K1-G6
agcgactcctggccgcaggaccagatcatgcagatcaccgtcgccttcaaccacttcggcaggggcctggtgcagcggatgccaagtgccgctggggcttcttccacgttgtcaacaacgactacacgcactggctcatgtacgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatgaacggcgccatctttaatccgtccggcggcgcccccaagcaggtcgacaccaacgagtgggtaaagcccaagccaggaacctacgttacaagggtaaccc

SEQ ID NO: 3039 - DNA, 265 bp, Zea mays
  Clone ID: LIB3228-008-P1-K1-G8
gctggcagcactacaggcagaaatggctatgtaaatataggcattggcatggtcatcttggatttcagattctgcggtatctcgcaactctggtatactcatgaggatcttcctaggaagacaagctttttcagaatcacaaacacaagctgcataccagcctaactgcttatgtatcatagcatgctatgttattgttttgtaatgaaatattttataggctaataaacatatttctattaataaattggttcgtgtcagtatt

SEQ ID NO: 3040 - DNA, 350 bp, Zea mays
  Clone ID: LIB3228-008-P1-K1-H1
cggacgcgtgggcggacgcgtgggtgtgactattgtgtgcgtgagagagaaacagaagaggaaaaggaatccatggcggcgacctggcgaggagggcggggcgctccgcggcgacgacgctatggggcgcggcgaggggcttcgcatcggtggggtccgacatcgtctctgcggctcccggcgtgtcgctgcagaaggcgcggtcctgggacgagggcgtcgccaccaagttctctaccacgcctctcaaggacatcttctacgggaagaaggtggtcatcttcggcttgcccggtgcatatacaggggtttgttcacaagcccacgttcctagttacaagaagaatatt

SEQ ID NO: 3041 - DNA, 416 bp, Zea mays
  Clone ID: LIB3228-008-P1-K1-H10
ccacgcgtccgcgcatacgcacccaggagatacagcgagcgagcgaccaaagccatggctctccgcaccctggcatcgaagaaggtcctatcttcccgttcggcggcgcgggccggccgttggcggcggcggcgtctgcgaggggggtgacgacggtcacactccccgacctctcctacgacttcggcgcgctggaaccggccatctcgggggagatcatgcgcttgcaccaccaaaagcaccacgccacctacgtggccaactacaacaaggcgctggagcagcttgacactgccggctccaaaggcgacgcctccgctgtcgtccagttgcagggcgccatcaagttcaacggcggggggcatgtgaaccattcaatcttctggaagaacctcaagcccattttcgaagggggg

SEQ ID NO: 3042 - DNA, 307 bp, Zea mays
  Clone ID: LIB3228-008-P1-K1-H12
attgagtcaagttcccacacagaccatgcatcctcaagtttgatcaggccccagcctttggtccttggaaatggtgttcagaaagcaaaggcacttcatttaaattatttgggattccccttggcagcccagaaaaatctgaacctctggtatccccaccaagtgtcgcatatgacgggaaacttcaaacttctccatcagaaaaagggaatcagctagacgtagttgaaggggataattgttctcatccttctaagactgtgaagccactcgatggtcctcagtcagattctattacagagaataa

SEQ ID NO: 3043 - DNA, 395 bp, Zea mays
  Clone ID: LIB3228-008-P1-K1-H2
gtccgatcgacgaaagctatagccagctagtaacaagagcaaaaacaccatcatctcatgcgcccgtctcaacgccaccccaatggccagagcacgaggatggtggcgctggccctggtggtcctcctggtggcggcgacggcgtcggtgcccacggccaccgcgtacggctgctacgacgactgctacgagcggtgcgccaacggcaagaaggacgaccccgcctgcaccaagatgtgcaaccaggcgtgcggcagcaccgacaagggcgccgtcggcggtgcgccggtttgatcgacccgggcttcatcggcgcgcgggctcaactcgatatcagcatcatatacaattgctgcttcggcggttacgtaaacccatgcatgatctttttaccc

SEQ ID NO: 3044 - DNA, 361 bp, Zea mays
  Clone ID: LIB3228-008-P1-K1-H3
gagaaaccattaataagcatgtttgctttgtgaccctagaaaccagctaggcacaagcagcacctcggccccctcctcggcgaacgtctactttctcgaggcgtacagtgaccgctcacctctcgggcgtgcctagctcgtcatcggtctccaatgccacgttcgtgctactactccaatcgttgctgacccgtgtgatctccactgacttccgcaaggagtgcgggcaccttcggtcccatccgatgttaaggcttacctcgcttatggtgttccacagagtgacatgaaactgtaatcacttatgcaaaagttgctagaccagcggctagagcatgtacatatggcgctttttacatac

SEQ ID NO: 3045 - DNA, 331 bp, Zea mays
  Clone ID: LIB3228-008-P1-K1-H4
atcatcttctccgatccatcaacaatcgccgagagcgatcgagagatatataaagatgaagaaagtggcatcatcgtcagccgttctttcgtgctagccctgacgctagtttgtgccccgctgattgcagaggcaaagaagaagagagtcgccgccgccgccgccgaggagaagaaggtgcaggacaacttctgctcgacgctgtgcgagggcaggaaggggatggacctggtggtgtgcaaggaatcctgcgacctctcacagcgctccaacctgttgctgtacgggcggatccagtgcaagggcaagtgcaccgagcagaaaggcatca

SEQ ID NO: 3046 - DNA, 250 bp, Zea mays
  Clone ID: LIB3228-008-P1-K1-H6
tcgccgagctagcagagaggcatgtttgcgttcttctgaatgttgtgcgcgtgtctgtggcagcataagtagagagtatgttgatgatgtgatgacgacgacgatcatttcgcggcggggaggttagaagtggccgggcgccaatttccgtcctagtttgggcgtttggcctatagccgagccggcaggctcgttcttcagttcttggatcatgggaagaacttctgccgggctggcttgttcgtttttt

SEQ ID NO: 3047 - DNA, 123 bp, Zea mays
  Clone ID: LIB3228-008-P1-K1-H7
tatggatgggtcgagtagtactatgtctttgggttcctcttcgtcgtcttgctgctgctgggtattggctgtgctgaagttccctggttctaacttacatgcacctgtgtgttgaggattgga

SEQ ID NO: 3048 - DNA, 164 bp, Zea mays
  Clone ID: LIB3228-008-P1-K1-H9
gagggttaggcttctcctccccctccggttcgggttcgggttcgtgaggttctccgggagccgaattcgtgggtgagcgatcgagatggcggcgtctgactgttgagtaccgctgcttcattggcggcctcacctgggccacggacgaccactccctctacatc

SEQ ID NO: 3049 - DNA, 339 bp, Zea mays
  Clone ID: LIB3228-009-P1-K1-A1
gcctcctggtgaccttctcctcgatctccagagtcggggcgatgctcgccgcgtgcgtgggcgtgtcggccggcggtgacggcgtgcctgtgggccggggccgcgtccggttcgagttcatggacgatgaagaccccgggcctgacctggacgacctcttgcggcacctcgcgaaggacggcccgccggcgtttgccgagctgctggagcggcaggcggacgccgggcggcctgtggcgtgcgtggtggtaaacccgttcatgccaacagctgtcgacgcggactgccgcaccgggatccctttggcggtgctgttggtgcagtcgtgcgcggtgtttt

SEQ ID NO: 3050 - DNA, 283 bp, Zea mays
  Clone ID: LIB3228-009-P1-K1-A10
cccacgcgtccgcccacgcgtccgcccacgcgtccgggtgaaccagcagcctccaataaaagccagcacatccaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggccttcaccgaggccgccgccgccggcgccccagccgtcttcgagtcgttggtgttccgtcgaagccc

SEQ ID NO: 3051 - DNA, 410 bp, Zea mays
  Clone ID: LIB3228-009-P1-K1-A11
cccacgcgtccgggtgaagcagcaggatgggtcggaaggccggtgctttgtacataaacccaaagaagtttggtgctatggcgaagccctgcatgccagaaatggtggccttcctcaactgtctggccttaaacaaacagaacgatgacaagtgtatcaagcagaaagatcttttggttgcatgctctcaggctcagaatgggaggccaaagaacgcagccaagaccatcaattaccatctccagcgacttgggcgaggcaagttcctctagtcgctgtgtgagatcatttcctcatccagctttatgccttgtaccgaagtagaattgctgaaatggggcattaatgtgtttgcttagattggacaatggtcagcaaataattttatgtcaaacagtaatgtatgagca

SEQ ID NO: 3052 - DNA, 231 bp, Zea mays
  Clone ID: LIB3228-009-P1-K1-A2
cgatataatagacacgtgtgatcatccgttgatccatcttgctaataaccctgcgtgcccttggttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgtgcccaccagcgcctactaggttg

SEQ ID NO: 3053 - DNA, 418 bp, Zea mays
  Clone ID: LIB3228-009-P1-K1-A3
gtggaatgaaaactttatcttcactcaggggtagttccttttccagttgcaatactgctcttctgctcctgtgaacggcactacccctgagtggaatgaaaactttatcttcactgtgtctgaccggacaacagacttggtaatcaagattatggacagtgatacaggcacagcagatgactttgttggtgaagcaacgattccattggaagcagtgtatactgaaaggagcattccaccaacactctataatgttgtgaaaggtgaaaaatactgcggggaaatcaaagttggtctcacattcactcctgaggatactcgccagcggggtctcccagaggacttcggtggatggaagcaatcatcttagagctagatgctttaagggtgcaccagagcacagcgacaattcatgcgc

SEQ ID NO: 3054 - DNA, 220 bp, Zea mays
  Clone ID: LIB3228-009-P1-K1-A4
aaaaaaaaaaaaaaaaaaaaaaaaaaaaaaaaaaaaaaaaaaaaaaaaaaaaaaaagggggggacaatatattataatccaaacttacatactcgtgcttgccaactttttatttcttctatagggcgtactaaattaaaataaatgggcgtcgttttttaacgtccaactttaaacccctgcttttcctaattaaatttttttgtgggacatcccattt

SEQ ID NO: 3055 - DNA, 425 bp, Zea mays
  Clone ID: LIB3228-009-P1-K1-A5
cccacgcgtccgcctgtcagtttccctctcccctcccgaaaccggattccgtaccgaatctggtctcgccttggagccgaggttgcacgcggttcgtcctgcggccatggaggacgaggagcacgaggtgtacggacaggagatccctgttgacggcgaggacgtcgacatgtccgccggcgacgacgcgaccaagcttcaggagctcgatgagatgaagcgccggctcaaggagatggaggaggaagccgccgcgctccgcgagatgcaggctaaggtcgccaaggatatgcaagatcccaatgcaaccacatctgaaaacaaagaggagatggattctcggtcggtattcgttggaaatgttagtctgctgtcatcaagcctttctatcaaagttttggcatctggttcagtttcagcacaag

SEQ ID NO: 3056 - DNA, 430 bp, Zea mays
  Clone ID: LIB3228-009-P1-K1-A8
ctctgctgtggcttcccaggtcattgatctagcaacttctcttgcaaaagttgcggatgtggatagaaatcttggtaacgaaagtaccgcagttgagggttttgaggaagcaattcgatgccttgagaagttgaagctggattctgaacaaactaccctcgaacagcggcgcctctcggttctcgacttcctgcacaaccagttggccgataagtaagacatagtcttctcctaagaatgcaccaccagcagatgtctcctcatggtaatgttcaactctactacataaggttcccttcggaaggagttggtctagaagcagcgatgagtgtgtgtttaccatcgtttgaaactttgtcacggcacaaaaataagaactcctgcactgtaaatgtaatcatatatatgctcattgagtatccttgatgat

SEQ ID NO: 3057 - DNA, 320 bp, Zea mays
  Clone ID: LIB3228-009-P1-K1-A9
caattggttaataatatggtcagcctgctatatccaggcacgggagcctcgggcattgttgggtgctcgaggctaaactcatccatccattctggacacatggaagcacacactggccaaaagcagtgtcgcaagaaaactgctatggtagcgagactaatcggcgctgtgaaggcgaacgacagagaagagtcaccgtcgacagcgctccccaaatactgtacacaaacaagtagaagagcatagccaagcgttgataaaccacaggatcttgcctgggatcgcgcctgtacatactcagacgccagcagatagaggag

SEQ ID NO: 3058 - DNA, 151 bp, Zea mays
  Clone ID: LIB3228-009-P1-K1-B1
tctatttattcatatttttatcagccatttatattcagacacgatagcctcgggcggtttttaattcattaggttaaacatattcatccatttctgaacacatttgtaacacacatcttcctaaaactatgtcatatgaaaactgctttgg

SEQ ID NO: 3059 - DNA, 331 bp, Zea mays
  Clone ID: LIB3228-009-P1-K1-B12
cccacgcgtccgcccacgcgtccgctcatggaacttccagaatggctcttccacgggtcgtgcaccccgcacatgagttcttctgtgccatacgcaggatcacagtgctcagtaccggtcgcatccactattttgcagaaaaatgttgcaacccgagcgctcattcgaaagactactgtatagcttatgacagttttttaatattgaagagcttcactggagacaactgaaaatcagaagctttccttagtttgagcagttctatcctagtgctccaatcactgtagtttagtgctgcctaatatgttttgatgggaaggacaatttcttc

SEQ ID NO: 3060 - DNA, 428 bp, Zea mays
  Clone ID: LIB3228-009-P1-K1-B3
cccacgcgtccgccacgcgtccggcggaagatcgcactgagcagttcttgaatgttctacagagggagctaggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtgatttggcctggcagcaggagggctcttcggaataagaatggatgtggctctaactctgcttctagaccggtgatggttcagcttagaagcaggggatcttcatcatcagaataaaaacgtgtgttgttgtgttgctgtgtctacgccactagtatttctgttgttacttatgttctaggtaaactgcgcagccagagcagagctgaagaatatg

SEQ ID NO: 3061 - DNA, 429 bp, Zea mays
  Clone ID: LIB3228-009-P1-K1-B6
gggcctacaggcagaggcaacagcaacaggtgtatggttcagcagtgcctaatccattcatgtcaaatgatcctttcgtgatgtcaaaccaagttgctcccccaccatcagttcaaatggctgccatgtctcagcagcatcagcagatccccacgatgatgcaaccaaatccttttggaccacctatgcagccacaggtaggcatgggtccagcaacaaacaatccctttctggatgctggattcggggcattcccagtggcgaacaatggccatcagcaacacaacccatttggcagtgcccaacttctgtaggctacgtagttacaagagcaaatttgtgcttcagcagatgcgattttttcggtgattatatcgtgcattgtgctcggcccttctttcatgcgatgcgtgtattatgaattggctt

SEQ ID NO: 3062 - DNA, 405 bp, Zea mays
  Clone ID: LIB3228-009-P1-K1-B7
gctcgtcacgtttgtgctgactttgtgttcggcacaagcaacctgtccaggttatgtgtaaagaactgtttacttgtttttttcataataacaaacgttgcagctgttttatccaagcaaatctaaatggtgaccacggcaccaagcaaaagtgacatgactgcaagggtaagacagcacaacatgatgcagctcaccaccgattatttgcaaacttaaccagttcactaccgttcagactccagacttcaagttcaatggccgacctgtcacccaataacccatctgaggcccacatccccaagttcgactcgggcaacaagcttgtgtgagcaccgacagatcacacgcccggattcgctggggcagtcgctcagattcgctaggagttctccgctgtctctg

SEQ ID NO: 3063 - DNA, 391 bp, Zea mays
  Clone ID: LIB3228-009-P1-K1-B9
ggctcgccgcgatggaattcgagtcagcggcgcggcggcggcagcgcagactctcttcgccgtcgttgaggacccacctcacgccggcttttgacgccgtggccggtggggagggcggcgtgtctgggtactcttcatcgtcgtcttccagcggtctcgaactcgggttcgacgcctctctcctccgcaaccgccgctccggtttcgccgccccctcggacctggacagccgtgtcctcctctactccccgcagtccgtgccgccgcagatgagggcggcgtacctggcagcggatgatggggtcagggcacctggcgtcaaccactacggatccaaatatgaggctgcccggcttactggcgcgccaggtttcagggtcagaaaacacat

SEQ ID NO: 3064 - DNA, 398 bp, Zea mays
  Clone ID: LIB3228-009-P1-K1-C1
gggacgcatcaccatactcttatgcggacgttttaacgccacacgaatggcccagagcacgaggatggtggccatctccctggtggaccttctggtggcggttactgcgcttctgcccacagacacctcgtacagagtgataccactactgctacgagcggtacgccaacggcaagaaggacgaccccgtctgcactaagatgtgcatccaggcgtgacggaccacctacatgggcgcctgcgactcagcgcctgcttagatcgacacccatctacatggacatcgcgcgctaagatcgatatcaggatcatatacaatcgctgattcttcgatcacgtcagcccatgcatgatctctacatcaggccgactgaatctgaaccttctactaaagtata

SEQ ID NO: 3065 - DNA, 365 bp, Zea mays
  Clone ID: LIB3228-009-P1-K1-C11
atgacacttggacgggcaaaacctgtcattgcataactgttgatcctttgaatgctgagtctaatggacactgtcatatgcaatcctcccgcaattaccgtagttcaaacgctccatatttaaagttacaacactcctgatcaatattcgatacaaacttttcatacgccatccaaggcgcgacggtggagatggagtgccgccacttcgagtcgcagcaggtccacgacaaggcggaggcgacgacgggccccggcggctggtacaggatggggatcagcggctaccaccaggacgagatctgcgacgtgcgcctgctcaagagcccctatgcggactgcgccaagatcgaccactcccgcgac

SEQ ID NO: 3066 - DNA, 431 bp, Zea mays
  Clone ID: LIB3228-009-P1-K1-C2
ccccagatcaacagcgactgatattcgctggcaagcagctggaggatggacgcacgctggctgactacaacatccaaaaggagtcaactcttcatttggtcctcaggcttaggggtggaaccatgatcaaggtcaaaactctcactgggaaagagatcgagatcgacattgaacccactgactcgattgacaggatcaaggagcgtgttgaagagaaagaaggcattcctcccgtgcagcaaaggctcatctatgctggtaagcagcttgctgatgacaagaccgcaaaggactacaacatcgagggtggatctgtcctccatcttgtccttgctctgaggggtggttactagtctaaacctgatgaactagcagtcagataaactgttgtgttggctgcgaaatgtgcaggcctgatgttgaacttgcaa

SEQ ID NO: 3067 - DNA, 411 bp, Zea mays
  Clone ID: LIB3228-009-P1-K1-C3
tgcccttctgtgtacgaagccgacgagcagccgacgctaaagcttggtccggtgagcttcagagaaggggcgggtacgtcaagatgcagatcttcgtgaagaccctgacgggaaagaccatcaccctcgaggtcgagagcagcgatacaatcgacaatgtcaaggccaagatccaggacaaggaaggtatcccgccggaccagcagcgactaatctttgcggggaagcagctcgaagacggccgcaccttggccgactacaacatccagaaggagtccacccttcaccttgttcttcgccttcgcggtggcatcattgaaccttccctccaggcgctcgcccgcaagtacaaccaggacaagatgatctgccgcaagtgctatgcacggctgcaccccagggctgttaact

SEQ ID NO: 3068 - DNA, 418 bp, Zea mays
  Clone ID: LIB3228-009-P1-K1-C4
cggacgcgtgggcggacgcgtggggcctaggcgagccagccctaggccaacctcactcaggcagaggaagagacgccctcactattcatggtggttgtgcaaccgtccatgaagactgttcacgatgcacactacgtcgagcatgtctatctcaatgagcacaaggtgctgccggatttcgacatcaacggcgaacaacgggagatgaagtggtacctcgacactggtgcgttgaaccacatgaccggcgacgcggacgtcttctccgactacaaccacgacgtcgtcgaattcgtacgtttcggcgatggatctttggtggaggtcatcgagcgcggatcgatcctgttcgagtcgaaggatggaggccacagggcgattcatgatgtctatcacatcctgtgtcttcggagcaaca

SEQ ID NO: 3069 - DNA, 414 bp, Zea mays
  Clone ID: LIB3228-009-P1-K1-C5
cagcgacgcactgcgacccggagctaacgtctcagctgaagcgcgcggcgcggtcgaccgtgtcggcaatgccggggcgcaccgtggcggccggcgagacgcccgtgctgatgagcggcgcggggcacgacgcgatggcgatggccaggctcaccaagatcgggatgctgttcgtgcggtgccgcggcggcatcagccactcgccggaggagtcggtgatggacgacgacgtgtgggccgcggggctcgcgctgttcaacttcatcgaccagaacgcggtgtcagaagaactggatgccgggcagaacgtggtggctgtggcgctggcggtggcagagtcgtgattggtcggtggcgattctttttagtgggagtaggcctgtagcctgcaactgtacataagacttgtttcat

SEQ ID NO: 3070 - DNA, 141 bp, Zea mays
  Clone ID: LIB3228-009-P1-K1-C6
cccacgcgtccgaaaaaaaaaaaaaataaaaaaaaataaaaaaaaaaacaatctagagggtccaaaaaaaaaaaaaatataaaatataaaaaaaaaacatttatttttatatatccctaaattcaatttcacttaccttct

SEQ ID NO: 3071 - DNA, 147 bp, Zea mays
  Clone ID: LIB3228-009-P1-K1-C7
gttgtctgcttttctcttgaacgaagatgtgatgaactcagctgaagatgtagtgtgtatgttgtcatggtttatttttctattttatttatctatctataatatctatcggagaaggtttgatatgaagcggaacactgattaacg

SEQ ID NO: 3072 - DNA, 57 bp, Zea mays
  Clone ID: LIB3228-009-P1-K1-C8
cccacgcgttcgcggacacttgttctgacgcttggttataaatagtcgggggggaat

SEQ ID NO: 3073 - DNA, 419 bp, Zea mays
  Clone ID: LIB3228-009-P1-K1-D1
gccgccgccaccccggtttccttcgtaagcccgtcgtcctccgtccgcgactctgcgcgagaagcgagagtatggacacccaagtgaagcttgctgttgtggtgaaggtgatgggaaggaccggctccaggggtcaggttacccaggtcagagtgaagttcttggatgaccagaaccgtctcatcatgaggaacgtcaagggaccggttcgcgagggagacatcctcacactgctcgagtctgagagggaggctaggaggctgcgttgaggcgggatactgtcttggtagttttcgtatggagttggatgtcatctaattgtgctatgtttgtcaaactttggtatgacctttaaaacacctgccttgtatgattatttgtgagcctggtggtaagattgcagtttggtttttatgatc

SEQ ID NO: 3074 - DNA, 336 bp, Zea mays
  Clone ID: LIB3228-009-P1-K1-D11
ctcccgcacgccgacccgcagccgccgccgttcgccatgggtttcctcgacgcgctctaccgtgtggtgatgcgccgcaacgccgtctacgttaccttcgtcgtcgccggcgctttcgcgggcgagcgggcggtggactacggcgttcacaagatctgggagatgaacaacctcgggaaaaggtacgaagacatatcggttttggggcagaggccagctgaggaatgataaattttggtcaccagtttgcttcggtttgaccgtttcattttggcacagtaataaacgatgtaaacttacgctgctcctatgacctccttctcattcgtttactct

SEQ ID NO: 3075 - DNA, 425 bp, Zea mays
  Clone ID: LIB3228-009-P1-K1-D2
gaaaggcaagatggcggcggcggcgcgcgaggacccttcttcctcttcctggctcgcgctcggcagcatgtgctccatgcacggccgctgatgagggagccagcggtggttattagtagtgcagacaagagctcgggcgccatgggaggcgttgcagcagcaatttatgtgctacctacgtactagtatttattataattgttattactaacaacaacgactggtagtatcgatcagagaccgacgctattcgatcgttggttcgtttcattgtcctttccttccttgctagctggtggtgtatcgaccatctaaatctaacaggacacgtggacctggacggcaagagatgtccagtccagcagtgtggaacgtttgttgctttgtctatcattaattgctataagtttgttcatatatacata

SEQ ID NO: 3076 - DNA, 413 bp, Zea mays
  Clone ID: LIB3228-009-P1-K1-D3
agcaggtcctttctttgaactcaggggttggccacttcgtcaagatcttccctggtgtggcgcatggatggagcgtgagatacaaccacgacgacgcagctgccgtgaagagtgctgaggaagcctttgcggacatgctcgactggttcaacaagaatctgaaataaactctgcaattgcatcctgccttgtaataatgcgtgttccagtgccctgggatcgaatctgctgtgtttgggcttttgcatggtcaggctattcagagttgtcatggacttagggttgtgttagtagattggttgcgctgaatctataataaaaacgaggtaaactaggacaatgatgatgtggccgtgtgtatttaatgtattctgttcacaattaaaaaaaaaaaaaaaataattacctatttt

SEQ ID NO: 3077 - DNA, 242 bp, Zea mays
  Clone ID: LIB3228-009-P1-K1-D4
atcgatgcctgtctatataaacttatttccttgctcacttttttattcgttgtccaacgacttttaacgataataaaatattcaattcattctattaaaccattaaaaaaaaaaaaaaaaaaaaaaaaaaaattaaaaaaaaataataagaaataaaaaaataataataaattataatataatatatataatatctaattaatatattattatattaaattgggggcggcccgtttttaaag

SEQ ID NO: 3078 - DNA, 317 bp, Zea mays
  Clone ID: LIB3228-009-P1-K1-D5
gcctgagtactacacactgcgcgcgccattggcagaggaggagaaagaagggtgccgtcggcgaagatttgtgtgtaaaacttaaaattttttttgattagtggtatttatttttcttattttttatttattttttatattatttatattttattttttttttttttttattttttatttttttattattattttttttatttttttttttttttattttttttttgtttttttttttttttttttttttaattttttttttttatttattatattttttttttttttttttttttttttttttttttattttattt

SEQ ID NO: 3079 - DNA, 244 bp, Zea mays
  Clone ID: LIB3228-009-P1-K1-D6
aggagctggacggccgcaacatcaccgtcaacgaggcccagtcccgcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagc

SEQ ID NO: 3080 - DNA, 208 bp, Zea mays
  Clone ID: LIB3228-009-P1-K1-D7
cggacgcgtgggcgccgacaagtttaagctcttcagcaacaatgttgtcggctaaaattccaacgcatcttgctcttatattactcctcagggtgttgtatatcatcgagttgttgtagcggtaatgtgagtaatcagggcatactagctgtatgtgtacatgcattccactattggagagtataggcaaatcatcatctaagttatt

SEQ ID NO: 3081 - DNA, 79 bp, Zea mays
  Clone ID: LIB3228-009-P1-K1-D9
aaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3082 - DNA, 414 bp, Zea mays
  Clone ID: LIB3228-009-P1-K1-E1
ctcgcttcttacatttggacctgacgtactgcaaagacgttttaaaattaagtaaactacatagtagtgcggtggccttagttttgggaaatggaacagagtataaccgatgtagtgaaaacagttggaccactgaagtaatccagttgccatctttccgatgcttcagctgccctgtgacgtgactccagggacgtatttgttgacacctgcttgaaaactgacaagcctctctattagacagagtgttaacctgtggtctcagaatggagtaaacaatggtagacagagtgttaacgtacatcatgtctgatgtaagccggcaggtattttcgtcgtgagccaaaactcggctaacgtcgtgacacggactattatttttatttttcttaaataataatcccttttcagaca

SEQ ID NO: 3083 - DNA, 376 bp, Zea mays
  Clone ID: LIB3228-009-P1-K1-E10
acatcgtatatcttagatagtttaattttgataatgggcccaagatatatcacgctatgcatcttgctagtacttgtcttacatggagatacaactgtggcagaaacttgcaggcagtttgttaaatgggatccattctgctttagtgcaatgtgcaaggcaagttgttttatagagggaaaatcctccgatggttcctatgtaaaggggcacagatgtgaatcaaatggatatcacgctgtgtgtgtttgttttctgagtaaaaatttggtatctaatgacatgcggatctatcttcttttgttcctctctgtcatctaggagtgtttgtctaaataattatatggtaaaatagttaactagtatgtttactatt

SEQ ID NO: 3084 - DNA, 303 bp, Zea mays
  Clone ID: LIB3228-009-P1-K1-E11
cgttatataaaaaaaaaaaaaaaaaaaaaaaaaaaaaaaaaaaaaaaaaaaaaaaggaaaaaaaaaaaaataaaaaaaaaaaaaaaaaaaaaaaaaaccaaaaaaaaaaaaaagggggcggccgttttaggggtccaaagtttccttccccttccttgcaacgtattagtttttttttggggcccccaaatttaatttcattgcccgtgttttaacaacgtcgggcctggaaaacccttggctttcccaaattaattcgctttgaagcaaatccccttttcgccagttggcttaataccaaaa

SEQ ID NO: 3085 - DNA, 413 bp, Zea mays
  Clone ID: LIB3228-009-P1-K1-E12
atcggtcaaagacaaaagatgattgctgtgagcatcatgtggtcattagtgcaggtgcaggtgctggcggcgatggcactagcatttctggtaggcggtgcctggtgtggtcctcccaaggttcccccgggtaagaacatcacagccaactatggtagtgattggctagatgccaaggcaacatggtatggcaagccaacaggtgccggcccggacgacaatggtggcggatgtgggtacaaggacgtgaacaaggcccctttcaacagcatgggcgcatgtggcaacgtccccatcttcaaggatggtctaggttgtggatcctgcttcgagatcaagtgcgacaagccagcggagtgctctggcaagcccgtggtggtgtacattacagacatgaactacgagcccattgc

SEQ ID NO: 3086 - DNA, 365 bp, Zea mays
  Clone ID: LIB3228-009-P1-K1-E2
gagaaagtcattcgactggctcttggaggcatgggcacagatgaggatgacctcaccagggtcgtaactactcgcgccgaggtcgacctgaagctgataaaggaggcttaccagaagaggaacagtgtgccgctggagcgtgctgtggccaaagatacaactagagattatgaggatattatgcttgccctcctaggggcggagtgaggaggcgtgcctcaactcgatctcatctgctgctacttgtttgatggggccaaaaatctgcatcgatgtggtatccacatggccgtgtttttgaataataatattgtaacacgtagcctgcattagcagcgcgtattaaataaaggaactttctgata

SEQ ID NO: 3087 - DNA, 291 bp, Zea mays
  unsure (1)..(291): unsure at all n locations; Clone ID: LIB3228-009-P1-K1-E3
gttgcctaggaatttggtacggtgaagtggcagtggacgtgaacaatgttaagtgttgagcatttaaaaaaaaaaaaaaaaaaaaaaaaaaaaaaaaaaaaaaaaaaaaaaaaaaaaaaaaaaaaaaaaaaaaagggcggacgaaaaaaaaaaaaaaaagattaagtaatattgaatgcaagggttttattttttatatagtgatacataaaaataaattaacgtggccgnctttttacaactttgtaaattgaaaaaaccttggcgtcacctaacttaatagatattgat

SEQ ID NO: 3088 - DNA, 119 bp, Zea mays
  Clone ID: LIB3228-009-P1-K1-E4
cccacgcgtccgctcttcgccaccactgttttagtcatcggtgcctgatgggcaccctgtttatttcatgtatcatttattgctgtcattgtaataagcgatgggcatgattgtagttg

SEQ ID NO: 3089 - DNA, 423 bp, Zea mays
  Clone ID: LIB3228-009-P1-K1-E5
gtcctggctctcctccacgctcggcggcacctccacctgcgacgacgcatgcaaagacgcgcccgtcagcgacatcaagaacgcctgcatcaccaagagcttcgagtttgagaagctgctgcgcgtcacgctcgacctcatcaccgatgcctcagggtccatgtcggccgaggtcgcactgcctccgtcggcggcatcgggcgccagcgggccggcaccggcgccgttcggaggttacggctcgtccgctggcgccccggcctacggcgcgccgtctcctgctggtgacccagcttatggcgccagcggctcgccggcaccaaccccgctgtagagtgtactgctttcgacgcgtactcgactgcatgcatgagcgatttataatgtcaccttggtgcagactcctgcgctccggaggatttt

SEQ ID NO: 3090 - DNA, 233 bp, Zea mays
  Clone ID: LIB3228-009-P1-K1-E6
gtttcgatctccacgctcattctgcggaaggcgttttggctgttcgggtcccttttggtagggaggtctccgacgagaagggggtgaaatcgtcgttcaacatgatgtctcatcatgcgtgggaggtggagaagagctacgcgagcccagagtttgagaagttactggctagatgccaaggcaacatggtttggcaagcctacatttgccgtccccgaccacaatggttgcag

SEQ ID NO: 3091 - DNA, 310 bp, Zea mays
  Clone ID: LIB3228-009-P1-K1-E8
cgagattgccactgcgaggggctgccttggacgattccctggaagtgagatgatgggcattattaaaaagtttatcaaggcgaagaatgattaatgctggttgaagcgctaaccttttgcgtgatctgtagaccataaggcttttctatgtaataaacttgttggcgcctgtttggacaaacactaaccatccctaggtcgccttcgtagtgagtccggatcttgaggatgatccctaggtttcgtccacagatggtcttgtcattggtagcgagttaataaatattatgtttgacaaataacattaccg

SEQ ID NO: 3092 - DNA, 88 bp, Zea mays
  Clone ID: LIB3228-009-P1-K1-E9
aaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3093 - DNA, 428 bp, Zea mays
  Clone ID: LIB3228-009-P1-K1-F10
ctgtctcctccccgctgccataaacgcaggctcacgcggacgcctccctcccgtgccaagcgcccaagaccaaacccaccagcacagcaccaattcaaccgcgacccaacccaccgccccgcaccctcctcccccagatctcccggccgcgacgacgccatgacggccaagggcggcgccacgccgtcccccggcggcgcgggccccgcggcggggaacggccgcctcttcaccgtcgggctggtcaccgcctggtactcctccaacatcggcgtgctcctgctcaacaagtacctcctcagcaactacggcttcaagtaccccatcttcctcaccatgtgccacatgtccgcctgcgccctgctctcctacgccgccatcgtctggctgcgcgtcgtgcccatgcagctcgtgcgctcccgcgtcca

SEQ ID NO: 3094 - DNA, 104 bp, Zea mays
  Clone ID: LIB3228-009-P1-K1-F12
agaagatcgcctgcgccgtcctcatcgccgcctcggccaccgtggcgctggccggggaggcccccgcttctttttccaacaaccgatttcttcgagtccgaacc

SEQ ID NO: 3095 - DNA, 426 bp, Zea mays
  Clone ID: LIB3228-009-P1-K1-F2
ggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaaactggctaatcttctatgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaagctattgttatgaaaatttgtcgtctgtaagcatgtgaacttccgacgttgccacatgctggatcagtctgaataagtaagtatgcagctctaggtggtcagctgcgtcta

SEQ ID NO: 3096 - DNA, 420 bp, Zea mays
  unsure (1)..(420): unsure at all n locations; Clone ID: LIB3228-009-P1-K1-F3
ctttccatctttagcaatgcctcaatggcgatggtactaggtgtaagtatagtgacatcattatggccttgttttaatgcaatatgttcaagtgaaactctggcatcagcattagcatacgagtccattctttgctcaaaaagtgatgtaagttttgcataagcctttgcataaggatcaccggattcctgatgcaagagtggtcgagacgcggttcctacagcagcaattcttcttgcaagtgcatccagtgggacatctaaccatacggtcagccctttcttcatgtaactccaattgattggtcggatcactgcaccacctccggttgcaacaaccaaccgatgcattnttgacagatccctcaggacctcactctcaatatctctgaagaatgtttcgctgttctgattcgcgagc

SEQ ID NO: 3097 - DNA, 268 bp, Zea mays
  Clone ID: LIB3228-009-P1-K1-F4
ccgtgctggtgaagtatgtggcggacgacggcgacatcgtgctgatggaaatccaggggaagttgtcggctgagtggaagcccatgaagctcttttggggcgccatctggaggatggacactgccaaggcgctcaagggccccttttccattcgtctcaccagcgagttcggcaagaaggttatttgcctaagacgtcatctctgttaactggatactttatgcctattacactttcaaacgatcaattttacttgactttttaatct

SEQ ID NO: 3098 - DNA, 184 bp, Zea mays
  Clone ID: LIB3228-009-P1-K1-F5
cccacgcgtccgcggacgcgtgggcagcagcctccaataagagccagccagagaaacggggaaaactctcgccggcgccatccgagcgaacatgccaaccgaccccgtccccaaggcaattttccgccgacgtaccaccaccaccgcaggagcgagatggagatgaagaggttcctcttcgtcg

SEQ ID NO: 3099 - DNA, 301 bp, Zea mays
  Clone ID: LIB3228-009-P1-K1-F7
ccgcggacgcgtggggaggagaaccagcagcctccaataagagccagccagagaaactgagtaaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgtcgcgggcgccccaactgcctccgagtcggtcgccgaggctcccgctggcgcttgcgct

SEQ ID NO: 3100 - DNA, 413 bp, Zea mays
  Clone ID: LIB3228-009-P1-K1-F8
gcggagatcatcggcaatgtcgaacatggggcaatccttccaggccggcaaggcgcaggcccagggcgagtgccaggcggagcgcgcagcgcagtgcgttagggacggcgccggcgccaccgcctgcgccgtgaccgacaccgccggagccgcggccgacagcgcgcagctgcaggagcaccgcgccgccggcaccgttcagcaggctgctgagcaggtggcgcagacggcggcgggcgcggcggcagccgtcaaggacacggtggcgggcgcggcggcggccgtcaaggacacggtggcgggcgcggcggcaggcgccaatgacgcggtgaccggcggccactgaccgactcacgcgcgtgaaccggacggcgtaccaacaatgctgcatggccaagggttgcgcctcaaga

SEQ ID NO: 3101 - DNA, 423 bp, Zea mays
  unsure (1)..(423): unsure at all n locations; Clone ID: LIB3228-009-P1-K1-F9
ctctactaacaggacggtatatgttggtgggcttgaccccaatgttagcgaagatgaactgaggaaagcatttgcaaaatatggtgatcttgcctctgtcaaaattccttttgggaaacaatgtgggtttgttcaatttgtaaacagagttgatgctgaagaagcactgcatgggttgaatggatcaactattgggaagcaggcagttcgactttcctggggccgcagccctgcaagtaaacagtctaggggtgattctggccaccggcgcaatggcaactgcaacggcatgtactacgggacaccattctacggtggatatggctacgcctnnccgattccgcacccaaacatgtacgccgcggcctacgaagcctacccgtactatgggaaccagcagctagtgagctgatgtagtgatgt

SEQ ID NO: 3102 - DNA, 404 bp, Zea mays
  Clone ID: LIB3228-009-P1-K1-G10
gcaggcatccgggagcatcttggcaggggtgactgtgatctggctgctgtttgagggcatcggctaccacctcctcaccttcctctgccacgcactgattgtgtttctcaccgtctggttcgtctggtctaatgttgcgtcctttgtcaacaggtctcctccaaagtttccagaggtgattctatctgaagcccaatgcctgaaggtagctcatattgcaaggaaagaaatcaacgaggctttctatacattgcgcaatgtcgcttctggaaaagatttgaaaacgtatctgatgtcaattgcagtgctttggttcatttcgataattggaagctgcttcagcttcttgactgtgtcttacactattttcctgatggcatacactctgccaatgttatatgaaa

SEQ ID NO: 3103 - DNA, 418 bp, Zea mays
  Clone ID: LIB3228-009-P1-K1-G12
cccacgcgtccgcccacgcgtccgatgttgttcgcattcggttcgtgcaccaccccactcaccttccaggtcggcaagggctccaagcctggccacctggttctcacccctaacattgccaccatctctgacgtggagatcaaggagcatggcggcgacgatttctcctttacactcaaggagggcccagctggcacttggacgctcgacaccaaggccccgctcaagtaccccctctgcatccgctttgctaccaagtctggcggctaccgtatcgccgatgatgtcatccccgccgatttcaaggccggcaccacctacaagaccactctcagcatctgatgagcctgtgatgagtgatgacgaataatatttccagtccacgtgtcaacgagccaatatttaatttttttcctat

SEQ ID NO: 3104 - DNA, 106 bp, Zea mays
  Clone ID: LIB3228-009-P1-K1-G3
cccacacgtccgactagagcgcgggcggccgttctagaggatcacaagcttacgtaggcgtgcatgctacaatataacctctctataggaggacctaagctcaatt

SEQ ID NO: 3105 - DNA, 423 bp, Zea mays
  unsure (1)..(423): unsure at all n locations; Clone ID: LIB3228-009-P1-K1-G4
cccacgcgtccgcccacgcgtccgacacggagcctctcgagatcctgctccacctgccgttgttagccgaggataagaacgtcccatatgtatttgttccatcgaaacaagctcttggccgtgcttgtggtgtgacaagacccgtcattgcttgctcagtgaccagcaatgagggtagccagctgaaacaacagatacagggtctcaaggactcgattgagaagcttctcatctgatttacctaagatctttcagtgtgatgggcctcggcgacacatttttcagaggcttggactggtgatggtgtcttgtttacattacgctttccaaactatatttgaacactgctaagtcaatcatatntgaattgtgcttcactttatatttgtgattgtcatgtatcctcaagatgcctctgtatcg

SEQ ID NO: 3106 - DNA, 373 bp, Zea mays
  Clone ID: LIB3228-009-P1-K1-G5
cgggcaatccagtcacggtgtacatcactgacatgaactacgagcctatcgctccctaccacttcgacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccc

SEQ ID NO: 3107 - DNA, 351 bp, Zea mays
  unsure (1)..(351): unsure at all n locations; Clone ID: LIB3228-009-P1-K1-G6
aaatagcgggtcaagtgaatagtgactaaagccaggagtcatcttgaggcgaccacctagcggtgtgacgagctaactcttgttgcagttgtcattgtagcagcacttcctctatacatggattaccactggacataaacagatgttggaacatctaggatggcgccatgcatacatatgtcgcacctagggcatggaccgcccgccaaattcaatcgcctctaggtaccacaccggcgacggcgtcttcggcaaggcttgtagcagtagctcatgcaggtagtgatgacaagggactgttagcgaagaatgtcgacagcggccaatggtcatgtaaatngttcatcgtat

SEQ ID NO: 3108 - DNA, 320 bp, Zea mays
  Clone ID: LIB3228-009-P1-K1-G7
cccacgcgtccgcgagaggagaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggctacttttcttgtcttttgcttat

SEQ ID NO: 3109 - DNA, 415 bp, Zea mays
  Clone ID: LIB3228-009-P1-K1-G8
cacaaacagatcgatcgattacagcaatggcggccaaggtgttcctcctcctccgactcagcatggtcgccgtcgtcctggctgccatcgccacagtagcgctcgcggaggaagccgatccgcgggcactgccggcacagtggaccaccgcgaagaagtacaaggccacgatggacgccaagacgcggcaggctttcgacggcgtggtggccgccgctacggcagagaagcggtcccaggcggtggaggccgtgctgcagcagcagctgaacatggacgtgtccctgtccaaggcgacgtcttccggggacgagaacaactacgtgagcgtggccgccgcctacgagaaggccgcgggcgccgtcatcgcggcgacgccggacaacaagctccgcgctatggcgttcgcgttcga

SEQ ID NO: 3110 - DNA, 60 bp, Zea mays
  Clone ID: LIB3228-009-P1-K1-H10
cccacgcgtccgcccacgcgtccgcccacgcgtccgcccacgcgtccgcccacgcgtccg

SEQ ID NO: 3111 - DNA, 180 bp, Zea mays
  Clone ID: LIB3228-009-P1-K1-H11
cctcgttcgattattcctattatatatggattggatgagattagaaaaaatttagaaaaatttaaaagaactttaacttgtttgtgatttaaactcatctaatcccactcaatccatatgaattgaaagctaaccgaacaaggcttaagggttagtttatgaactctattctaatttttt

SEQ ID NO: 3112 - DNA, 252 bp, Zea mays
  Clone ID: LIB3228-009-P1-K1-H12
aaaaaaacgacgtctgtgcgtcaggcgttcggcgccgtatttgcttgtgtcgtggtagctacttttctttctggtgtgagttctagtcttgagtgctttggagttccaacaagggaaggagcagggagcgcaacaggtggagggagaggccggcggccggccatcacgccattgattgccactgcattgtggagggtgagtggaggggaaggaaaaggaaaagggtgggttttactcgcatggggaggcgaa

SEQ ID NO: 3113 - DNA, 289 bp, Zea mays
  Clone ID: LIB3228-009-P1-K1-H2
gaatctttcaaagatggcgtccaagaagatggtcctcgccgtggcggcactgctgctagtcacgctcgcactgcaggtcgcccctcctgcgatcgccatggactgcaaggccgggtgtgccgagatcaagaactccccactcggcataagcatcgaggagtgtctgaagaggtgcgaggggatcgccactgagcagggacctagggacccttacaaggataacaaacttgatatcccataaacacttatgacttgctgatatatttgtgcctatccaatcatttgtgat

SEQ ID NO: 3114 - DNA, 262 bp, Zea mays
  Clone ID: LIB3228-009-P1-K1-H3
aaaaaaaaaaaaaaaaaaaaaaaaaaaaaaaaaaaaacggacaatataaataaaagcggggggggctaacacatgcatgcaaaaataatacctatttttttattccaccctacttcattctctctgtctggttattcttaacatcttgtcttggttaaaccttggtttttcttcacttaattcttattttcattcctttcccctttttttcttgcttatttgttatttcttttattaggcctcttcttccattctttttctt

SEQ ID NO: 3115 - DNA, 103 bp, Zea mays
  unsure (1)..(103): unsure at all n locations; Clone ID: LIB3228-009-P1-K1-H6
atctacggcgtccccatcagtctttgccgccacctataacctatcggatcctgcaaagctatatatgattctatggtataatgtgtggttgcggcannncttt

SEQ ID NO: 3116 - DNA, 225 bp, Zea mays
  Clone ID: LIB3228-009-P1-K1-H7
cccacgcgtccggcgacgattctgattccgacgacgatgggtcagcttgagcctgaccgatgacgcgggtttgggttaccggtgccactcaaaatacgatcccttttattgtaaaagagggatcccttctttccattgcattcttgcaatccgtttcttcttgactatgtttcttcttgactatgtaacgataataacatgagaaaattatctgaatgacaaaaa

SEQ ID NO: 3117 - DNA, 339 bp, Zea mays
  Clone ID: LIB3228-010-P1-K1-A2
ccggttcaagagggagctggatggcattcaagtggagctacaagcaaccgacccgagcgaaatgagcatggacatcgtcaagtcgcgagccctctgaaacagccccggccgctgcacctgcacgctgcaggggcgcatcggctcctgcatgcccgtgggtcgtcgaatccttgcttgtgtgttgggaacggtcttgtgttttcgagtccttgttttcctggaagcaaaagccctgcattctatatgagactgtatgccattttccatctttttctctccccatatctctgccctaatcctgctaccgctagaaactagaacttatttgggggttgatct

SEQ ID NO: 3118 - DNA, 431 bp, Zea mays
  Clone ID: LIB3228-010-P1-K1-A5
aaaatggccaaggcagccgccaccgcgaatgccatcttgctcttggctctcttcttcgccggcgctcacgcgaatgtcccatgcatactccccgtatgcaagacggtgggtggcgggagccggttcttcgacgtgcagttctgcctggcggcactcggctccgatggccggagcgtcgaccactgcctcgactaccaggtctactccgccattgccgctgacctcctcgcggccaacctcaccgctacggcggccaagatcaacggcctgctccggaagagcggcggctccgccgacgaggccacgacgcgctgtctccggtcctgtcaagcgttgtacggcgacatggaacggaggcagactggctgcgcggctgccgtccggggcgtcaggaagggtgaggccaccaggtgcttggaggaagtcgcgtc

SEQ ID NO: 3119 - DNA, 399 bp, Zea mays
  Clone ID: LIB3228-010-P1-K1-A6
ataaggcgagccgagagccattcgcatggaggcggcgatggatctgatgcggcggatgccgccacggagcgcggagacggcgctcaacgcgctgctctccctcctccccgaccactccctcgacctcctctcccaggtcgacctcccgctccaggtttgcatggataaggagagcctgaaggaatacattctatgcgaatataaccgtgatgctgactcctaccgatctccttggtcaaacaaatatgacccccctttggaagatgggacagttccttctcaagggatgaggaatcttgaggttgaggcaaacgaagttttctcagtgtatcgtgaccagtactatgaaggtggcatctcatctgtttacatttgggaggatgaagataatgggtttat

SEQ ID NO: 3120 - DNA, 429 bp, Zea mays
  Clone ID: LIB3228-010-P1-K1-B12
cccacgcgtccgctcgaccatccctgcaaattaccgcgatggctcccaagatcctagtcatccttgtgttcctcgccgtggcctcaccggctgctctggccgccttcgatgtgatagagatgctggccgacaagcccacgtactccacgttcctgaagctcctgcaggacaccaaggtcgcgggcgaggcgaatcagctccggtcggcgacgctactggtcgtccccgacaaacttgccaagcctctggcgtcgctgcccgccgataaggtgcggccggcggtggagaaccacgtccttctcagttacttcgaccccatcaagctggacgagatgaagacacgcaccgtcatcctccccacgctgctctccgtcaccgacaagaaactcggcgtcctcaactacaccagggccgacgacgggcagatgt

SEQ ID NO: 3121 - DNA, 430 bp, Zea mays
  Clone ID: LIB3228-010-P1-K1-B3
ggccagttcatcccagacattgtcgcgaccattggctctgctgcccaggagctcatcggcatgggcgcgaaggcgatcctgatcccgaacaacttccctatcggctgcgtaccgacatacctgagcgggtacaggagcggcaaccgcgcggactacgacgagcacgggtgcctccggtggttcaacgacttctcccagaggcacaaccgggcgctgcgcggcgaggtcgaccggctcagggcgcagcaccccggcgtgaagctcatctacgccgactactacggtgccgccatggagttcgtcaaggacccgcacaggttcggcatcggtgaccccctcacggcgtgctgcggtggcgatgaccagccgtaccacatcaacaggccgtgcaaccgagcggccaggctctggggcaaaccgagcggcttcg

SEQ ID NO: 3122 - DNA, 430 bp, Zea mays
  Clone ID: LIB3228-010-P1-K1-B5
gggcctacaggcagaggcaacagcaacaggtgtatggttcagcagtgcctaatccattcatgtcaaatgatcctttcgtgatgtcaaaccaagttgctcccccaccatcagttcaaatggctgccatgtctcagcagcatcagcagatccccacgatgatgcaaccaaatccttttggaccacctatgcagccacaggtaggcatgggtccagcaacaaacaatccctttctggatgctggattcggggcattcccagtggcgaacaatggccatcagcaacacaacccatttggcagtgcccaacttctgtaggctacgtagttacaagagcaaatttgtgcttcagcagatgcgattttttcggtgattatatcgtgcattgtgctcggccattctttcatgcgatgcgtgtattatgaattggcttc

SEQ ID NO: 3123 - DNA, 424 bp, Zea mays
  Clone ID: LIB3228-010-P1-K1-B6
cacttgttgaggcaaagtcagatattgttgttaagattggtctccggaaaggttctaaatcttttgaagaagcccgagcagcaggattcaccgaagagagtgggacgctgggtgatatatgggagactgtatcaaacagtgatcttgttttgctactgatatctgattctgctcaggctgataactacgagaaaattttctcgcacatgaaaccaaacagtattcttggtttgtcacatggatttctccttggacatttgcaatctctgggttttgatttccctaaaagcatcagagtgattgctgtatgccccaagggaatgggcccatcaggcaaaagactttatgttcagggcaaagagatcaatggtgctggtatcaaagctagctttgctgttcaccaatatgttgatggaagggcttc

SEQ ID NO: 3124 - DNA, 424 bp, Zea mays
  Clone ID: LIB3228-010-P1-K1-B7
cgaccttctccagctacggcgacccgcccggtacggcgcgccgtcgctggagctcccggggctcatcaagatcagctgcgacggtggcccgccgtgcgacccggacgcccgcgactggctcgcgggcgacgcggaggtcacgcaccgggtggccaggtggatccaggaggccatgccggaccacgtggacgccgcgggagggccggtcgtccggcagtcgtgcatctgctccatgacccccgacgccgacttcgtcatggacttcctgggcggcggccgggacgtggtggtcggggccggcttctcgggccacggcttcaagatgggccccgccgtggggaagatcctggcggagatggccattgatggcggctccgagacggcggaggaggctggcctggacctcggcttcttccggatcggg

SEQ ID NO: 3125 - DNA, 94 bp, Zea mays
  Clone ID: LIB3228-010-P1-K1-B8
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3126 - DNA, 425 bp, Zea mays
  Clone ID: LIB3228-010-P1-K1-C10
cccacgcgtccagggacgcgtgggcgtatgtctatggaactctatttaaaccatatatttctcaacatgagaatgaaatcgaccggaatctccttgagctgagagctcgagccaccgtcacggttgaccttgattttcagaaggctgcttctgcaggacaaagtactttctttgacgttttaaaatatgttgctgcccagtcaccttctgagaaatcaacgcaacgccttcatcaggaatcacagcagccgccacaacaacagcaaccacaggtgcatcaggcgcaaccacaaaaacaagcagcatctgttatgcgcagagcatcatctattgctgctcggcaagcagcaaaggcacagcaatcttaggagactaaacccgtttcatcttcgcccaagatcaagcgtcaaacatcaatgagatct

SEQ ID NO: 3127 - DNA, 328 bp, Zea mays
  Clone ID: LIB3228-010-P1-K1-C12
atcgttggttgtgctagtaatatctgtgggcacccgggtcatgattacgctgcagttaagtgtgccagatgccttggttacatgtgaggctcatgacactggaaaatgtgacatggacctgtcttagcctcgcggaaaaaaactgtaacttcgtaagcgtagccactcctttaaatatatattcctaacaacgctgcccgtttatagaaatttaagcatttgtgggataaaccaagcattgattttgaattttggagaagaaagttgggatttatataatttttgtgagaaactgagatccaacctatggggggttacgttttattat

SEQ ID NO: 3128 - DNA, 412 bp, Zea mays
  Clone ID: LIB3228-010-P1-K1-C2
attacacatgacaagctagactgttgtcacattgtttttatttggctcgactagcggcccaccaaagacataatcccacaagaggactaaacagagctctatcaacttcgacagtacataatcacacgttcttcttggtagcaaagtagtgctatatggctacaccaggtgtacaaaatagtacgctgatgttacgataatggcatatttgtataatcgtttggtctcctgatctgggaggcgcgcacgcagcggcggatcctcggaggcgtgtgcctaggagtggcgctcgctggcatcccaccttcggcaatgacgtcagtcttctctaggcgcgagcgactatgatggacttacctaagcgtgagtggtggtggatcgactaccctttttttatgcaacctagtataca

SEQ ID NO: 3129 - DNA, 357 bp, Zea mays
  unsure (1)..(357): unsure at all n locations; Clone ID: LIB3228-010-P1-K1-C5
ggccatcatagataagacatttgaagatgcttgtgcggnttaggatggaaaaataaataaagaggagtggaaggaatttgcgttacgccaccctaacctgttaaagaatatgacactgccttatctgagggacatcacaaccggcttccctagtttcgtcttcaacacggcggtggaagattagtcgctccaattgaaggcaataaagcagtactggggattgcttgaggtgcacaaggttcctgaaacctgacggctgttggtcgccttcaaccactgagaatccgatgtgttctgagcatcaaggcagccgccacctgaccatcactcctgctataaattataatataaattata

SEQ ID NO: 3130 - DNA, 435 bp, Zea mays
  Clone ID: LIB3228-010-P1-K1-C6
aaaaaaaccagcagctagcgatggctggagcccgggcactgctcatcgtcctcgcggctgccgtcgcggtcctggccgcgcggccggcgtctgcaggcgggggagccgcggcggtggcggagatctgcatgaagactccgtcccccgacctgtgcaccaggacggcggggaagcacgccaacaagtacaaggtggtggacgcggtgacggtgctagagatgcaggtggacgcgttcaagaagcgcgtgaaggcggcgcggaggctcgccaaggaggaggtcaagacggccgcgacgcccgaggcgcggagggcgctgaacctctgcaagacctactacctggacgccggcgacaacctcggcgcctgcaagcgcgccatcggctttcgcgacgccgtcaccattcgcgccacgatgagcatggtggcgcaagaca

SEQ ID NO: 3131 - DNA, 379 bp, Zea mays
  Clone ID: LIB3228-010-P1-K1-C7
cacacactggcgcgcacgctgtctgatagactaaagatattgccagcttgtgacaagagcaaaaacaccatcatccgattcggccgtctaaactccaccccgatggcccacaacacgaggacagtgacgctggccctgagagtcctccgcgcgtggcaaggcaccatctgttcccacccccaccgggtacggctggtacagccacaggtacaagcggtgcggcaaccctaagaaagacaaccccgtcttcaacaacatgtgctttcagaggtgcggtagctccgacaagggagacggcgtacgcactgacgcttgttcaaacgggactttatactcacgcgaactcaaattgctagaccgatcatatacacttggtgct

SEQ ID NO: 3132 - DNA, 425 bp, Zea mays
  Clone ID: LIB3228-010-P1-K1-C8
gcatgatgaagatttctctattaaaaagtgtctagaggagttggatacaattgatgggctgacagatgaggatagatcatatgcaatggaagtctttgaatctgggttcaacagagaagtgtttatgagttcaaaaaaccacaatgttaggttgttttggctcaagagaaaaattaaagcgcttgctgctatcatgtgatgtgaagtgaatgtggttgtgaagagataggcttacagaaaccgaagacatccaactgctagtaccgttccagcgagaagacttcagccctgctttcagagtgcttggtgaacgatggaaggcctaggatgctgtttttgtttatgttgcttagagacggatattggaacgaggatataccttgtttgtacggtatcgtgctgccaaaattaatgcgttttaagca

SEQ ID NO: 3133 - DNA, 79 bp, Zea mays
  Clone ID: LIB3228-010-P1-K1-D11
gaagctcctgcacgcatgttaattatatacatatatatatacacgtcggcatatgacattctcttgcactacaaaccta

SEQ ID NO: 3134 - DNA, 375 bp, Zea mays
  Clone ID: LIB3228-010-P1-K1-D12
cgggcaatccagtcacggtgtacatcactgacatgaactacgagcctatcgctccctaccacttcaacttgagcggcaaggccttcggctccctggcaaagcccgggctcaacgacaagattcgccactgcggcatcatggacgtcgagttcagaagggtgcgatgcaagtaccccgccgggcagaagatcgtgttccacatcgagaagggctgcaaccccaactacctggccgtgctggtgaagtatgtggcggacgacggcgacatcgtgctgatggaaatccaggacaagttgtcggctgagtggaagcccatgaagctctcttggggcgccatctggaggatggacactggcaaggcgctcaagggcccct

SEQ ID NO: 3135 - DNA, 96 bp, Zea mays
  Clone ID: LIB3228-010-P1-K1-D2
atcgaagccagtctatataaacttatttcctagctcacttttttattcgttgtccaccgacttttaccgataataaattattcacttcattctatc

SEQ ID NO: 3136 - DNA, 431 bp, Zea mays
  Clone ID: LIB3228-010-P1-K1-D3
atcgatgcctagtctatataaacttatttccttgctcacttttttattcgttgtccaccgacttttaccgataataaattattcacttcattctatcaaacaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaggggggccccttttaaaagatcaaagtttacgaacccgtcaatgggtagttaaagttttttttaagggcccccaaaattaatttaaggggccgtcatttaaaaaatgcggacatgaaaaaaccctgcgttacccaaatatatccccttgttaaaaaatcccctttttccctgctggggtattagcaaaaaggcgcgccccgacctcctttcc

SEQ ID NO: 3137 - DNA, 361 bp, Zea mays
  Clone ID: LIB3228-010-P1-K1-D4
catgaagtgatctaaaattaattactactaatgctttatcaatggtgtttatgtaccgtcgcaacacacggacaactaattagtaaaacataaatagaaagagaaacaccgaacccaacccaaagaaacagaggtctctgacggtcgcgcggcaactacccgatcgagctgctccggcctccggctgacgctgtcccacggtcgcatgtagatatacggtagcgctgcttggctaggcctgtgtcccatgggcactggtgtggaacaccatccgtgtgcgccccgaccccgatcagttgcccttgccgacgggctttttctcgctgtaggcgccgttgacgctgaagctgctgagagtgcg

SEQ ID NO: 3138 - DNA, 321 bp, Zea mays
  Clone ID: LIB3228-010-P1-K1-D5
taaaaaaaaataaaaaaaaaaaaaaaaaaaaaaaaaaataaaataaaaaaaaaaaaaaaagtaaattaattaataaaaatatattattaattaaataatatttatttattaataattaaattatttaaatttttaatatatatattttggggggccttttttaagggatccaattttttgtcccctttgttggcaataaatatttcttttttgggtccccttaatattatttaatgggtggttttttatatagttggttcgtggaaaaacctttgtttcccaattttattttcctgggattatttccgctttttttatttt

SEQ ID NO: 3139 - DNA, 247 bp, Zea mays
  Clone ID: LIB3228-010-P1-K1-D6
cccacgcgtccgggcaagatcggctgcagctcagagtggaaccccaagatgagaggaacctcgcttattggcccaaacaccctgattctttcagatgggaatgcggatgaagaatttctcctccttgatgtaacattgtgtttgtttgttatatttacttcctgggtattatgtttaattgttacttttcatgatcgaatggaattgaaatttatggtctaaaaaaaaaaaaaaaaaaaaaccataa

SEQ ID NO: 3140 - DNA, 313 bp, Zea mays
  Clone ID: LIB3228-010-P1-K1-D7
gtcgattgcctgcaaatctgatccaagcgcagagggatctgtttggtgcacacacctatgagcgcattgactgtccgggttcattccacaccgaatggaccaagctggcgaggaggagcaatggcgcagccatttgaggaattggttggtatgagcagggatgttttctgctttgggtgatttctctctgtgggttatctttccttttactattgttatctttatgcttctagatccaagtcgagtacttcgaataatgctgtactgtatggttggcaagtgaagaacattgtgtagcttcagttttactgtg

SEQ ID NO: 3141 - DNA, 377 bp, Zea mays
  Clone ID: LIB3228-010-P1-K1-D8
agaggacacaagcttacgcacgcgtgcatgcgccaagctaactttaacatcgtgacccctctactgaaggcactgctcgtcctgagacaacgcgttgacgacgctaaccccatgccaacccagcttaactaccacgcgacagatgcccacttgcccagctgacagaacaaggaccagtgccgccccgatcgaactccaaaaaatacacgcagcctggctagccaatgggacgctccctgtacccgcgcttttaacgcagcatatgcatatagcacacgcattgcttactatagcatgcaccgcgatatagcgcccgattgctttgctgttgtaagtgccatcacaagcatatataccgggtttatctatactactat

SEQ ID NO: 3142 - DNA, 422 bp, Zea mays
  Clone ID: LIB3228-010-P1-K1-D9
ctcgatctcgcgctaggttttcgccacaccgctctcgtcctccgcgaagatgccgaagaacaagggtaagggaggcaagaaccggaagcgtggaaagaacgaggctgacgacgacaagcgcgagctcgtcttcaaggaagacgggcaggagtatgcgcaggtgacccggatgctcggcaacgggcggtgcgaggccacctgcgtggacggcacgcgccgcctctgccatatccggggcaagatgcacaagaaggtgtggatcgcggccggggacatcgtcctcgtcggcctccgcgactaccaggacgacaaggccgacgtcatcctcaagtacatgaacgacgaggcgcgcctgctcaaggcctacggggagcttcccgagacgctcaagctcaacgagggcgtcgacgtcgatgggcccg

SEQ ID NO: 3143 - DNA, 429 bp, Zea mays
  Clone ID: LIB3228-010-P1-K1-E1
catgacagtatcatggaggggtatgaagaggaaaaaacagtgcttaacattggggaacatgttgaatctttagcgtgaaaacattttgttatgtcagtcaaactcctggaattcttttgcttttccgtaggacctttactaaggacttgcctgcgatgcattataagattattgattgcttaaattatgtgttataatatggtggtggattggtactgagtatcggtggttgcgttatcaaaaaaaaaaaaaaaaaaaaaaaaaaaaaaaaaaaaaaaaaaaaaaaaaaaaaaaaaaaaaaaataaaaaaataaataaaaaaaataaataaattaaataattaatttggggcggcccttttatagttcccaagcttactttcccgggtttgcgacgtatttttttttatttgggggcccctaatacaat

SEQ ID NO: 3144 - DNA, 147 bp, Zea mays
  Clone ID: LIB3228-010-P1-K1-E10
aatctattggttagtgtagccctagtgtctagttagtttgggtatctatactgttattttgagacatgttgacttgcatggtcatctggattgggttcgcatttctgagtcatttgtcttgacatgaaaatcttgctttttttcttg

SEQ ID NO: 3145 - DNA, 317 bp, Zea mays
  Clone ID: LIB3228-010-P1-K1-E11
gaagctactgcaagcatgtgaattatattcatatatatatacacgtcgccatatgacattttcttgcgtaaaaaaaaaaaaaaaaaagaactaaaattaaaaaaaaaaaaagaaaaaaaagagattgagaaaaaagagagaaaaaatggaactggcccattgaggaaggttgagaaccagttaacaagaattgccaacatatttttggacaaggggggtaacaaagtgataagggtttccaacaaacattcttggagttcaggaagagtgggggcggccaccaatttcattatttggtgacaagcaaggtttagaga

SEQ ID NO: 3146 - DNA, 374 bp, Zea mays
  Clone ID: LIB3228-010-P1-K1-E12
attacgcgtcgggtcacgcatgctcttgggcgtgactgtcaagctgtttcctacagctctcatctgacttgttcatgcgcacattctctaggcggcagctgttgtgctagcgtctcctcttaactccacgtctttgagaaaaccattggcggagatgagttctaaccagtctactgtcaaggggcatgccaggagggagaggcctagggctcgccctcatggcgctagcgcacagaggaggcaggaaataaaggaagcttttgatctgttctgatacatataactgtggtaccattgatacacaagagctcaatgttgccatgagagccttgagatttgagatgactgaagagcaaattaggctaatgattgct

SEQ ID NO: 3147 - DNA, 179 bp, Zea mays
  Clone ID: LIB3228-010-P1-K1-E2
ctcctgctcgcggaaagtgagcttgactgttgccggggtggaagtatcgttttggactgatgcatgagtgctgcggaggggtttgttgtttgtttgtttgttcggtgaccgaatcgcgagctggacgcctgtttaatccgtgcttatacatcgtctgagtaaacagcaataagagggac

SEQ ID NO: 3148 - DNA, 284 bp, Zea mays
  Clone ID: LIB3228-010-P1-K1-E3
cggacgcgtgggttcgtggtcggcatcctccacctcttaaatcctggtgaggaaaccgcaaacttttgttgtttctgttcaaaggtggtacccaaggaagagccccatcagtgaagttggtcgcgggaggaagtttgcctcccactttgaaaacaataaacttttgtgcgggaggtgttttgccttcctggcctgtaataataccttatgcactcgtaataccctggtattgtaataataatactctctctatatatttaatgaatgtaaattaagttattgtc

SEQ ID NO: 3149 - DNA, 424 bp, Zea mays
  Clone ID: LIB3228-010-P1-K1-E4
cccacgcgtccgcgcgacgggacggcccttgtgctgtgggagtggtgcgagggagacaaccagcgctggaagattgttccctggtgaacaaggaaatgtgtgaccgagcccgcaccaaggaggagctcctgccgtaataagtgaagtgattggtactgaagtttctggaaataagaggctcttctgagatgcctgtttgtgtgagtatttgcgtttccattccgttttcatgataataaaacgcattgattattaatatatgtaatgtgatgctacactgagtggcagcgttggtatatatttgtaagaattaagaacccattgttgttggactaagcgtgacgagtgatgtactgatgtatgaacctttgcttgatgcatatgctcttctgctccaaataaaataaatatttttattggggcg

SEQ ID NO: 3150 - DNA, 434 bp, Zea mays
  Clone ID: LIB3228-010-P1-K1-E5
cccacgcgtccgctgggctccgcgcaacgtgtgtggaagatggcacggtaaaccaggaaccgatggccgcttcgaccgccattgccgatcggaggatgaacaccagcacctaagaagatgtgagagaccgagggagagagaataagaacgccctgtgcggatctccctcaaacgcgagacgctgggatggatgacctcggggccgcgccgctcgcaaattttggcccgcgccttgggaatttctcgccatcgaagttaaatccgccgtagatccgttttcgccgtggccagaggattccgcgccgctaagcttgcgtgaggttacgagtcacctgaagatcatcctggtatctggaatctcaagtcccaggtcaagaacaggtaccgcaggatgaggcgcatggaggatgctgcgacgagttcgagagaggtct

SEQ ID NO: 3151 - DNA, 439 bp, Zea mays
  Clone ID: LIB3228-010-P1-K1-E6
accaaaccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgtaatcgtgtccactcgatcgagagatcgatcgatgcttgttattatatttgtattccacattatatataagaaatacaaattaaattaaa

SEQ ID NO: 3152 - DNA, 422 bp, Zea mays
  Clone ID: LIB3228-010-P1-K1-E7
cagagccatgcggtgcttgccctccaggagagctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgtttaaaaaaaaaaaaaaataaaataaatacattaattaattaaatcaattaatttatttatttaatgatctaaataaattaatattggggcggccgctttagaggaaccaagtttacttaccc

SEQ ID NO: 3153 - DNA, 362 bp, Zea mays
  Clone ID: LIB3228-010-P1-K1-E8
ggcaagcgggccagctatcttcagtctcacagttggagagatgtgcaacaggaacccaaggacaatcactgcggaggcaatggcagttgaagccatggagaagatggaggcaccaccttcacccgtgcagttcttgcctgttgtcaacgagaacaacgtcgtgtgtggaatcatcacattgcatggattggtctctgccggattgtagacttgtgtggcaccattacctgttagctagctgttaccgctggagtatttatgtggagcctgaactcttcagtgtacccttatgtacagtatagtggtcgctaagaggaacatggtacactgcttataatgcttgtgtttttgtacttaatttt

SEQ ID NO: 3154 - DNA, 426 bp, Zea mays
  Clone ID: LIB3228-010-P1-K1-E9
cccacgcgtccgatcaaaagtggtggatatgtacaaagaggcttttgaaagcatcgagatcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagcagatgattactttgagaagtaccctgaactcaggaagaagtttgatgatgaaatccgtaacgataactggggatattgaagagattggagagaactcttatgatgccatttccatgtccgtgaagaaccaataagtttcctgtggcctgaattgggtggtttccatagcatgtgcacggggtttgggtggaatgcctacag

SEQ ID NO: 3155 - DNA, 428 bp, Zea mays
  Clone ID: LIB3228-010-P1-K1-F1
cggacgcgtgggtggatgtgctggtgttgatgcaagaaccggtgatacctggctgttttcttcgggcaagggccatcggccttatgcccatgattgatcagggtgagaaagatgataagataattgcagtttgtattgatgatcctgagtaccgccacttaaccgatctcaaggagctttctccgcaccgccttaatgaaatccgtcgcttctttgaagactacaagaagaacgagaacaaggaggttgctgtgaacgatttcttgccaccaactacttccctggaggccattcaacactcaatggacttgtacgctgaatacatcctgcacagtttgaggcgctagatctggtttccagatggaacagtccctctcctggtctcaggggggaaaaaaataagcaataaccgaccagtctcctggctt

SEQ ID NO: 3156 - DNA, 341 bp, Zea mays
  Clone ID: LIB3228-010-P1-K1-F10
cccacgcgtccgcccacgcgttcgtccactcgtgcgaaaaaatacataaaacacagaaagaactgcaaataaaataaaaagctgttacccccagacaggatttattctaagttaaaatcctaaggaaaaaaatggtagcatcttggtgctgcaatttaaaaaaaaaaaaaaaaggggggcgcgccgttgtagaggatccttgcttacctgcgcgtgcatgcgatttttctttttttttttgtagcgtcaactaaattcaatgggctggccgttttaatacaacgtcgtggctaacccatccctggccccacctaactgaattggcttagattccattttcc

SEQ ID NO: 3157 - DNA, 429 bp, Zea mays
  Clone ID: LIB3228-010-P1-K1-F11
gtcgaaatcgccaagtgggctcatcgtcggggtgacggggcgggatccgcgccgccggcgtgggacttcacgtgcggggacgctcgggacgaaaaggattggcgagggaccttcacggatggaccagggtggtggtcgtcgtcacgacgaggaagatcttcggccgatgagcccgttatttttcaccggagttcctcgtggccgcggagtcgcccctcgtcgtgagtagtgctctctacgcctccaaccgccggtaacttcgtcttgaggatggaagtcttttcctcatgatgaacacatacgagatgaagatacgatctaagcatgataagaataaacgccgaaggtatcaccagattgatagcttcggcttgtaatgatgatgaagtatgatgatgatgctgaccgaaggggaaaaagactacttgg

SEQ ID NO: 3158 - DNA, 398 bp, Zea mays
  Clone ID: LIB3228-010-P1-K1-F12
ccagattgttgcctcaatacctgggactttgtgaactccaccgagagtgagtggaagaatggagcccgccagacgatgagattatcattccactcttttggaagaaaacgttttatagaaggaagcagtgttgcggagagagcaacaatgcctagaatgaaaaaggaacactggattctcttatgtgtggtcaaaattcccaagagaatgcaacgaaaatgctagaggaggtcaacagaatcctcaaggaaaatggtgtctacatgctgatcacttatggggatccaagttaccgcttgcgtctcttgaaggacatggaaaaatggacagtaaagctccatgtcatagaaagatgggagaaaagttcgaatcagaacaaatgggaactgacaaagcca

SEQ ID NO: 3159 - DNA, 313 bp, Zea mays
  Clone ID: LIB3228-010-P1-K1-F2
aagccctttttctttcttctttctcttattattatatattctatggctaggttctatctgcatggggttagcatcttagcgtgtaaaattgtataatttggtgtgtgttaactcaagaaaaattggagctgtgatatataagtccttgaaaaggacgggaattttgctctcagagagtgacttatgcttctacccttaaattggaccgaattgaagctaaataaaaaattaaaaataaaaaaattaataaataaataaattaattaataaatatataaaaaatatgtatattaaatcaatgattaaattattt

SEQ ID NO: 3160 - DNA, 237 bp, Zea mays
  Clone ID: LIB3228-010-P1-K1-F4
tttggctcttagaaaggtccctcagagtaacagctcatggatgaatgattttattcgccaatatcacaatgtgaacatcaacgtggctgtgcagactgaacacggattgtttgttccagtaattagggatgcagacaagaagggacttggtacaattgctgaggaggtgaagcagttggctcaaaaagcaagagacaatagcttaaaaccagcagattatgagggtggcaccttcac

SEQ ID NO: 3161 - DNA, 433 bp, Zea mays
  Clone ID: LIB3228-010-P1-K1-F5
cccacgcgtccgcccacgcgtccggccgcctctcccgacgccatccccacgagcgccttctccgacgccgtctccgctccgccgcattctccgacgccgtctccgctccgccgtcttctccgacgtcgtcaccttcccctcgacaaggttgcttagaagcagtgtgcagtgatgcgaggcatggatgcgagagtgcaaagtggaagcaacacatgaagtcgacatggagaaggaaaatgcaatgacagtccacatgaaacttgtgaaaaaagaattaaatcccaaagttcctaatgaagagacttgtattacagttttatgttatattgtctatctatttgtgagaatggagatgaccttgctggatggattagcttcgttaatgctttagtttgctgctgctgcttcagtttgctactgatgatgcttctac

SEQ ID NO: 3162 - DNA, 415 bp, Zea mays
  unsure (1)..(415): unsure at all n locations; Clone ID: LIB3228-010-P1-K1-F7
cccacgcgtccgcggacgcgtggggtaaagcggttgtaaattaattagcgtgagcagcatctgtaagttgacatcaacttggttggttgtgtgtgtgtagattatagagaaagagagtgtcaatgtaacgttaattcctgngccaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaataaaaaaatataaaataaagtaaataattttaaaataaaataaattaatttataatatataggggggggccattttttgaaacccaaaattttctctccccgtgtagttgggttattttttttttttttgggtcccttaattttatctattcggggggtttttttaaacggtggt

SEQ ID NO: 3163 - DNA, 425 bp, Zea mays
  Clone ID: LIB3228-010-P1-K1-F8
aacggcgccatcttcaatccgtccggcggcgcccccaagcaggtcgacaccaacgagtgggtaaagcccaagccaggaacctacgttacaaggctcacccgcttctccggcacactgtcctgctgcacgggcaagccgtgctgaaggccggtgggcatcaggctgcttcttctagctcatggcctggccatgccaggtcgcgctggctgcgtttcatttcatggaagaaagcaaggatggatcacaggttgtcgttctgctaattaatctacatacgtttgccttcaagtactgtgttgtggcattgttacacatcacagtacagtttggtcaaatttttttccacagaggaagtagggattgatttaatcattgatttaatcccacacgcgtgtatctacgtatacagtttgtataacatgaac

SEQ ID NO: 3164 - DNA, 333 bp, Zea mays
  Clone ID: LIB3228-010-P1-K1-G1
cccacgcgtccgcccacgcgtccggggatgccctagatcagttcttcatctcaagacaacgtggtcttcccatccaagcgaatttggtggccactagctcgtcatcgacagtgcttcttgctttgagtttgagatggcctttccagctcaaccagtttcttgcaagccttgtaactctgtgtgtacatagtttattttttcatatagagagagagtaaaaaggaaaggctaattattcatcacaaaagctgttaacagtgcattgaggcggcttatgtcaatatgtaccaaactacacttgttttaataattcaaggcactaaattccctatc

SEQ ID NO: 3165 - DNA, 169 bp, Zea mays
  Clone ID: LIB3228-010-P1-K1-G11
atttgctagctagcgggccttacgttattagctgattgtggacaagacaatcggcgagtcttacaccacataaatgttggatactataggactgacctggactgctgcatttctacttacatggttgccaattagtatcaaaattttatgtggggtgagactcgacgat

SEQ ID NO: 3166 - DNA, 410 bp, Zea mays
  Clone ID: LIB3228-010-P1-K1-G12
gcatctttgatgccaaggctggtatcggactgagctcttctttcatgaagctcgagtcttggtatgacaacgagtggggctacagcaaccgggttctggatctgatcgcccacatggccctcgtcagcgccgccgccaagctctgacgtccgtgctcgttcctccagtagtagcctaagagaaaggctgcaattttgacggccattttctgttagctgttgtgtggaataaagatcaaatgctggaacacttcgaactcgcacgagactggactcagatccatggcctgtattttagttgtagaaaggggcaaatttgcaccgtagtaccatggcatggctatatgcggaactgttgatagatgagtcgctgtacggtttgtcgacttgatgatatgttgatgtgggagc

SEQ ID NO: 3167 - DNA, 168 bp, Zea mays
  Clone ID: LIB3228-010-P1-K1-G5
aaaaaaaaaaaaaaaaaaaaaaaaaaaaaaaaaaaaaaaaaaaaaaaaaaaaaagggggggaataaataattttaataaaatgggcggccgtttttggggttccaagctttcgtccgcttgcttgccccttctttgcttttttttggtgtcacctattttcattttat

SEQ ID NO: 3168 - DNA, 379 bp, Zea mays
  Clone ID: LIB3228-010-P1-K1-G6
cccacgcgtccgagaagctgctgctgctgcccctgctgctccagcgatgaatgctgatgcttgcagcttccattctaaggctttccaagattgtctcaacaactatggcagcgagatcagcaagtgccagttctacctagacatgctgaacgagtgccgccgaggtggtgtgtctgtctaagctgcctctgggattattcatggattttctttccggatgggggtatctcattaataaggcaccgcgaaacttcgaccatctccacagctagaaaccaaacttcctgggattaatttattttgttatcctatggtgttggaacagactttttgtctcttgatcataaatatttaaacgaacctgttttgttgaagtaaa

SEQ ID NO: 3169 - DNA, 374 bp, Zea mays
  Clone ID: LIB3228-010-P1-K1-G8
cgtttacctgaagcacaagaataaacgcagccgggcatgggcgaagctaagctgagcaacgtgaccgtcctgctggtggccctcctcctcctgagcagtggcgttcaggacgctgccgccatgccaggcacgttgaactacgacgcgattgtcgccgacgagccaaacggaaagaacaaggacctgtaccgccccgtcgccaacgccaataaatacacccgcgggtgcgagcccatagaacgctgcaggggcgcgcgctgatcaccaagcatatacatatagcacatcgatttcttattattgcatgcacgtttatataagtgctcattgtcttgctgttgtaagtgccagcacaagcatatatacggcgttta

SEQ ID NO: 3170 - DNA, 417 bp, Zea mays
  Clone ID: LIB3228-010-P1-K1-G9
cccacgcgtccgtaaaaaaaaaaaaaaaaaaaaaaaaaaaaaaaaaaaaaaaaatggggtaaataaaaaaattaaaaaaaaaataaaaaaaaaaaaaaaaaaaaaaaaaaaaaaaaaatttatatggttaaatataaaatataatatatttggggggggcctttttaggggttcaaggtttttctcccggggtttgcggcttttttgttttttttttgggggcccttatttttatttctcgggcggggttttaaaaccggggggttgggtaaacctttgggttgtccctttttttttttgttttggggaatagttccttttgtgccattgtgttatatgttaaatggggcttccctttttctcttttcaattattgcctccttttttggtttgggactccctttttgttgttttttt

SEQ ID NO: 3171 - DNA, 71 bp, Zea mays
  Clone ID: LIB3228-010-P1-K1-H1
tcgcccacgcgttcgcccacgcgttcgggtaagccgactccgtcggcggcggcggcgatcatggccgcgca

SEQ ID NO: 3172 - DNA, 434 bp, Zea mays
  Clone ID: LIB3228-010-P1-K1-H10
gaaagataccacgatctctggagcaaatttttcaagctagccagacacttaactcacagggctggagatataagatgcaggcctcaatgttggagatttacaacgagactatacgcgacttgctagcaacgaatcgcatggctgctcaagatgttggggcttcaaagtacagtatcaagcatgatactaatggtaacacgaatgtgtcggaccttacgatcattgacgtaactagtatcaacgaagtttcttctctccttaggcgggctgctcagagcagatcagttggtagaacacaaatgaatgaggaatcatcaagaagtcactgtgttttcacacttcggattttcggtgtaaatgagggaacggatcaacaagtgcaaggagtgctgaatcttatagatctagcaagcagtgagcgcctgaacaaaagt

SEQ ID NO: 3173 - DNA, 433 bp, Zea mays
  Clone ID: LIB3228-010-P1-K1-H11
cccacgcgtccggggcgatgacctcttctacgagcacacactgaccttgactgaatctctgtgtggcttccagtttgttctgactcacttggataacaggcagctgctgatcaaatcgaaccctggcgaagttgtgaagcctgattctttcaaggcaatcaacgatgaaggcatgcccatgtatcagaggcccttcatgaagggcaagctgtacatccacttctcggtggagttctcggactcgttgagcccggagcagtgcaaggccttggaggctgttctcccgcccaagccagtatcacagtacactgacatggagctggacgagtgcgaggagacaatgtcgtacgacgtgaacatcgaagaggagatgcggaggcggcaacagcagcaccaggaggcctacgacgaggatgatgatgtgccaggcggt

SEQ ID NO: 3174 - DNA, 263 bp, Zea mays
  Clone ID: LIB3228-010-P1-K1-H12
cgagggactatcgggcaatgaggacgacgacgatgactccaccaactaaagccaagcacgtcggtccgattgcatttggaacaagatatgaaagaaaagtgagagcaatgttgtttaaaaccaaaaatccataataatgtgtggtcatccgtgatatgttcttgctctccctctttttctttctgtttgatttcgatgtgttatcatgttcttagcctctaattgtatcaattcttgatatcaaggactccaaaattatcgtt

SEQ ID NO: 3175 - DNA, 425 bp, Zea mays
  Clone ID: LIB3228-010-P1-K1-H2
cttgattttgctgcaattgatggggattctgaagctttgttggtggaaagtagggtaaatttaagtcggatacctaattccccagaaagtacacattgaactcttcctatttcattttaattccttttctgagggtcttgtgccctcagcctaaaaaaaaaaaaaaaaaaaaaaaataaaaaaaaaataaaaaaaaaaaaataaaaaaataaaaaaaataaattaaaaattaattaatagataaaattattaaatgatgaaaaatgcaaaaaacttaattcaatcattggggcggtcctttttgagggtctaagttttcttcccttcgtttactcggtaattgctttttttattgcctccctaaatttaattcattgggcggttttttcaatcggttatctgggaaaacccggggtttcccaaaa

SEQ ID NO: 3176 - DNA, 434 bp, Zea mays
  Clone ID: LIB3228-010-P1-K1-H3
cccacgcgtccgcccacgcgtccgggcggagggaagcgtcgtctaaattccaaccctaggccatggcgaatgcggcctcatccgcctcgtcgccgggggcaggttcctccccctcgcagcaggccggtggagacgggggaggggacgcgcacacgccgcggcagcggcagggccggcccccgcgcgccggctccgacccgctcctcatcgtctgcggctgcttcagcgtcgtcacggtcgccaccgcgctcctctgcgtcgccgtcaacgtcgtcttcgccgtccagtccttccgagccggcttcgacatattcgggggcatatttcggtgctacgcgggcgttttgtcgtctttcgtcgccgtcctctgagaccgagtgggggttcatcattccgttctggaagatatttgaatactggcctgcacggggaat

SEQ ID NO: 3177 - DNA, 388 bp, Zea mays
  Clone ID: LIB3228-010-P1-K1-H5
cccacgcgtccgcgcgtgcaagtactcgatgcctctagctgcacccactgcgatcttcatccgtgtgtgccaggaaagtggctgggatttcggactgagatcgaggagatggtcttgcagtgaaccgagtgacatgtactcgtacactaggatcctctggtcacagtctgtgctgtacccgaccaaggtgactaggtttggatggtgcagcaggctaagcatcagcacctcgacgaggaactcacggttaccttgcagcccatctttgtcgagctgcttaaccgctatgacttccatggtgtttggaatgcatcctttgtacacccttccgaagccgccctcgcccagcatgttttttgggcagaaaagagtggtggcgtccaccagt

SEQ ID NO: 3178 - DNA, 423 bp, Zea mays
  Clone ID: LIB3228-010-P1-K1-H6
ctttctgcaaaccatctgcagaaactgagtttatcttttcaactaaccacaccgcttgggcacacatttaaacctcaccaggtgttcttgaaattgaggcatgagagtaaggttgaacacttattcgtggtacctggctctgcaaggcagttcaaaattgttcttgacttcctaggtttggtggagaaattttactacctttctggaagatatgaccttgagcttaccgttggtgatgctgtaatggaaaattcatttctacgacctctagtccatttggagttggacctgccagatgccccagaaaaagccccacgttcttctgcacaagctagttgacccattctcaaaatgtagggccaaaggcagagatttcacatatattccgcgcaccatagaagagccactcaagagcttttgcta

SEQ ID NO: 3179 - DNA, 287 bp, Zea mays
  Clone ID: LIB3228-010-P1-K1-H7
cggacaaacaaagagcacaggagctggatgggcagcattctgacgatggatgcatgatctactgctactattggcatttgtttatctgaagaaggggaatgggtagttgaagcaccgaacaaggatctggaactgctggatgcctctacccctttcgaaactgaatggttaaaatgattgatcaacctaccagttccagttgtcacttgtcagtcgagaaataaacctttcccagagttgtattacccgtctcaccacatgaatggatgctcacattttctggattt

SEQ ID NO: 3180 - DNA, 416 bp, Zea mays
  Clone ID: LIB3228-010-P1-K1-H8
gtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacggtcattatcttcgtcttatttatgacgaatgtcatgtatgttctggggactgacatgtatattc

SEQ ID NO: 3181 - DNA, 194 bp, Zea mays
  Clone ID: LIB3228-010-P1-K1-H9
taaaaaaaaaaaaaaaaaaaaaaaaaaattaataaaaaaaaaaaaaaaaaacaaatatataaaaaaaaaaaaaaaaaaaaaaaaaaaaaaaataataaaaataaaaaggggggccctctttaaaggttccaagcttacttcccctggcttgcgactttattatttttttttagggccccctaaattcatttcat

SEQ ID NO: 3182 - DNA, 230 bp, Zea mays
  unsure (1)..(230): unsure at all n locations; Clone ID: LIB3228-011-P1-K1-A1
aataaattttggctctttgcatgggaaaaaaaaaaaaaaaaaaaaaaaaaaaaagggaaaaaaaaaaaaaaaaaaaaaaaaaaaaaaaaaaaaaaaaaaaaaaaaaaaaaaaaaaaaataaaaatataattttntnnnnaaaaaaaaaaaaggggggggccgttttgggggtcccaggtttacgtccgcgggctggcgcgggaatagtttttttttgggggccccaaaat

SEQ ID NO: 3183 - DNA, 139 bp, Zea mays
  Clone ID: LIB3228-011-P1-K1-A10
ttcaggggttacctcttgtctctctctatctctatcttttccttttgattaaaagcaagtgaattaggggtggaggtcaaactcaacataaagaatccaaacaaaccaaaacctaaaataaataaaaaaagaggaggac

SEQ ID NO: 3184 - DNA, 402 bp, Zea mays
  Clone ID: LIB3228-011-P1-K1-A11
ggagtacgcgaggacggtggtgatggacagcaccatcggcgacctcatcagggcggaagggtgggcggagtggatgggctacctcggcctcaagacgctctactacgccgagtacgccaacaccggcccggacgccggcaccagcaagagggtcaactggccaggctaccacgtcataggacaggccgacgccactccattcaccgccagcgccttcatcgacggcgcgtcatggctgcagagcaccggcacgcccaacgtcatgggattcaccaaagggtaatgatcgggggattgcaggatgcatgcgatgatgatacgcgcgcgtgtcttcatgcatgcaacatgcttgtgcgtttatgcggaaactgctagcatttttgcgcgcatatatatagctgg

SEQ ID NO: 3185 - DNA, 402 bp, Zea mays
  Clone ID: LIB3228-011-P1-K1-A12
ggcgagaaagggaccctcggcgaggccgcggacatggggaccatccataacctgggggagtgaggggacgccgaccggccatatacgatgacctaaccgcctgttgctggtggtggactgcatgtttatcaaaagttatagctcctgctcgcggaaagggagcttgactgttgccaaggtggaagtatccgtctggactgatacatgagtgctcccgacgggtttgctttatgattagttggtcaggcgccaaataacaagatgggctccatctataatgcccagctcatacagatggctgtgtgcacaccactaagatggacatgcgtactttcttgcatgcaacatgcacatgcattaaggcgggcactgttagtgatccacacttactatctcttgcat

SEQ ID NO: 3186 - DNA, 242 bp, Zea mays
  Clone ID: LIB3228-011-P1-K1-A2
attcgccgcttgatgtgtggatccgtcgcggctgccgtcaagcatagacaccaagaaccagacctcggggtggatcatcggggtcgcggaggtctactggatggggtcaagaagtatccgggcaagtcgtctctgggaaccctgcttattgctcgccggatgctagcgccgccgtggactgcgcggcttcgagaagtcgaggtcgtcgcgacatattccagtgaaatatatttacaggaacc

SEQ ID NO: 3187 - DNA, 369 bp, Zea mays
  Clone ID: LIB3228-011-P1-K1-A3
cccacgcactggaacgcgatgaggctgagggagaaagaattggctgctgtgaagatcaaccctgccgatgtcgaaattatcgctactgagcttgagctggacaagaagatcgcggagagaacgctccgtgagcacaagggtgatgccgtggctgcggttcgattactgctgcgctagttccgagatttcgtcgccagcatcatatgttccccttcagttcctcacaagaggtggtgatgtgaagcactagtacttttgtctgtgtgcctgttttggaagtttgctattagaactatgttgcagaaaatttaagaatgagaataccatgcaaaaggtgtaatatgaattgtattaattatttgctattag

SEQ ID NO: 3188 - DNA, 404 bp, Zea mays
  Clone ID: LIB3228-011-P1-K1-A4
gcgccacccatcagcgtctgcggcaatggcgggcacggtgacggtcccggggtcgtcgaaaccctccacgccgctgctcaaggacgagctcgacatcgtgatcccgacgatccgcaacctcgacttcctcgagatgtggaggcccttcttccagccctaccacctcatcatcgtgcaggacggcgacccgaccaagaccatcaaggtgcccgagggcttcgactacgagctctacaaccgcaacgacatcaaccgcatcctcgggcccaaggcctcctgcatatccttcaaggactccgcctgccgctgcttcggctacatggtctccaagaagaagtacatctacaccatcgacgacgactgcttcgttgccaaggacccatcaggcaaggatatcaatgccc

SEQ ID NO: 3189 - DNA, 409 bp, Zea mays
  Clone ID: LIB3228-011-P1-K1-A5
cccacgcgtacgaccacgcgtccgcgcccgcaccacggcggcgggggcggcgccccgcctgtgaggcagcagacgtacaggatctactgcaaggctggggaggaccagtacagcctcgcctcccgcgacggcaaggtctgcctcgtgcgcacggaccgtgatgacgacgcgcagcactggatcaaggacatgaagtacagcaccagggggaaggatgaggaaggctaccctgccatcgtcctcgtcaacaaagccactggagaggctctcaagcattccctaggccagtcacaccctgttcttgtgacccgccataatccatactccctggacgagtctgtcctgtggacagagagcacggacgttggggatgggttccgctgcattaggatggtcaacaacatctacc

SEQ ID NO: 3190 - DNA, 443 bp, Zea mays
  unsure (1)..(443): unsure at all n locations; Clone ID: LIB3228-011-P1-K1-A6
tacgcctccaggtaccgantcccggattcgacgcgacgcgtccgccttgatcagctcatctgcaaggcactcggcaatggctcatccaacagttacgccatcaagaagaaggacgagattgagcgtgttgccaaggccaaccgttgaactgagcttgtatcctggtgcactctgcgctggaaacttttatgtcgctggcagtcgtatcggttcttgttttaccaatgtttagagttttttgagacctatatgcggttttggttttcagtgcacaattaaaattactgagtaatgtagttgattgggaacagaaatgtttggtgcctggtttaccgaactccagttctcttgtcatttttctttattctatagtctgtattatgtatgcgtatgagtattgagatgattctgcaaaaaaaaaaaaaaataaaataattataaaa

SEQ ID NO: 3191 - DNA, 407 bp, Zea mays
  unsure (1)..(407): unsure at all n locations; Clone ID: LIB3228-011-P1-K1-A8
cgcgctggaacgcgatgaggctgaggnaaaaagaatgcgttgctgtgaacatcaaccctggggatgagaaatttgtgggtactgtgggggtcgcggaggtctactggatggggtcaagaagtatccgggcaagtcgtctctgggaaccctgcttattgctcgccggatgctagcgccgccgtggactgcgcggctccgagaagtcgaggtagacgcgacatatcccagtgaaatatatgtacaggaaccttcggacttggaacgaagctgtccatattatggaaagcatgattgggacgaatgtcgaataaattctgaagctatgcgcaaggaagtttgggctcattagcagaaaaaggaaccgacttaaataggaaaaggctatttagttctcgatagattgtcct

SEQ ID NO: 3192 - DNA, 175 bp, Zea mays
  Clone ID: LIB3228-011-P1-K1-A9
cccacgcgtccgtaacaacttcgaaggagcaagaacctttagtgatgttgttgaaaatataacttaacggtccactgaaaatcccttcaatgcgcaatatcttgtcacctgtctctaggagaccacgcagagtgctaatgatagggaggccagcaccaaccccacgcgtccggac

SEQ ID NO: 3193 - DNA, 136 bp, Zea mays
  Clone ID: LIB3228-011-P1-K1-B1
cacgcacgcgtgggttttgtgggaaaaaagtcatgccaggacatgattcgtatattgtccttttgttcactctatctcgtatttgtgaactctaaattgtttgccaatttgattgatcatagcccagtgttcagag

SEQ ID NO: 3194 - DNA, 404 bp, Zea mays
  Clone ID: LIB3228-011-P1-K1-B11
cgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatgaacggcgccatcttcaatccgtccggcggcgcccccaagcaggtcgacaccaacgagtgggtaaagcccaagccaggaacctacgttacaaggctcacccgcttctccggcacactgtcctgctgcacgggcaagccgtgctgaaagccggtgggcatcaagctgcttcttctagctcatggcctggccatgccaggtcgcgctggctgcgtttcatttcatggaagaaagcaaggatggatcacaggtt

SEQ ID NO: 3195 - DNA, 404 bp, Zea mays
  Clone ID: LIB3228-011-P1-K1-B12
cgccattggcggcggcgacgcgccaaccatcatcagccagggcaaccgctacatggcaccaccaaacatcggcgccaaagtgatcaccaagcactacgcggaagaaggcgtgtggaagaactgggtgtggcacacggaggacgacctgttcatgaacggcgccatcttcaatccgtccggcggcgcccccaagcaggtcgacaccaacgagtgggtaaagcccaagccaggaacctacgttacaaggctcacccgcttctccggcacactgtcctgctgcacgggcaagccgtgctgaaggccggtgggcatcaggctgcttcttctagctcatggcctggccatgccaggtcgcgctggctgcgtttcatttcatggaagaaagcaaggatggatcacaggtt

SEQ ID NO: 3196 - DNA, 221 bp, Zea mays
  Clone ID: LIB3228-011-P1-K1-B2
cggacgcgtgggcggacgcgtgggcggacgcgtgggcaacaaatatactcagcttcaggtagatctgatacaccatcactgggcgcgacatggatccggagttgcataggacacaatgaaacaagttctgtcatggatgttcttatctactgtcgaactgtctttgtttactttacattgttgtagtgtctgtgttagtgtcatgtctgttctacttcaaa

SEQ ID NO: 3197 - DNA, 279 bp, Zea mays
  Clone ID: LIB3228-011-P1-K1-B3
gagctagatcgggagcagccgatatagaagatacaagagtgcatacatatacatgcaacggtgtcaagacaatatagagggacctaaaacgaatgtactagccggccattaacatggttgtgacggtgaaaacgaccaccgatgcgacacaaatggcgtgggaatgcatgaaggacatcggcgcggtgccttgtagcatgcatggcggcacacatctggcctaacaacagccgcgcagagggaatgtccaatgggacgcgcactatattgcgacattaa

SEQ ID NO: 3198 - DNA, 406 bp, Zea mays
  Clone ID: LIB3228-011-P1-K1-B4
gccgaaccagcgcgtgatggagtcacggtcgtacgtctgaccgctagaagccacgacggggtcgcccatcagctcgagggagatggggcaccggaagtccggcggcggcgacggtggctccgcgtcgtcgagatccaccttggagtccacgggccgcggcgtggcggcactgaagaggacgcacttggcgtagcggaggaggccgacgagggcgatcatcgacgacgtccacctctcggcgacgcggtcgccgatctcccgctccagggtctcgatctcgtcgctgcagctggcggggtcgttgatgcccacgtcctccaggataccctcaagcctctcccgctccggcacgatctcccgctccacctcctggatcagcgcgagcacgcccgccttcagctccagc

SEQ ID NO: 3199 - DNA, 410 bp, Zea mays
  Clone ID: LIB3228-011-P1-K1-B5
cttggtacttggtaatagatggcagcacctccgtccatgccggcgccgccgccgccggagccaagcggaggcatcgtatcccccgtggcggtggtggcctcgcatttctgcgcgccctacgtggtgcagctggcggtgaaggagaagaaggtgagcctccgggaaggcgacttcaccatcaccgacaccaacggcgccgtcgtggtcacggtcaagggtgccttgatcagcatccacaaccgccgccgcctcctcgacgccgccggcaaccccctcctctgcctgcgcgagaaggtaatcagcatgcacaacacgtgggaagcgtacagaggggacagcacgagatcgagcgacctgctcttcaccgccaagaaatcctccatcatccagccgttcaagaccgagatgct

SEQ ID NO: 3200 - DNA, 403 bp, Zea mays
  Clone ID: LIB3228-011-P1-K1-B7
ataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatcccgccgcagcagacgcaagcgctcacgttctgcgacaccatgtacatgaacacgcaggacaccatcggcgcggcgcagcgggccatcacgttca

SEQ ID NO: 3201 - DNA, 99 bp, Zea mays
  Clone ID: LIB3228-011-P1-K1-B8
tctagaggatccaaggttaccgaccgggggcttgcgacgtattagtttttttttggggtaacttaaattaaattaattggccgcggtttaccaccgtgg

SEQ ID NO: 3202 - DNA, 401 bp, Zea mays
  Clone ID: LIB3228-011-P1-K1-C1
cccacgcgtccgtggaaactgagacgcttcttcagttcaaatgaaaagcacttgcctgcaatatctgatccagagatcgaagctgcatttaaggatttgttggctgctagttggaatgaacttccagattctctcgtagcggaagcaaagaaagcagtatctaaagcgaccgatgataatgctggtcaagaggctttgaaaaatgtattttgtgcagctgaggcatgtgaagatttcagtggaaccttggttaccctaagaatggctcttgatgatctgtgtggcctgactggcgaaaatgtgggtcctttacctggttatattgaagatgctgttaaagctgcatataatcgctacatgacatatctggagtcctttggccctgaggaaaattatctaag

SEQ ID NO: 3203 - DNA, 400 bp, Zea mays
  Clone ID: LIB3228-011-P1-K1-C10
cggacgcgtgggcggacgcgtgggaaagggttttacaggaatagatgaccctgatgaagcaccactgaattgtgagattgagatcaaagaggtagatggtgtatgccctccgcctgctgagatggcagggcaagttgttacttaccttgaggagaaaggcttcctgcacgagtaggctgaatccaagcaacatgtggggaagatttcagtaagactagcgcagaataagtcaaaggcgctggcagttacggtatagcagttgcatagattggcctcaatgccttagtattttctttccgtacttcctcttccacaggctccatgcaatttcattcagatgagcctggatggttcctaatttctttgacctctagagtagattacttgtaatgcaactctg

SEQ ID NO: 3204 - DNA, 396 bp, Zea mays
  Clone ID: LIB3228-011-P1-K1-C11
tttattcatcgaagaccacaggaccggcgagggcaggagatatctacgccggggccaggtctcgagcaaacaccatcattggggatggaagaagttcatattactgtgaggacttaaaggactgcgaaaagggtaatctcatcaaggtcaagtgctacatcgaggctgaagctatactaacacggctcttagaagacggggtactctatgttatctgatacgggagagctcatgattagagtttattctggctggaaccaactatataaacgatttcatatgcattagcatgcaatcgagactctagcttgctctatagatatctacacgtatacgctcttaaagctttgttctgtcgcagttgaatgtggactaataagtgaatatatgcaaact

SEQ ID NO: 3205 - DNA, 403 bp, Zea mays
  Clone ID: LIB3228-011-P1-K1-C12
cccacgcgtccgcacacacgtaaccaaacccatacaaggcaatctaaacaagggagaactgatcttatgcctgattatagcagtgactgacctctgtttaaatactaatgaaccaacgctatatgactttgtatatatatgcgcctgacacccggatttatggccagggatctattggtaccttatatagtgagttcaatgactgtagcaccgataatcgctcgccggacgtctggcgcgctcaccaaatcactgttcgccgtggtccggtctctgcgccacccgattgccgacgagcaagccaccgtggaatctgaggttcagcaagtagagatagctgagcaggagctcattgaaggagaagaacaggtggtcgaagaggagtcgcctaacactgaggagt

SEQ ID NO: 3206 - DNA, 399 bp, Zea mays
  Clone ID: LIB3228-011-P1-K1-C2
cggacgcgtggggtgcgacatcccacccgtcgggctgtccatgtcctccaccttcgtgggcaactccacctccatccaggagatgttccgccgcgtgagcgagcagttcacggccatgttcaggcgcaaggccttcctgcattggtacaccagcgagggcatggacgagatggagttcaccgaagccgagagcaacatgaacgacctcgtcgccgagtaccagcagtaccaagacgccacagccgaggagtacgacgaggaagagcaggacggcgaggaggagcacgcctgatcgatgcaacgggcttcagagtcttcgctgctgtggtacatcaactgggactataagttcctacaatcctatactacctaccttaagcatatgtattcatgcacttc

SEQ ID NO: 3207 - DNA, 403 bp, Zea mays
  Clone ID: LIB3228-011-P1-K1-C4
ctgcagcctccttttatttgtcgcatctaactggccatgttggggaatatgtggccttgactggtgaaaagcttaatggaacagatatgattgctcttggcctcgctacacactatttcatgagtggccatctggatctgatcgatgaacgacttgcaaagttagtaactgatgatccatcagttattgattcgtcccttgcacaatatggagacatggtttatccggacaaaaatagcattgttcataggctggaggtgattgataaatgcttcagccatgacacagttgaagagattgttgatgccttggaaagtgaagcagccagctcaaatgaagaatggtgtatcttggcgctgaaacgattgaaagaagcctctccgttagctttgaaggtctcact

SEQ ID NO: 3208 - DNA, 297 bp, Zea mays
  unsure (1)..(297): unsure at all n locations; Clone ID: LIB3228-011-P1-K1-C5
cccacgcgtccgccaagcttgtatgaatctgagaccaagagtttgtagagaataattgccgcggaaggtcgatagcaaaccaagtatatgtactgtattcagcaatcagcagttctgatgttcgattttggattgagtccagaaaatgctgttgaggtttgaactagggaagccagcattcctctggctttgtactgttgtgagagtaagaacatatctaggaactagtattgcagtggcagtcactgagtcgatatatctacttctgcaccttccagctccaaaanaaaaaaagag

SEQ ID NO: 3209 - DNA, 355 bp, Zea mays
  Clone ID: LIB3228-011-P1-K1-C6
gaaaaaaatcataactagctcaatggtaaaaacaaaatacaaatatgcatagtagatcatgcattctacttattcactaccgaacaaataaaaccaaaaatctaacaacaaaataacaaaaaaatctaacaaccatataagtatctggatccataacataacaggttgtctggcccagcatggattggatcgcagttgcaggcagcagtcgcagtcccattgatgccgccgtgtgagtcgacctcgtagtctcagtctcaggggcacttgggcctcttgttggggccggcggtgagcatgttgcggtagcaagggcagtcatggatgtcgtgcggcacgcagttgcatgcctcgc

SEQ ID NO: 3210 - DNA, 403 bp, Zea mays
  Clone ID: LIB3228-011-P1-K1-C7
ccctcatattgtggttggcacgcctggtaggatacttgctcttgccagggataaggatctctccttgaagaatgtgaggcacttcattcttgatgaatgtgacaaaatgctggaatcacttgacatgcggagagatgttcaggagatcttcaaaatgactcctcatgataagcaagtcatgatgttttcagcaacgctcagcaaggagatccgtcctgtatgcaagaaatttatgcaagatccgatggaaatatatgttgatgatgaggcaaagttgaccctccatggtcttgtacagcactatataaaacttagcgaggcagagaagaaccggaaactgaatgatctcttggacgctcttgatttcaaccaagttgtgatattcgtgaagagtgttagcaga

SEQ ID NO: 3211 - DNA, 149 bp, Zea mays
  Clone ID: LIB3228-011-P1-K1-C8
cccacgcgtgaaagcactcctggtctggcgcgatttgtagagtttttggttcagggggttaggttcgctgttgcctacctcatttgcccctgatcatcgccgcaatttatttatttataatataaaagatccagattttccccctctca

SEQ ID NO: 3212 - DNA, 404 bp, Zea mays
  Clone ID: LIB3228-011-P1-K1-C9
cccacgcgtccgctcctccatcaccaccaaactcaacaacagccagctcgcgaaaataatgaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtga

SEQ ID NO: 3213 - DNA, 404 bp, Zea mays
  Clone ID: LIB3228-011-P1-K1-D11
cccacgcgtccggtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatg

SEQ ID NO: 3214 - DNA, 400 bp, Zea mays
  Clone ID: LIB3228-011-P1-K1-D12
cccacgcgtccggtgatttgaaataattgggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatg

SEQ ID NO: 3215 - DNA, 410 bp, Zea mays
  Clone ID: LIB3228-011-P1-K1-D3
cggacgcgtgggcgacggcagcccggatctggcgctctccaccgtgatgcgcgtctccccgggcctctcgtccttcgccgccgacccggcgcgggccggggagtctttgaagccgctgatagattttgcgagggataagattgacggcgcgggcagcgccgctggggaggcggaggtgcgactcatggccaccgcagggctgcgcctgctcgaggagcgcacccaggaggcaatcttagcgtcctgcagggacgttctacgagcctctgggttccggttcgaggacgcgtgggccaaggtgatcccaggctcggatgaaggtatctatgcttgggttgcagcaaattatgctcttggaagacttggaggggatcctaacagaaccgttggaataattgaacttgggggcg

SEQ ID NO: 3216 - DNA, 398 bp, Zea mays
  Clone ID: LIB3228-011-P1-K1-D4
ggcgcgggcccggatcggagctgccggcggtgaccgcgcgcgcctgcatggcggcgtcccgcagcgaccgcagcgtgcgcacgttggcctcccagaagccgcagcgctcgaagggcagtccgtgcttgcggcagaggtcgcgcaccaggggcgccacgcgccggaggtggcaccgcggcagccgtgggaacaggtggtgctccacatggaactgcagcccgccgtggaaccagtccatccacggcgggcacgccacatccagcgtgttccgtgtctgtttctggaaccagtcgtcgccgcggggccgccccacgtacgtccccaccgagatgtggttgagacagaaccatcggacaattcgtatacaatcaaaaaatattggtatccatcacttatcc

SEQ ID NO: 3217 - DNA, 213 bp, Zea mays
  Clone ID: LIB3228-011-P1-K1-D6
gccgccggtgccataaacccgcgggtagcgggttgggctatacttacgctatccgtcccgggtagcggcttttgtttctgcttgaatattaatctggcatgtacgggttcgcaatctatgtacccgcgggttttaaactcgtcggatcattgggtccaccgatatggcacaaggcagggaatgcgagaagtacagtgagcgatttgttggggc

SEQ ID NO: 3218 - DNA, 350 bp, Zea mays
  Clone ID: LIB3228-011-P1-K1-D7
gatttaagttggagaagattgagcagctagaggtgaactacacggagccaggaaaccatagcttgagtgcatgaaacaaaacattcttggttgacccgactagcttcctaccgattgggaatagttcgcattgcctcccagattctgggaggccattgccagcataagttgaagctgttgtattttagttcaaaattaaactagtggatgacaaatatttaagaatggaggtagtaataaggagccaagtgcttcaccaatcattccaaattcaatattctttatgtatatacgtactatttcatagccaaacgttttctcctcacctgtgtaatcggagttgattattt

SEQ ID NO: 3219 - DNA, 152 bp, Zea mays
  Clone ID: LIB3228-011-P1-K1-D8
ctcagcattccccttagtcaaatctgtaacctgtagcatctataagcgtgtggctttattgttgaaatcctgatgtttatcgttctctataaacacaaaactgaacaaataacctcgctgcaatgaataaactcaggtgttcagtgtgaatc

SEQ ID NO: 3220 - DNA, 395 bp, Zea mays
  unsure (1)..(395): unsure at all n locations; Clone ID: LIB3228-011-P1-K1-D9
nccacgcatncgagaacgcatatgcggttgcgtaaacatatacgagtgtggcggggcatctctttaattcgtcggccaaccgatgcgggccggagagtatttgaagccgatgatagattttgagagggataagattgacggagcgggcaatgccattggaaaggcaaaggtgcgactcatgggcaccgcaaggctgtgactgctcgaggagcgcacccagtaggcaatacttaacgtctgtaaggacgttctactagcaattaaattaaagttaaaggacaacatggccaaagagattaccatgattggatgaaaagtaaatatgcttgggatgcagcaaattatgctattggaagacttggaggggatcctaacagaaccgttggaataattga

SEQ ID NO: 3221 - DNA, 378 bp, Zea mays
  Clone ID: LIB3228-011-P1-K1-E1
accacgcgttcgcccacgcggtcgacgtaagtgaaatgacctatataatgcaactgtgcgtgtaaaaaactaaagactaaagaacaaccaaacagacagaaactgcaaggcaagaacccaagacacgcaaagcaagcagcagaccaaacagattagaccaagagaacgagacaagagcgggggatggtgaagcggaccgaacttacttacctgcccgcgcgcctgcacacctctgctatcggggcaccgaaaggcaagtcggtgcctgctgagtgacaagaaggggcgcgtgaaaaccgtggaggagcgcaccaaagagagcgtgtacatacacaagattgagagggagcggcaagagaagatgaagacgaggctcga

SEQ ID NO: 3222 - DNA, 404 bp, Zea mays
  Clone ID: LIB3228-011-P1-K1-E10
cggcgctctgcccctactgcctgtgctgcagcaaatggggcttctgcggcagcaccgaagcctactgcggcaacggctgccagagccagtgcgaccgctgcaacgccaccgtcgcgtccatcgtcacgcgggagctcttcgacgagctgctgctgcaccgcaacgacctcaggtgccccgcccagggcttctacacctacgactcgttcatcgccgcggcgggcgccgacgcgtccgacggcttcggcaccacgggcgccgtcgacatccggaagcgcgaggtcgccgcgttcctggcggagccggcgcaccggacctcgggcggctgggacggcgcgcccaacggcacctacgcctggggcttctgctacaagccggccggcgcccagaacgtcacggacccc

SEQ ID NO: 3223 - DNA, 160 bp, Zea mays
  Clone ID: LIB3228-011-P1-K1-E11
catttaacgaattggtatcgctgatgcaccagtttaatttggtgccctgttatttgttctttccctcgagtgagggatcgacacctgtaccattgcttgccatttgtctggaccagttcaacaattcgatttaaccatcacgtatatgtgtgctttggat

SEQ ID NO: 3224 - DNA, 390 bp, Zea mays
  Clone ID: LIB3228-011-P1-K1-E12
cggacgcgtgggcaaacacgttgatagaaacaaaaaagaacaccactatagaaaagaaggccgacactggggacgaacaaaacctaccaagaaacatgctggcaccagtacgtaagaacggcttcatcagtcatcaagaaccgatcatgcaagggtggggaggtttttacctacaagactggtaagcatggtcacgcaaaatgccattttgtcgccatagacatattcaatgggaaatagcttgaagatattgaaacttaatcacacaactgtgacattccgcatgtgaaccggactgagtatgagctgatagatatttatgaggatggaatagtgagccttcttacttcagatggcaacactaaggatgatcttagactcccaactgat

SEQ ID NO: 3225 - DNA, 294 bp, Zea mays
  Clone ID: LIB3228-011-P1-K1-E2
gggagcacgaactgagcagaaggaagcggtagtgccactggtgcaagctcggcggctcagcgtcaagacgaacgattacagcagctatgacccttccccgtccatggacaagccacactccaagctcataccgaactgatcaatcatgtacgcgtccaggttgcagcagtggagttgccgatgagaaatttaacagcttaaatgtgtgcctgatttatatatacagaagcattatattactaggcttgcttaaactgttctcatgacatctaatatcatattattatagatgtg

SEQ ID NO: 3226 - DNA, 443 bp, Zea mays
  Clone ID: LIB3228-011-P1-K1-E3
gccccgatccggggttcgacgcgacgcgtccgactacgcgtagatcggcgagctgccggacttaagaatccacggaaaaacctgagtgctcgggcaatcctgtcacggtgttcatcacagacatgaactacgagcctatcgctccctaccacttcgacttgagcggcaaggccttcggctccctggcaaagcccgggctcaacgacaagcttcgccactgcggcatcatggacgtcgagttcaaaagggtgcggtgcaagtaccccgctgggcagaagatcgggttccacatcgagaagggctgcaaccccaactacctggccgtgctggtgaagtttgtggcggacgatggcgacatcgtgctgatggaaatacaagacaagttgtcggctgagtggaagcccatgaagctctcttggggcgccatctggaggatggacact

SEQ ID NO: 3227 - DNA, 159 bp, Zea mays
  Clone ID: LIB3228-011-P1-K1-E4
aagcatgtgaacttccgacgttgccacatgctggatcagtctgaataagtaagtatgcagctctaggtggtcagctgcgtctaccacaatgagcatgtacgtatggagaaatatctgtgaacccattttgtttatgaataagatttgttttttcgagtt

SEQ ID NO: 3228 - DNA, 406 bp, Zea mays
  Clone ID: LIB3228-011-P1-K1-E5
cggacgcgtgggcctcgcgcggcgaccacccgattcgaagcgtgcggagagaccgaagaagcgggagagatggctcgtaccaagcagactgctcgcatgtccacgggagggaaggctcccaggaagcagcttgtcaccaaggctgcccgtaagtctgcccccaccactggtggagtgaagaagcctgaccgctaccgccctggaactgttgccctccgtgagatccgcacgtatcagaagagcactgagctgctgatcaggaagctgcccttacagaggctcgtcagggaaattgcacaggacttcaaaactgatttgcgtttgcagagccatgctgagcttgccctccaggaggctgctgaggcataccttggtggcctgtttgaggacaccaacctgtgcgcca

SEQ ID NO: 3229 - DNA, 406 bp, Zea mays
  unsure (1)..(406): unsure at all n locations; Clone ID: LIB3228-011-P1-K1-E8
cccgaccgaccgtggacaatatcgaataactcctgccaaatcgccagttctttttgtgtactgtgcgctagccgccgcctagctgcactgctgtatttttgtttcaggattgctgctgctgttcgcacattccatctttggctcctcccggagccggaggcgcgtttttactgttagccttactcttactccctgtagctccacgtagaagagaaccgatgtcccttgatgatggcgatgatgctgaaacctttttttgaacaatgntgaaaaaaaaaaaaaaaaaaaaaaaaaaaaaaaaaaaaaaaaaaaaaaaaaaaaaaaaaaaaataaaaaaaaaaaaaaaaaaataaataaaataaaaaaaaaaaacaaaaaaaaaaagggggcggccgttttagagaac

SEQ ID NO: 3230 - DNA, 412 bp, Zea mays
  unsure (1)..(412): unsure at all n locations; Clone ID: LIB3228-011-P1-K1-E9
aaccgaaaaaaataacagaatcgaccgcacgcgtccaaccacncctacatcgatagctgacaatattgaattactcctgccaaatcgccagggcggggtgtgaactgtgcgctagccgcccactaattaaactaatgcatttttgtttcaagaatgctgattttgttcgcacattccatttttggctcatataaacacctgatgagcatatgtactgttagccttactcttactccctgaagctacacgtagaagagaaccgatcccccttgatgataacaatgatgctaaaacctttttttgaacaatgataaataaaaaataaataatatggaaaatactaaaaaataatacatatataataataaattaaatatataaataataatacaaatatttttaaaataataaa

SEQ ID NO: 3231 - DNA, 420 bp, Zea mays
  Clone ID: LIB3228-011-P1-K1-F1
accacttttattggaaaaaaaaaaaaaaaaaaaaaaaaaaaaaaaaaaaaaaaaaaaaaaaaaaaaaaccaaaaaaaaaaaaaaaaaaaaaaaaaaaaaaaaaaaaaaaaaaaaaaaaaaaaaaaaaaaaaaaaaaaaaaaaaaaaaaaggggggggccgttttaggggaccaaagtttacttccgggggattgcaaggtaatagtttttttttggggcccctaaaattaaattaatgggcgggggtttaaaaacggggggatgggaaaaacctgggggtaaccaaattaaatggctttgaaaaaaatccccttttggcaggtgggggaaaaagaaaaagggcccgaacggatggcctttccaaaaattggccaaccctaaatgggaaatggaaccccccttttaggggccattaaaggg

SEQ ID NO: 3232 - DNA, 403 bp, Zea mays
  Clone ID: LIB3228-011-P1-K1-F10
gtcagaatgtgctcagaaaggcattgcagtgagaccacggaaaggtgacgccctccttttcttcaaccttaacccagacggcaccaccgactcggtgagcctccatggtggttgcccggtcataaaaggcgagaaatggtcggctacgaagtggatccgtgtggcctcgttcgataaggtccatcacccacagggcaactgcaccgacgagaacgagagctgcgcgaaatgggcggccctaggggagtgcataaagaacccagagtacatggtgggaaccacagcgttgcctggttactgtcggaggagctgcaatgtgtgctagggtcaggacgtgagagtactagtatttgttagtgcataccacttgtatccatagtctgttgttggtctcctacatctc

SEQ ID NO: 3233 - DNA, 372 bp, Zea mays
  Clone ID: LIB3228-011-P1-K1-F11
ctcgatgctcggctccaccgtcttctgcgacgtcgtctccttcccctcgtcaagatatgggttcttgggagaagcaagttagacaatttttgttagatatgaattgaaaggaatggatggattaacaaccgaggacaaatcatatgctttggtgctttttgaatttgcgataaatagagaggtttcttaacaacaatggagcatgatgttagagaaatttggctcaagcgtaaaattaggttgcttagaagcagtgtgtagtgatgcgaggcatggatgcgagagtgcaaagtggaagcaacacatgaagtcgacatggagaagaaaaatgcaacgacagtccacatgcaacttgtgaaaaaagaatcaaat

SEQ ID NO: 3234 - DNA, 374 bp, Zea mays
  Clone ID: LIB3228-011-P1-K1-F2
atcaaggcactcagagaggcaggtgttaccgttgtcgagtcaccagcgaagattggctctaccatgtttgaaatcttcaagcagcgtggaatggtagaatagacgatggagacattgagaaaccgcattttgatgctcatgggcaattgcgagcaattccttccatggcctcaaacaaaactaatgaggctaccttttcttacgtgccttctgtttggaagatggcctcttcacctggatcaccttccaatgagctcatttccaataagacgtttcagagccatggacatgcttggagtcaatgtgaatgcctaatttcgaatttttattgtttacacatgtcaatctaggtttaccaatctgtttccttgtat

SEQ ID NO: 3235 - DNA, 396 bp, Zea mays
  Clone ID: LIB3228-011-P1-K1-F5
cggacgcgtgggaagaggcgggagggaaggagtgatttgggtgtttctgcacattcacaggtatatgtggtgctgtttaggagtttggtggagaaagagaagcttgatgacgcgctgtggatttgtaagagctgctttgcaatgaaggcagcaccaccgtttgaggctgttaagggtttggttgagggtttggtgaaggcaggcaggtcaacagaggccaaggatgttgttgccaagatggagtttcttgtgaaaggcgatgccaaacttgcttgggggaaggttgttggtgaactttcttttgaagagggatcaccgaatttgaatccatgatttgctagaggcatctgtgttacttctcattaattcatgcattttggagtttgaatgatgatg

SEQ ID NO: 3236 - DNA, 249 bp, Zea mays
  Clone ID: LIB3228-011-P1-K1-F6
aaaaaatagttacaacaagacttacatatactacaaagtatagcagaaactattgtatatcttttctttcggatctctgtacttcccaaggacggttgactagggatagcactcgtctagtactcatgaaacttgttgggtaactcatcacttgaactgacatgtgttacccaccatataggattttgttgactccacatcacctcttccaatgaaatacatgtacgatgaactaaacatagctcatac

SEQ ID NO: 3237 - DNA, 412 bp, Zea mays
  Clone ID: LIB3228-011-P1-K1-F8
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggttgttaatttaaaaaaaaaggggggggcctttttatgaattaaaatttttttttttttttttttgaaaaaaaattttttttttttggggaaaataaaaaaaataattgggggggattttaaaaagggtgaatttaaaaaaaattttggtaaaaaaaattttttttttttgaaaaaattacttttttagggggttggctaataagcaaaagggcctccccttttttttttttaaaaaatggtgaaacctttttttgaaaatttaatcctctttt

SEQ ID NO: 3238 - DNA, 408 bp, Zea mays
  Clone ID: LIB3228-011-P1-K1-G1
cccacgcgtccgcccacgcgtccgaaccccaactacctggccgtgctggtgaagtatgtggcggacgacggcgacatcgtgctgatggaaatccaggacaagttgtcggctgagtggaagcccatgaagctctcttggggcgccatctggaggatggacactgccaaggcgctcaagggccccttctccatccgcctcaccagcgagtccggcaagaaggtcatcgccaaagacgtcatcccggcgaactggagacccgatgccgtctacacttccaacgtgcaattctactagactttgaattcccttcgattcatccggcacagcgggctatggaccttcagcagcaagctaattaagttggcagcatgcaccgctaaccttatatactactgagacttccaaatt

SEQ ID NO: 3239 - DNA, 280 bp, Zea mays
  Clone ID: LIB3228-011-P1-K1-G10
cccacgcgtccgatcagccctgggagccaaagaaagagcaagcctagctcgtgagtacattgtggggaagctgctgaatgttttgcgttttcttgcattgcgctgggtcaggtatcaccgagctgaatagcctctgggttattgcctggacgggacccaaataatgttgttctgaataccaatatattgtatatttgatcatcttttgacattgaaatgttgttgctgttgtaaaagcagctttgaggaatatctcatgcaggtgttactgacttcggtt

SEQ ID NO: 3240 - DNA, 412 bp, Zea mays
  Clone ID: LIB3228-011-P1-K1-G2
cggacgcgtgggcggacgcgtgggcggacgcgtgggtaaaaaatgatgcgtggaccaatgttgaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaataaaaaaaaaaaaaaaaaaaagggggggggcctttaaaaggacaaaagattaaaacggcggaaatgacaagaaaaaatttttattaaacggtaaaaaaaaaaaattaaaggggccggtttaaaaaagaacgaggactggaaaaacctgctgaacaccaaaaaaatacacttcgagaataataatatttaggacggtgggggaaaaaaaaaaaaaggcccaaaacaatggcctttc

SEQ ID NO: 3241 - DNA, 368 bp, Zea mays
  Clone ID: LIB3228-011-P1-K1-G3
cccacgcgtccgcccacgcgtccggcagtgtctgaagttagaaaaagaatggggttaggtagccttgaaccaacatttgaaacattggtcgagtcttttgtcttcttggacaagaacaaagatggatatgtcagcaagagcgagatgatacaagcaataaatgagactattggaggagagcgctcttctgggcgcataggcatgaaaagattcgaggagatggactgggacaagaatggaacggtgaccttcaaggaattccttttcgctttcactcactgggtggggatcaataatgaagaagacgaggacgaagaagaatgagcgtgtcggctgaaggagattaggcgttccgaatcgaccgagcc

SEQ ID NO: 3242 - DNA, 325 bp, Zea mays
  unsure (1)..(325): unsure at all n locations; Clone ID: LIB3228-011-P1-K1-G4
cccacgcgtacgctcacgcgttctctcacgcgttcaaccacacctncgggtctggatcgcgtttccaccgctctaaacaatacaagaatacttactcgtgcatgccacgaactaacttttttatattgtcacctaaatataatatacattgcacgtcattttactattcgagaatagcaaaattctgggcgtatacacattaaatgatttgaggagaaatactgttacaagaattgaacggttaccttaaaggaattcatttattgttttattcaataggtgcgcatcattaatgaagaatatgacgacccatattaatgagcat

SEQ ID NO: 3243 - DNA, 125 bp, Zea mays
  unsure (1)..(125): unsure at all n locations; Clone ID: LIB3228-011-P1-K1-G5
accacacattcacccacgctttcgtccatgcttaaaatcacaaaaaaaaccacgggaccggtgctatttccatcttttncaacatacaaaaaccaatcttacatccccaaccatttccatataat

SEQ ID NO: 3244 - DNA, 76 bp, Zea mays
  Clone ID: LIB3228-011-P1-K1-G6
gccccacgcgtccggccacgcgttcgaccacgcgtgcgcccacgcgtgcggccacgcgtccgcccacgcgtccggg

SEQ ID NO: 3245 - DNA, 400 bp, Zea mays
  Clone ID: LIB3228-011-P1-K1-H1
gggcaacctgtccgggctgccatcgtcggacggcgaccaaatctaggcagcgcgggtgttggtggcctccaacgaggcctctcctcgactgacgtggtggacgcgacagccatcgagcgcagggtggagataatggtgttctcgaggatcctcgcgtcgcgcagcacacatagttaatctaatctcgggacacgcggaccgtccgagcccaagggccggaccgtccgctcattttggtgtccaacacacccgtacgttcgttcggtcgattaagcacttttacattatggctaattaggattaaaggggatgcgtaactgctaatcttctggagacttcttattatctttagatgagatcaccaccggcttttattcttcaacagggctcattgagttaa

SEQ ID NO: 3246 - DNA, 347 bp, Zea mays
  Clone ID: LIB3228-011-P1-K1-H10
cgacgaaagctatagccagctagtaacaagagcaaaaacaccatcaggtcatccgcccgtctcaacgccaccccaatggcccagagcacgaggatggtggcgctggccctggtggtcctcctggtggcggcgacggcgtcggtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggcttcatcggcgcgcgggctcagctcgatatcagcatcatatacaatcgc

SEQ ID NO: 3247 - DNA, 295 bp, Zea mays
  Clone ID: LIB3228-011-P1-K1-H12
aaaaaaaaaaaaaaaaaaaaaaaaaaaaaactaataaaaaaaaaaaaaaaaaaaagggagaggaaaaaaaaaaaaaaaaaagggggacaaataaaaaaaaaaaaaaattaaaaaaacgaaaaaaaaaaaaaaaaaaatatataaaaaaggcaaacaaaaataaaaaaaaaaggagacggaagtaaaaaaaaaaaaaggaaaagagaaaaaaacaaaaggggagtggacacccaaaaaaaaaaaaaaaccatgtagaaaaaaaaaaaaaacacatacgaacacaaacagagaacag

SEQ ID NO: 3248 - DNA, 392 bp, Zea mays
  unsure (1)..(392): unsure at all n locations; Clone ID: LIB3228-011-P1-K1-H2
actgaatgccctgtcagaggacggcagccttgtgtgcatgccaccatgggttaatccgtggcttcttctggccatgtcggtttctttcgggctgcatttcttgatcctctacgtgcctttcctcgctcaagtgtttgggatcgtgcccctcagtttgaacgaatggctcttggtggtggcagtggccttccccgttgtgctgatcgacgaggttctcaaatttgtggggcggtgcctgacagcgcgtgcccggaaacaatcagggaagaggaaggcagagtagatgctagtgatcatcggtatttagaatctgtagtgccacggggaatcgatattcaatgtgacacccncattgtttttgagctgctaagggctctcgatcctttcaaagt

SEQ ID NO: 3249 - DNA, 426 bp, Zea mays
  Clone ID: LIB3228-011-P1-K1-H3
attccggggcggaccaagccgtccggccttagcgcagttgaaagagagaccagaagggaggagagagggcctcgccggcgaccttcgctccggccttgatgtgggtgcccagttcctcgctgggcagtgccgagcgtacaccgagaaggtcacgctctcgccggtcaagtctggaggacgagctgctcagaatgcgtcgtcggcattgagagaagtcatgggctcctacacaaatgcaatccgccgtcgtctacgtctcgaccaacggtaggaacaatgccctgccgtgcgccgcatcgcccactccgatgtgtgcgaacccctgtcttcggccggcgtcgcgctgcctaggcgcatgccccagccattaccacgaagacgcctgccctcacttttgcctgcatgccgccatgcatgtactcaatg

SEQ ID NO: 3250 - DNA, 203 bp, Zea mays
  Clone ID: LIB3228-011-P1-K1-H5
gcgggaaacaccgaggtggaacagcagcctccaataaaagccagcacatccaaataaaaccgagagacctcattccttatgcaagccgaccgccgacgtaccaccgcgccaacccgagagaaagatggagatgatcaagaggatcctcatcggcgcgctcctcgtagtcgacgtcttggccaccgcaatggtggtctttacct

SEQ ID NO: 3251 - DNA, 158 bp, Zea mays
  Clone ID: LIB3228-011-P1-K1-H7
tttttttttaaaaattgctacaatttgagggttagaacatgttaacacatcgtaatcaaacagaaagaaaaagagggggagcaggaacatattatgggggaccacacattattatgggggtttggtgggaaacaaaaaggatcgaacttatttttaat

SEQ ID NO: 3252 - DNA, 313 bp, Zea mays
  Clone ID: LIB3228-011-P1-K1-H9
acgagccgttcagtacctcagtaagccagaaaagactcatcaggaccgtcttgaagatttagatgcaaaaattttcttcgccaaaaatgtacagttttgctcactgacttaggacatgtttggagcatctatttttttagaaactggtttatgaaaactgaaatggtttcaaacatatctgattatatcccagtttatagaaactagattcctagtttcttaaaaactaaaaagctagccttatctagctaaaaccagtttataaaaactgaggtggtttcaaacaccataaaccaggttttttttgaactaa

SEQ ID NO: 3253 - DNA, 87 bp, Zea mays; identical to SEQ ID NO: 1371
  Clone ID: LIB3228-012-P1-K1-A10

SEQ ID NO: 3254 - DNA, 173 bp, Zea mays
  Clone ID: LIB3228-012-P1-K1-A11
cccacgcgtccgaggcggagtggtagcgtagggtacatgtgaggttgaggtcggcagtgcgagggtgaggtcggtggttcgattcctaacaaccgtgtagcgcgtgaaaaatgccgcgatttgcgacttctgtggggtgggctgagtccacatcttaaataaatatttaaaaa

SEQ ID NO: 3255 - DNA, 62 bp, Zea mays
  Clone ID: LIB3228-012-P1-K1-A12
cccacgcgtccgccacgccttcgtagacccctttccagacgcgctcgccatcccggcatcta

SEQ ID NO: 3256 - DNA, 375 bp, Zea mays
  Clone ID: LIB3228-012-P1-K1-A2
cttcctcgctggcccataaatatatatctatctatcgccatcgagcaattataatctcacagaataataaacatcatggggcaagcctcacggctcgtcctcctcgccgtcgtggcgctgctgtccgccggcctcctcccgcaggcgctgggtaagggtaggggaggcaggggacacggtggcgccgtcaacccgcaggtcgccggcatctgctctcgcaccccgttcccggaggtgtgcacgtccaccgccgggcggcacgcgtccaagtacccggtcatcgacaacctggccgtgctgaacatgcaggtggacgcgttcgccaagcgcaccgcgcaggcgcgcaagcacgtcgcgaggtcggcccgcaccatc

SEQ ID NO: 3257 - DNA, 429 bp, Zea mays
  Clone ID: LIB3228-012-P1-K1-A3
agcaccgcacggagagcaagcaagaaagcaaccaccgcactgccactacctaacaatggcccgcgcctacgtgtttctcgtcgtgctcctcctggccgctgtcatcgtggcaccgttcgcgggagcgacgcgtgtcgacgtcgttgagggcaggtccatggcgtccgccgacgcgccggaggccgccgcaccatcacccgggcctgactccgcctcgtcaccggactcctcgtcggatgcgccctccagcagcagctcctcggactagatagctagccgctcgacgcacgatctcgctctccatctacacggcgatcgagttctagctttgtcggcatgcaatgcaaaattccgattcttcgggaataatcaagcaccaaaggaatgtgcttgcatcactcactactagtaccttgtttttatatatgt

SEQ ID NO: 3258 - DNA, 397 bp, Zea mays
  Clone ID: LIB3228-012-P1-K1-A4
ccagcagcgacgagagatatggatgagggcagcacgatgccagcaaccaaggtctagtggtgatggtcaagggctgattgcagcggtcatggatgacaacatcacatgatttagtctgatgggatgttgctagaaattggcgctggacggcgttgcgcctgttgccattgcacccagatggtgactgttgcgctccatctgtcgagatctgtctagcccgtctctctaccatggtctttctctcaggccaatgcatagacatcgtcacgctcgtttacatcaccaagctttgggcagcaatggcttgcaggatcaacttcattcccaagatatgacaactccattcccaaccgcattgtctgctattcagttattactatatatatgaccgtttttt

SEQ ID NO: 3259 - DNA, 288 bp, Zea mays
  Clone ID: LIB3228-012-P1-K1-A6
gccgtcgagacataccaagggtagacggaggctccttgaccgccgtcgttgggccgtcgtggtggatgcgctcgtgctcgccgacatggtcaacgtaggcgcaggaccaaacctaatggacgggctgggagcagtcgtcacagttataagttctgcacgcgtacttgccactcctcgacaatatagaggcgtcattgcatgacgcggcggcggggtgcgaaaaccattcagaggtcttgacgggctactgagatgcgaagaaacttgaactgtaccatggggtggcga

SEQ ID NO: 3260 - DNA, 411 bp, Zea mays
  Clone ID: LIB3228-012-P1-K1-A8
gtcgaatgaaccgaaaccgttcgatcggaattcggaaaaaaacaatcaacgaagacaggaaaatacctactaccttgccaccggcaagtgcccgggggcgggccggccatttagatggtgcgtctaggtatcgacgtgccgagcatgctcgccaatggctatacttgcatgagcagaatcggcccttgtagtgaccagttattcagtatactagtagatggatgcgcatcaaggagccaacccaggaccacgaccagtaggcaaacaataatgtttggcaaagaaaagttagggcatgatgcgatactagcactagtattatgtggaataaagcactagtagatcgtaatgtttttatatataactgcagcgatgtgaacacgtataataatatatgcgtgcgggaaccat

SEQ ID NO: 3261 - DNA, 416 bp, Zea mays
  Clone ID: LIB3228-012-P1-K1-A9
gggaggaagagggagatccgagggcggatctttggccggatctcccgatctgcagccctgtggctacacaaaccactctgttcagcagcacgccagcaccaggctgtaggcgatgataccagaagccaaagtaggagcagaaggccaagaagggtcttgatcacttggaatgagggaagactgaactgagcgttcttgatcacttggtatagttattgcacatcagcaccaagcctaatcttttacttgttccagctatggctgacatggtctttgaggttgctaaccagggggctgacttggtatagttatttttttggtccacttgctctattccatctattctagatgctacttaagaacaatgatgtattcctgagttctatggggtttcctgttaaaaacaaaaattctac

SEQ ID NO: 3262 - DNA, 294 bp, Zea mays
  Clone ID: LIB3228-012-P1-K1-B1
gtcatgcgtacgtccaggtgtatgcacacgcgtacattagacagaaaggatagagaaggaactagctgaaactagatgtaatgtggaaaaagatctgaacaaagacaggatatgatatatttgagaagtacccgtgcacttaagaagaagtttgatgatgaattttgtgacgataactggggatattgaagagattggagagaactcggatggtgccatttgcatgtccaagaagaaccaatgtgctttctgagggatgaattgtgtagtgtgcatagtatgttcaagggagtg

SEQ ID NO: 3263 - DNA, 309 bp, Zea mays
  Clone ID: LIB3228-012-P1-K1-B11
gtatgctgcctcccgttaccgtggaaggcaggcttctgaggtactttgtttagcgatgtttgtggtctgataggactcaaacggcattggagctctgctgaaataatgaagctattttctgaggaagagtgatagctagtgtgagattaaattttcttcatgtaggatgtaagatctgttctttcagagctgggagctcataaatagatgaatgttcagaaacgttgtcccaaacaaaaatgaggtcttcgttttaataaacaaaaaaatacggtcccattggtcagctgctattttgccaaataaaaa

SEQ ID NO: 3264 - DNA, 389 bp, Zea mays
  Clone ID: LIB3228-012-P1-K1-B12
cccacgcgtccgcttctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaagtgtgccaagaggcgtgcgacaaggactacgtg

SEQ ID NO: 3265 - DNA, 357 bp, Zea mays
  Clone ID: LIB3228-012-P1-K1-B2
ttttcctaaaatcttaaataaataatttatttagtttatgtaataatatcaacccaacacaacaaggcatcagaagggacatgtagcatcacatatttcttgggtggtttggtgccacaaaataaccatagaaaaaatattgtcttgctaacatgagcaccaggtgagctcttttgaaatataattcatcatcagaggctgattagatgctgagtgtggtcttataggtggtgccggccttgaaatcagcggggatgacgtcgtcagcgatgcggtagccaccggacttgacagcaaagcggatgcaaagggggtacttgagcggggccttggtgtcgagcgtccaggtgccggtcg

SEQ ID NO: 3266 - DNA, 315 bp, Zea mays
  Clone ID: LIB3228-012-P1-K1-B3
cccacgcgtccgagctattctaatctgagagagccaaaagagctgggcaagctggggcgctccaccctgtgcagatgttaggtgtgtgtgtgtgtgtgtgttgctgctggcaacgcgtgcgagcagtgcggccctgatgcggtgctgggagagtgtacaccgagctgaagctgaaggcgtacatggttgtgtactgtgattgtgcatattttcatcccatgtataggcactcgcgggatgcttgagcacctgaggattttttacctgaccttatacgcacaaactactacgtaaatagaaatggtgagtatatac

SEQ ID NO: 3267 - DNA, 401 bp, Zea mays
  Clone ID: LIB3228-012-P1-K1-B4
acgcagttaaccaacgccagagaaggagtgcgttgggagagagagcagagcgcagcgatgaggagagcagtgagggccgccgctttggggacttcttcaacaacgccatatgggctcgggaatcaggccggtgaccttcgcggggtcgccgtggattcgtctgggaccgcgacgggtgagtccgagaactggggcaccgctaatcgctcgccggacgtctggcgcgctcaccaaatcactgttcgccgtggtccggtctctgcgccacccgattgccgacgagcaagccaccgtggaatctgaggttcagcaagtagagatagctgagcaggagctcattgaaggagaagaacaggtggtcgaagaggagtcgcctaacactgaggagttcgatctgatct

SEQ ID NO: 3268 - DNA, 385 bp, Zea mays
  Clone ID: LIB3228-012-P1-K1-B5
gtgtgcaagaacgtgaatgcggccgaggagatcctacggggctgcaaccagaacatgcccagcagggcgctgacgttcagccagctgggcgccgcgacggacgggttcagcgagcagaacctgctgggagaaggcggcttcgggcgggtgtacaaggggctcctgcaggacaccagagaggtcatcgccgtgaagcagctggacaggaacgggttccagggcaaccgcgagttcctcgtggaggtgctgatgctcagcctcctgcaccacccgaacctcgtcaagctgctgggctacagcaccgactccaaccagcggatcctggtgtacgagtacatgcccaggggctcgctggaggaccaccctctggacctgcccccgagct

SEQ ID NO: 3269 - DNA, 316 bp, Zea mays
  unsure (1)..(316): unsure at all n locations; Clone ID: LIB3228-012-P1-K1-B6
atccggttggcgatgttttaaatcctggatcccaaggtccagagggcatgccggttcggatctaatctgaaccattatagggagttcaaacggctggagtgaactcgtaccctttcggccaaacaaagtttttaaggtagtgtttggttgaagagccaagtagaacggaaacgttctatcccagttttattgttgtttggttatagagtaactagaacaaagtggctccaattagggaatattcgtaaaaattttaaaaaaaattccantggggtaaaaaaaatattattaaatataaaaaattttatttattttt

SEQ ID NO: 3270 - DNA, 210 bp, Zea mays
  Clone ID: LIB3228-012-P1-K1-B7
cccacgcgtccgtcatcagaggctgattatgaattatatttcaaaagagctcacctggtgctcatgttagcaagacaatattttttctatggttattttgtggcaccaaaccacccaagaaatatgtgatgctacatgtcccttctgatgccttgttgtgttgggttgatattattacataaactaaataaattatttatttaagatttt

SEQ ID NO: 3271 - DNA, 313 bp, Zea mays
  Clone ID: LIB3228-012-P1-K1-B9
cggacgcgtgggtgaggttgcgggagaaggaagggggttgtgtgtgtttgtgcatagtgtttcgcaaaagagatccgttgttctttttcttcttctctgtatatagttaagtactcctactgcttactgcatcgcagcaccgggcacgggctgggatctcggccgttgttacctgaacgatggtggtgagtgtgctggcgtcgcctgctctctgctctgtctttgccgctgtaccattttggaggcgcttaccatattatgaactttgaactatgatatgatgttcgcataaatatcacatgttctctgtata

SEQ ID NO: 3272 - DNA, 177 bp, Zea mays
  Clone ID: LIB3228-012-P1-K1-C1
cccacgcgtccgagaagagcacaggcatcggggcaggcatgaatctcatccatcatcgagagtgtccagaagtgcagcacatatcgaggatattaactcgagaggaggtgaagcatcccggaatggagatcctgatgctttggcaacaatgaacgcaactgcagaagctcttgaagc

SEQ ID NO: 3273 - DNA, 421 bp, Zea mays
  Clone ID: LIB3228-012-P1-K1-C11
ctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaaggctttccaagattgtctcaacaactatggcagcgagatcagcaagtgccagttctacctagacatgctgaacgagtgccgccgtggtggtgtgtctgcctaagctgcttctggggttattcgtggattttctttcggtgatgctatctcattaataagataccgtgaaacttttgtctccacagcttgaagctaaac

SEQ ID NO: 3274 - DNA, 296 bp, Zea mays
  Clone ID: LIB3228-012-P1-K1-C12
cacgggttaactagtttttctacttggcatggaagtaccatccagactatgaagtcttatttgcttgctaaataatactgtcaaagaacaagttgactacattgttgcatcatatttctgtttgaatatgtggatatgaaatgccatcaacttgaagatcagcattgctactataatggctaattacttcatatctgtctactatctaatcatttctcctattcagcatccatttatactcttacttggctatttgacatttatacatcaattcttagagttttaaacccgggcgg

SEQ ID NO: 3275 - DNA, 255 bp, Zea mays
  Clone ID: LIB3228-012-P1-K1-C3
cggagatctttttcgcgcctcccagctccaactgaagcaccagctctccaagaccgggggggggggatccgtcttcattggcctccagggcattggtattaataattaaattagggtcgtcgtcttaaggtagcctcgcgtcgtcctcttaaggtagcctcctccaagtcagggtagagccagaggtaaaggtcctctgtcattcgccattgaaccggaaccgctttttcaagaggaatactccccctctttttt

SEQ ID NO: 3276 - DNA, 422 bp, Zea mays
  Clone ID: LIB3228-012-P1-K1-C5
aattgagatggcataatttttgctggaaatttgttcgccttcgtttgcaagcttgtgtgcatcagatttgttgtgacgtgaagaccagtgccagtttcattggcgagttgaggaagttattgcatagtggaatggataagtgtgcatattttgttctttttgtacagtattcaatcagtttagtgggatcagttggtagtaatgataactataataataccgtgcctattattgatggatgggggtgatcagatccatgcataggatgaagtttctcccttcttttgtaatataaatataaataattgtgtcggttttagcagctctaataaaatttcttttaggggttgctttaaaataaaaaacaattttattttatttaaaattttccctcaaatttttgtttcaatatttttaattta

SEQ ID NO: 3277 - DNA, 417 bp, Zea mays
  Clone ID: LIB3228-012-P1-K1-C7
gcttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgacgagcccatgacccct

SEQ ID NO: 3278 - DNA, 425 bp, Zea mays
  Clone ID: LIB3228-012-P1-K1-C8
aatttggtgagatatactaatttacgttcgctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaggggttccaagtttacttccccgtgcttgcaacgtaatagtttttttttggggccccctaaattaatttaattggccgtgtttttaaaacgtggtgcctggaaaaaccctggctttcccaaatttaatggctttgaagaaattcccctttttcccggttggtgtaatagtaaaagggcccccaccgttcgcctttccaaaaatttgcccatccttaatgggaaatggacccccccttttatcggcctattaagcccgtgg

SEQ ID NO: 3279 - DNA, 107 bp, Zea mays
  Clone ID: LIB3228-012-P1-K1-D1
ttcacgcgttcgaggacgcgtgggcggacgcgtttttaaaaaatcggtaaccgtacaattgggttatttaaatcacatacttttttagattctgttttctataaaaa

SEQ ID NO: 3280 - DNA, 334 bp, Zea mays
  Clone ID: LIB3228-012-P1-K1-D12
tttacgcgtctgctcacgcgttcaccaacgaatccaaacacacaagaacaaatacgaaagaagctggatgaaggggaacaaatgaatggatatatgtaatattgagatgcatgccctatcaaatcactgtactggggttctcaaaaaaatcattgtaatgggagttatatatataactttatctcaccatttatttacaccaacaagtcattgggtatgcatgttctatcgttacattttgtggttgaaaaaaaaaaaaaaggcccagaaccgatcgaacttacaaacagatgcgcaaacaaaaataaaggggggggcgctctaggggatccaa

SEQ ID NO: 3281 - DNA, 399 bp, Zea mays
  Clone ID: LIB3228-012-P1-K1-D2
cggacgcgtgggccgtcgtggactacctcgacttcctctgcgcgctcgggtacaacgcgacggccatgaggacgatgaacaggggatcgttcgtgtgcccgaccacccccatgagcctccacgacctcaattacccatcaatcactgcgcacggtcttcccgccggcacgaccacgatggtccggcgcaggctcaagaacgtcgggctgccggggacgtacacggccgccgtcgtcgagcccgaggggatgcacgtgtcggtgataccggcgatgctggtgttcagggaaaccggtgaggagaaggagttcgacgtgattttcacggtcagcgaccgcgccccggccgcgagctacgtatttggcaccatcgtctggtctgatgggagccatcaggtga

SEQ ID NO: 3282 - DNA, 252 bp, Zea mays
  unsure (1)..(252): unsure at all n locations; Clone ID: LIB3228-012-P1-K1-D5
gtctcagaataacttcatatactatagcacttgacttcgcaagtgtacgtgtgtgggtacgtcggcacatcaagtaggccccactatacgacgcgacgcatatatgtacgcaatgggagtacgtgccacttttacgtacttcattgctgctaccaaaggaaaaggaaggaagcaatgctagctccgttgctgtaaatgatgcatgtactgatagttatacataaatgaatgaatgcatgtatgatgccgcng

SEQ ID NO: 3283 - DNA, 340 bp, Zea mays
  Clone ID: LIB3228-012-P1-K1-D6
ttcctctcttctctaaaccggcgaccaggagaacttctcctgtcgacgggtagctcggcgtgggggcataaccctgccggcaaccacgggtcaaggctacgatctacgtagccgaggtcctcctaccttgggcaataccgcccttgacatgagctgtccgtcaacttttctctgtagtgtgtgccacgggaggaggcatgggatgaggatacgggatgagagaagccgcaggtcatttaccatgcatattcagaaagtttgtttgtcgtggctttaaggagtgctcgctcgtcgggcctcacaacccaaatggagctactcaacatccaggctgtagatg

SEQ ID NO: 3284 - DNA, 416 bp, Zea mays
  Clone ID: LIB3228-012-P1-K1-D7
cgtcgcagcaggacaagctcgggatgggctacgtctttgggaggctcgtctggacagacgggacccactatgtcagaagccccgtcgtcgtcaacgccctcgcatgatctatccagttcgtgctaactagagtacactacctactactactacttgagggccttgtggatttttgtgacatcttagataagtagtaaggctctaaaatatatttttatttcttcttgttattattagtaaagaaatgagataggtttttttttgcttagctaaaagacatatcatctataataaattttggctctttgcatgggaacttgaattaatggtaaaaaactgcatataatataatgaagggaaaagggcacttttagtttcaaaggcatagaggattaagttttttttatgtcaatgta

SEQ ID NO: 3285 - DNA, 419 bp, Zea mays
  Clone ID: LIB3228-012-P1-K1-D8
gttactagcaagcagattaaagttatatctgctattgcatcacctcctgccctgcaaaagctcaataacaagttccctgggctccacgtgtacacaggaatgattgatccagaagtaaatgagaaaggttttatagttccaggactgggggatgctggcgacagaagctttgccacataatcagactgcccaatttgattgggtcagtgttcgacctgcgagaatctttgcttgagtttcacagaaacggagcaactgccagtagcagtgtttattgctgtagattactttcgtttgagattttgttccttttcagtgttatcagctgcctaccattttgtagcacccattctgtatgattgtgtagaatataaggctagttcaaatgtctccagatggtaaaatgctcgagagaacaa

SEQ ID NO: 3286 - DNA, 418 bp, Zea mays
  unsure (1)..(418): unsure at all n locations; Clone ID: LIB3228-012-P1-K1-D9
gctaccccggctcgtcctcctctcttctccatcgccgttggttctctcacgccacacggtcatccgatccctgtccaccgcgttgggagcgccgcagcccatggacgacaacgagagagagaaagagaatgagaatgagaaggagaagcactacgggactgacgtcgaggatgaagaagaggacgaggaaggtaacaagcgagtcgtggtgcttggcccccaggtccccctcaaggagcagctcgagctcgacaaggatgatgagagcctgaggaggtggaaggagcaactccttgggcaggtcgacacagagcagctgggagaaactgcggaaccagaggtcaaggtgctggacctgaccatcctgtcacctggcagaccggacctgatccttncgatcccgttccaggctgacgag

SEQ ID NO: 3287 - DNA, 407 bp, Zea mays
  Clone ID: LIB3228-012-P1-K1-E1
caggctatcaagaaggcttgtggcctaagtcaatggcccacattgcacttggtgggtgcgttggcttaccatctccccaattgggagagtggacgtcataatttgtggtagagggggtacgtgttcgcgcggcctgcgcggcctctgccaattcatatggttttgaagtttttttgcagtttagatctcggtttgctgcttcttgatccagatctgtgtttctctgcttcttgatccagatctgtgtttctcatccatgaagaaactatgatataaaattcatgtaattttgaagtttttttccagtttgtttcttgctcttcgctccatatctaggtttaaacttttcatggtccggcttctcggcccctagcccctgccaattcgtgtaataatggagttaattt

SEQ ID NO: 3288 - DNA, 400 bp, Zea mays
  Clone ID: LIB3228-012-P1-K1-E10
cacgcagttaaccaacgccagagaaggagtgcgtcgggagagagagcagagcgcagcgatgaggagagcattgagggccgtcgatttggggacttcttcaacaacgccatatgggctcgggaatcaggccggtgaccttcgcggggtcgccgtggattcgtctgggaccgcgacgggtgagtccaagaactggggcaccggtaatcgctcgccggacgtctggcgcgctcaccaaatcactgttatgcgtggtccggtctctgcgccacccgattgccgacgagcaagccaccgtggaatctgaggttcagcaagtagagatagctgagcacgagctcattgaaggagaagaacaggtggtacgagaggagtcggctaacactgaggagttcgatctgat

SEQ ID NO: 3289 - DNA, 413 bp, Zea mays
  Clone ID: LIB3228-012-P1-K1-E11
ctaccgtcggagttgactgactaagacggtgttgacgcctacctcaccaaataagggcccgaccttttacggcattcacaggggggacaggaaatcagcggccatggcctcgattccggcgacgaccttcggcagcatgcttatccgtcctattgtgtgccgcggctggcacctgcgtcgacaggctaccttctagactacatcatccagggccgcgtctactgcgacacctgccgcgccggggtcgtgaccaatgtgcaccgagtacatcgcgggctgccaaggtgaggctgaagggcaagcacttgggctccggcaagctcgagcgctccatcgacggggtgaccgacgcgaaccgcacgtacacgatcgagcttaaggacagccacgaggaggacatctgccaggtggtc

SEQ ID NO: 3290 - DNA, 302 bp, Zea mays
  Clone ID: LIB3228-012-P1-K1-E2
cgactggcgacgactccgccaccgccgtcgatctacgcgagacgcccaggtcttcgtcaacgacgagcatgcgggttagagaggaagaaattgcaaccgaaacaatggcggcagattccggcgctcgcagacaaccaagctttaccaaggtcgaccagctgcgccctggaacccacggccacaacctcatgctcaaggttgatgacttcaagatggtcgttcagagaggccgtgagggagggccccaaggaagacagatgaggattgcggagtgcttggatggtgatgaaaccggcattatt

SEQ ID NO: 3291 - DNA, 118 bp, Zea mays
  Clone ID: LIB3228-012-P1-K1-E4
gcgacgattgctggatagcaaccacacaacatcactgtagttctttgtttactatattaaagcaccagttttcatggttcaataatttcaccttcgttgattttgcaaaaagctccaa

SEQ ID NO: 3292 - DNA, 422 bp, Zea mays
  Clone ID: LIB3228-012-P1-K1-E8
cccacgcgtccgcaactctccacccccaccggtcaaatccccaccaccacctgctccggtgagctcgccacctccaccagccgtcccatcaccacctccacctgcaccatcatcacctccaccgtcggcacctgaggagttcatcttgccaccaatcatggcgcagcagtatgcgtcgccaccgccgcctctgttccaaggatactaagcggtgatcacagcgcgctctactgacgatgagagtaatcgcgacgagggaggccaggagaagcagtgacaagtcgatcgcaccatgcaatgctctagcgacctgaattgaatgctatcggataagcgcatgtacgtttgtgcgtaagggtataacagcataggtaatgtaacgagtgtgtgcacatgtaacatgatgaccgagaagagaaaca

SEQ ID NO: 3293 - DNA, 221 bp, Zea mays
  Clone ID: LIB3228-012-P1-K1-E9
cccacgcgtccggctcaaccagatggccaacaactgcatggctcttgcaaacatgatatgaaccacgcatgccaccccagcgtgaggtgccatcgcatgcacggaatgcttgcattcatttttcatttaattaagaattcattgaaattatgagttatatatattgagtaactctatgtatttgttcctgacctgcactatttattcaatagtatgtcatg

SEQ ID NO: 3294 - DNA, 265 bp, Zea mays
  Clone ID: LIB3228-012-P1-K1-F10
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaagggttcaaagtttatttccccgtttttgcaaagtaataattttttttttggggcccttaaattaaattaattggccgggtttttaaaacgttggaattggaaaaaccttgggtttaccaa

SEQ ID NO: 3295 - DNA, 376 bp, Zea mays
  Clone ID: LIB3228-012-P1-K1-F11
gctcgagcctgtcaccggagcgcagctgaattacccggcgatactggtgccgctgcgagctgaggcgttcgccgtgaaccggacggtgacgaacgtcggaccagcgaggtcgaactacaccgccaagatcgaagcgccgaaaggcctgacagtcaaggtggagccggcggagctggagttcacgaaggtaaatgagaggaagacgttcacggtcacagtgagcgccgcagccggagccagcagcgagcaggagctcgccgaggggaccctgagctggctgtctcacgaccatgattatgtcgtgaggagcccaatcgtggccgactccagacttaccttgagttgattgacacggtcacaccgttgcgcctgcgct

SEQ ID NO: 3296 - DNA, 299 bp, Zea mays
  Clone ID: LIB3228-012-P1-K1-F2
agaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctccgagtcgtccgccgaggctcccgctggcgctggcgctggcgctgccgctggcgcc

SEQ ID NO: 3297 - DNA, 430 bp, Zea mays
  Clone ID: LIB3228-012-P1-K1-F3
gtacaacgtgcgctccatcccgatccgcaaggacgacgaggtgcaggtcgtgcgcggcacctacaagggccgtgaggggaaggtggtgcaggtgtaccgccgccgctgggtcatccacgtcgagcggatcacccgcgagaaggtgaacggctccaccgtgaacgtgggcatccacccctccaaggtgatcgtcaccaagctgaagctcgacaaggaccgtaaggcgctcctcgaccgcaaggcccggggccgcgccgccgacaaggctaagggcaagtttactgccgatgacgtcgctgccgccgccgctggtggcgccgccaccggcgcctctctccaggagatcgactagactcttcacggtcatctgatggttgtcgtaccgccttttcctcatctctttagtttttgctaccaattgttatgtgat

SEQ ID NO: 3298 - DNA, 225 bp, Zea mays
  Clone ID: LIB3228-012-P1-K1-F8
aaaaaaaaaaaaaaaaaaaaaaaaaaaaaaaaaaaaaaaaaaaaaaaagaaaaaaaaaaaataaataaaataaaaaaaaaataaattaaaaaaataaaaattaatatttataaattaatataattgggggggcctttttagaggttttaagttttctttcgggggtttgcgctttttttttttttttttggggtccctaaaattaaattaattggccggtgtttt

SEQ ID NO: 3299 - DNA, 325 bp, Zea mays
  Clone ID: LIB3228-012-P1-K1-G1
cccacgcgtccgcttgccttcactcctgcagcgaggacgggagtgaagatctctttgtgcacactagtgcagccgctgcccaccggtgcagaggtgatcaccgtccccggcggggctgatgtggtcgcttccactggtgaggctacccacagcagaggtggttgcctccgctggcgagaccgttagtgccacctgctggcggtccttcggctctttggctttaatggcctcactgttaccccccataggaggatgggggcgaggtcctatttatagcagcgcttgacctggggtgatcgctgctgctgtctaagcgccccggggc

SEQ ID NO: 3300 - DNA, 385 bp, Zea mays
  Clone ID: LIB3228-012-P1-K1-G10
cggacgcgtgggtcttctgcctgcctcggcacccgggcctttgccttgtgaacaaaagtcgtcgcgttcctcttggctgatgaaatcctcttctcgtctagatctgagcctccgcctgtctttcggatcagatgcttggtccgatcgaacaacggtgagtcttgctctgttatttgattgttctaaacgcatggttttgtttttgtgatgatgtgcaggttccgatctgtttcgtttgattgatgagttgacgcatcggctcgaaacgaggctgcatggtttttgtgcctggaggtttctgattagcgtgtttaaggaaactgggtgccacaatttgttgctagaagtgctcgatccgtcgaattgatatctgccgagctgcgac

SEQ ID NO: 3301 - DNA, 356 bp, Zea mays
  Clone ID: LIB3228-012-P1-K1-G11
cccacgcgtccgcgactactcccagtggctaacccccatgcccgccttccgacgtacggacgtcgccgcggctgtcgaccgggagcacgacgtttggaaattcaagccgtatcctctccgggtggccatgctgacgacgatctacggtttcggtctttacaagtggtggatgtacgtatctagctagtgtgggtcgtacactcgtactctccccccttgccgttcctcattgtgagcagatgcgatagatggagtatattgcctggctaatatgctgctgatagcctgatatgaagaaccaccctcaagacaggttgatgtatgtaatgtaacgagcggatttttgtgatgcgcaa

SEQ ID NO: 3302 - DNA, 65 bp, Zea mays
  Clone ID: LIB3228-012-P1-K1-G12
atggggtcaaccgttatgtaactaatggatttgattaatctggtctctaactctctatctgtcta

SEQ ID NO: 3303 - DNA, 418 bp, Zea mays
  Clone ID: LIB3228-012-P1-K1-G2
gtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggaggacatctgcgaggtggtcttggtggagagcccgcg

SEQ ID NO: 3304 - DNA, 377 bp, Zea mays
  Clone ID: LIB3228-012-P1-K1-G3
cggacgcgtgggtggacgcagatgtgatcaccatcgagaactcccggtccgacgagaagctactgtccgtgttccgcgagggtgtgaagtacggagctggaatcggtccaggtgtctacgacatccactcgcccaggatcccctccaccgaggagatcgcggaccgcgtcaacaagatgctcgccgtgctggacaccaacatcctctgggtgaaccctgactgcggtctcaagacacgcaagtacacggaggtgaagcctgccctgaccaacatggtcttcgccaccaagctcatccgcacccagctcggcagcgcgaaatgagtcagatttggtagatccatggtttgttgaacacaaaagccagcagggtcattt

SEQ ID NO: 3305 - DNA, 385 bp, Zea mays
  Clone ID: LIB3228-012-P1-K1-G4
cggacgcgtgggaggagcaccacaagaaggacgacggggagcacaaggagggcatcgtggagaagatcaaggacaagatcaccggcgagcacggcgacaagtgcggcgaccacaaggacaaagaccataaggagaagaaagataagaagaagaagaaagagaagaagcacggggaaggccatgaccatggtgatggtgacggccacagcagcagcagcagcgacagcgactgatctcgcctcggcgagcgccgtacgcacaaatgcaccgcgcaggttataatacgagctgttcgccgaacaccatgcgcatatattatacagtactcgccaagattgttgttctgcaatcttcgggataaaaaggttcttttttttgttttcgt

SEQ ID NO: 3306 - DNA, 247 bp, Zea mays
  Clone ID: LIB3228-012-P1-K1-G7
tgtttttccaaagatttttgttcggtataagcgcaaggtattgctacgatgccgtactttattgctgttcgcactgtatatagttctgttggacgaaaaatgtattatctgaagttaaaacgtgatgcataatgatttaagctcacatattaaatacttaaatattaaaattaattattgggcggttgttttagaggattcaagattacgtacgtgtgcatgcgactatatagctctatttatagtg

SEQ ID NO: 3307 - DNA, 425 bp, Zea mays
  Clone ID: LIB3228-012-P1-K1-G8
gcgatctcctctccctctccctctccgatccattctccagcgcagcgaagtaaacatgtctgaccgggcaaagatgtcgtggcaggcgtacgtggacgagcacctgatgtgcgagatcgagggccaccacctcgcggcggcggccatcgtcggccacgacggtgccgcctgggcgcagagcacggcgttccccgagttcaagaccgaggacatggccaacatcatgaaggacttcgacgagccagggcacctcgcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatctacgacgagccgatgacgcctgggcagtgcaacatgg

SEQ ID NO: 3308 - DNA, 420 bp, Zea mays
  Clone ID: LIB3228-012-P1-K1-G9
ggtaagcaaacagtgcaggcaggtttgaagcagacccatgaacagcagctgatgtcatcctcgtcttgtgttagttcttcagttgtggcacagagctcgcattacgctagctccatccagcatgatgagtctatacatagaaggaatcctcctcatactagttcgcctgcattgcctgatgtgtggtcttcccgctcgcaagctctgcccagatttggatcaccaagttgggtgttccagcagcgaccttggttggctgcacccgtcacagttcgaaccgctgttcctgtctgctcagccaggccaaacgtggtgaattctaccactggaataagacctgctgcccagagccatgatggagagagagatctgaacagcgccgcaacagcgagttctggattcaataaactccaaatttga

SEQ ID NO: 3309 - DNA, 344 bp, Zea mays
  Clone ID: LIB3228-012-P1-K1-H10
gtgaccatccaggtgaatggcaatctgctggcgaccacggacctaagccagtacaaggatcatggtaattggatcgagattctacgcgtggacaaccttgtcatcaccggcaagggaaagctcgacgggcaggggccagccgtgtggagcaagaactcctgcgtcaagaagtacgactgcaagatccttcccaactcgctggtgatggacttcgtgaacaacggggaggtgtccgggatcacgctgctcaactccaagttcttccacatgaacatgtacaagtgcaaggacatgctgatcaaggacgtcaatgtgacggcgcccggggacagccccaacacgga

SEQ ID NO: 3310 - DNA, 218 bp, Zea mays
  Clone ID: LIB3228-012-P1-K1-H11
gttttatggactggaatagtctgcaaacatcacgatagcaatattgttctgctgctcctcagctgaggatgctgccctgtcctgaactcctgattttgcttttgatctactatgtgatgatttgctcttccttttgtttggaaaaaaatacaaatcggtatattctccgtcttagatataaaaaaaaaaggggcgggccgcttttagaaggattccaa

SEQ ID NO: 3311 - DNA, 277 bp, Zea mays
  Clone ID: LIB3228-012-P1-K1-H12
gcattctcttcccttccctgagcaaagagaagtagccacaagcatgtctggcatcatcgacaagatccaggagacgctccacatcgggggcgaccacaaggaggagcacgagcacaagaagggcgaggagcaccacaagaagggcgaggagcaccacaagaaggacgactgggagcacaaggagggcatcgtggagaagaacaaggacaagatcaccggcgagcacggtgacaagtccggtgaccacaaggacaaagacctataggagatgaaagat

SEQ ID NO: 3312 - DNA, 298 bp, Zea mays
  Clone ID: LIB3228-012-P1-K1-H3
gtcctgctcaaagttggcacgctgtgtcagcaagcaagccctcatctgctactcacttcatgggcatccaccaaagccttggtattcagctggcgcagcttgcgaaggatgcatctgcagcagcagctgcacgtagagttagtggtcaacgaaaggcggtcgaggttgagtctgttgcaactgctggtaaacaagagactcgagaagtagtgaagaagttataccgtgctgagtttgtcgagaggcaacatcaaggtttagatgaggataccgatttgagagctttggagaatggatt

SEQ ID NO: 3313 - DNA, 203 bp, Zea mays
  Clone ID: LIB3228-012-P1-K1-H4
cccacgcgtgcggcgacgcgtgggaaaaaaactatagcgcgctgagacgcgaacacgcacgagctggggcgattggggaacattagatgacgcgaaaataaagagagagggtcgtgtattcgggaccgctaagtttttgtgagatgataaagggactattggtgggcttaaaaataattaattttctattttttcatcttttt

SEQ ID NO: 3314 - DNA, 230 bp, Zea mays
  Clone ID: LIB3228-012-P1-K1-H5
ctcacgcgtgcgctgcttcttgctaattcatactgatagaccgcgtgctgtgttcatcacgcacatggatgacttggatgttgctagctaccaatttgaagggagcaacatggtcaagacctggatggaaggggcaaacatcaatgacacggggcttacatataaggatgactcaattgtgattcattcggagggatctctagatctctctggaccagatatatgttgat

SEQ ID NO: 3315 - DNA, 274 bp, Zea mays
  Clone ID: LIB3228-012-P1-K1-H6
ctgcgtcaagaagtacgactgcaagatccttcccaactcgctggtgatggacttcgtgaacaacggggaggtgtccgggatcacgctgctcaactccaagttcttccacatgaacatgtacaagtgcaaggacatgctgatcaaggacgtcaatgtgacggcgcccggggacagccccaacacggacggcatccacatgggcgactcgtccggggtcaccatcaccaacaccgtcatcggcgtcggcgacgactgcatcttcatcggccccggg

SEQ ID NO: 3316 - DNA, 81 bp, Zea mays
  Clone ID: LIB3228-013-P1-K1-A1
ggtgggcactttttcggggaaatggtgcgcggaaccccccattttggttaattttttttaaaatacatttcaaattttttt

SEQ ID NO: 3317 - DNA, 374 bp, Zea mays
  Clone ID: LIB3228-013-P1-K1-A10
cccacgcgtccggtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgtgggcgccaaggtgaggctggagtgcaagcacttttgcaccggcaagctcgagcgctcatcgacggggtgaccgacgcgaacggtacgtacacgatcgagc

SEQ ID NO: 3318 - DNA, 231 bp, Zea mays
  Clone ID: LIB3228-013-P1-K1-A11
cggacgcgtgggttcaaaagcagaaacactttagttaaatgagatatgcgtcacaggaagctaggtgatatgcgttcattattctgttcacaaagaaagcaccagctgtttagctatcaagtggcatacccatcataactaaggggagaaggagtgtcttttagctggtttttaccatctgtcatcaataaaatgagtgccacattgcgactattgcattattacgtttac

SEQ ID NO: 3319 - DNA, 83 bp, Zea mays
  Clone ID: LIB3228-013-P1-K1-A2
acccaaaaaaaaaaaaaaaaaaaaaaaaaaaaaaaaaaaaaaaaaaaaaaaaaaaaaaaaaaatagtgtataaagaaaaattt

SEQ ID NO: 3320 - DNA, 207 bp, Zea mays
  Clone ID: LIB3228-013-P1-K1-A3
cccacgcgtccgtccacgcgtccgcccacgcgtccgcaagattcctatccatcaaggctgatgcggagtataagtagagaactccgtgatgttggtagttgaaggcaaccaactgattgttgatgtccctcctattctgtgatctccggaatatttgctgatcattgggtgtttattcatgatgatgccttggggattgttttccct

SEQ ID NO: 3321 - DNA, 378 bp, Zea mays
  Clone ID: LIB3228-013-P1-K1-A4
cggacgcgtggggaccgtcctggctgatttcatgggtgcgattggttcaggaactggtatattgctcgctgtgacaatcatataccaatacttcgaaacctttgagaaggaaagggcgactgagcttggtttctttggtttttgattagtagctgtggaaccttaacttggctatagctgaattttcttgtaagtccctgtagtgcttagccagttgtaacttaaagagttctgtttaggttgccttcttgcggccacaatcatgtagcagaatgtgcgtgtgtttcaggttagcgtgggggtatgtgcatctgtccaaagagagtcttgcaatttggcaaccggatattttgttatcaatttcaggtacctttgaac

SEQ ID NO: 3322 - DNA, 211 bp, Zea mays
  Clone ID: LIB3228-013-P1-K1-A6
gtttacgaactacaaagaagctaataaaaacacttgtattgaaagtgatgtgctccacctccaggtttgcattgtcgtattttgctacttttcaacagagaagccctggcttcattggctacagaagttattaccttttcttttcatgtgtaattgtctctcattggttgactatacctagtcgaatttgttgtgtaagaccttgatggcg

SEQ ID NO: 3323 - DNA, 262 bp, Zea mays
  Clone ID: LIB3228-013-P1-K1-A8
atatttaaatatgagctgttaaggagtattcaaaataatgaatttgtgatgtacaattttgccactggggctaggttccatgcctagagattattttgttttctttactctgctgagctgcaaaagcatttcaccaacgggtacatttcacgttttttttggtttgcaatgcctcgatgttatcagcaaccttgtaacttaacagtttgatgagagttgataaaattttgtgctatggaaaaaaaatttcttttcataaaat

SEQ ID NO: 3324 - DNA, 306 bp, Zea mays
  Clone ID: LIB3228-013-P1-K1-A9
cggaccttcagttcgttggacgcacatgacttatagttttaaatactaggacacccgtttgggagtggtggagtgtgcagggttttgggtgcggaaccaggctaaccgggcacacaggctccggaccaccctatggaacgggcattcgtttcttagaaccggcccttaggccttcccctattttatttgaaatagatattatttattaagcagtatttaacacttgtaaacctggttacttaatgagcgtatttcttgtcgataaaattgttttctccttaaaatagtttttttatttatattttt

SEQ ID NO: 3325 - DNA, 312 bp, Zea mays
  Clone ID: LIB3228-013-P1-K1-B10
ccgcaatccgacattgcgctccgctatgcaggcgtacgcgcgcctctccttcgttgcctgcaggaaagtgatcgcgggtgtgtttagcgcaaccacacggtcgtgctgtcggacctcccgggggttggcgcatgcggcgtctctgcctgtgcaggagcctccaccgaaggggcagtagaggattacgaagcaggagaggaggattaggataatgaggttcattgagaattatagggcttgaaatgatgtggagtctcctactattaaaaatgtacaggagcaagtggagggcgggcactacacatgcgcgtg

SEQ ID NO: 3326 - DNA, 182 bp, Zea mays
  Clone ID: LIB3228-013-P1-K1-B11
ttaaaattaaaaattaatatataaatatttttatataaaaaacaaatattaatatagaggttttcttaaatattcctttcttttttgatttgatttattctttgtgcctttttttttcttgttgtttttctttttttttttttttttcttttttttttttttttttttgttttttttttctt

SEQ ID NO: 3327 - DNA, 369 bp, Zea mays
  Clone ID: LIB3228-013-P1-K1-B12
cttctccttctttttttaatttgaggagttttggtttttttaatactaatttgtgttaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaattaaaaaaaaaatggggtgttcttttaaaaatataaattttttataccgttattttggaattaaaaatttttttaattgggaaataaaaaataaattaaaggcccgtgtttataaataaaatatattaaaaaaactttattttacataaattaaaatttattgaaaaaattatctttttcttaatttg

SEQ ID NO: 3328 - DNA, 368 bp, Zea mays
  Clone ID: LIB3228-013-P1-K1-B2
aacaagttgtgtaccgccaacggcgcctccaaggtcaccgtcaaggacgtcaccttcaagaacatcactggcacctcctccaccccggaggccattagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagacccttccgcgactgacccatctctctagttataatttttctctcgtccttgcattgcatattagtttgctattcattgggtaacccacaacaggtaaaccgacaacattcaacaagct

SEQ ID NO: 3329 - DNA, 119 bp, Zea mays
  Clone ID: LIB3228-013-P1-K1-B3
cccacgcgtccgcccacgcgtccggccatacatccggggatgtagctctagaggatgcaagataaggttcgcgtgcatgctactttataggtcatttataggctcacctatattcaaat

SEQ ID NO: 3330 - DNA, 176 bp, Zea mays
  Clone ID: LIB3228-013-P1-K1-B4
gaacctgtggcagggagcctcattttgatacgttttgctgaaccgtctttgtttttttttcccctgaatctgtgtggtatcgcaagcgtcgagcccaatttcttttgtataagaataatgaggtgcccataaaaaataggccccaagaagattgttttgcttgtgtacattcgaac

SEQ ID NO: 3331 - DNA, 397 bp, Zea mays
  Clone ID: LIB3228-013-P1-K1-B5
gccccccaatgattcattagtcttggatatccgcttgaaaaccaggagccagatatctaccttggcaacggtgccaacgcctcctgctgtcatccatgctcggctgtgcgcatggtctggtggcggccgtgtgtcatcctattcttttgccgctcgtcgttgcactacctcgccatgtctgcaacgctatggaatcgccgtgcaagccgctcaagtgaggatacgtgttatcagaagagcaagttggtacctggaatctcaagtcccaggtcaagaacaggtaccgaaggatgaggcgcttggaggatgctttgatgtgttcgtgagaggtctaggacgtcgtctcccagtcaacttcgggttgctggacccgtgcttcttataaagaaatatttac

SEQ ID NO: 3332 - DNA, 90 bp, Zea mays
  Clone ID: LIB3228-013-P1-K1-B6
gtccgcgagggtctatatgctgggatatccggtacaaaaccagcacgacgagtcgtcggccttggcgacaattacagcgcctgtgcttgt

SEQ ID NO: 3333 - DNA, 177 bp, Zea mays
  Clone ID: LIB3228-013-P1-K1-B7
ctgaataaaagtacagaggatgagaggaatatgtttcttttattcagggcagcacagcaacagacgcgcgcttcagcgttgggtctcaacaggaatatttacagaacactcgacgattacttttacgcacggcacagcacgactgcgagctctaaacctgacaaacgggctctaaac

SEQ ID NO: 3334 - DNA, 287 bp, Zea mays
  Clone ID: LIB3228-013-P1-K1-B8
gccacgcgtcgggttcggtgcttaagagatcttaatcgtcgagaagaccctagagagcatcaatcatacgcactgcaccacatggggcattagtttgctgtcggctaggaaggtgccatgcaccagtgtcacgatgggtgacctgaacgttgtgtataggacggccaacaacaagaccatggctatatgcacgaacgccaagggtaggaccaagggttggcttaaggagcttgcatgcttttagacccttcgtcgactgacccacatctctagagatataatttttt

SEQ ID NO: 3335 - DNA, 268 bp, Zea mays
  Clone ID: LIB3228-013-P1-K1-B9
tactccgtcctcgccgacgtggtccagcgctaccaggctctcgggttcaaggacggcaaggacgcctgctgcggctacgtcggcctggcggtgggcccgctctgcaacatcggcagccgtacctgcccggacccctccaagtacgtgttctgggacagctaccaccccaccgagagggcgtacaagctcatgatggacgacttcctcacaagatacatgagatacatacactagctagctagagctagtcgatccgccatgttaattt

SEQ ID NO: 3336 - DNA, 313 bp, Zea mays
  Clone ID: LIB3228-013-P1-K1-C1
aaccaagctaccatggatcaaacacacacagatacagagaagtagtgaagagtggccgtcgtcatggatgtgtgctttcaccatcgtcagggtcagggagactcgccctatcccggcggatgtttccgtggcgtcgttgggcggatagggccacctgctccgactgaattgctcaccggagtatcaaacccgccgcagatcgacctgcgcgcgtggactacgtcatctgtgcctataccgtcgatgcgaggtgacgatgaacttggagttccaacctttgggtcaacatctgaactacaaggttttttaaagt

SEQ ID NO: 3337 - DNA, 390 bp, Zea mays
  Clone ID: LIB3228-013-P1-K1-C10
gcgggaagaagggatctggaggcataactgtgaagaagacagggcaagcgatggtggtcggcatctacgacgagcccatgacccccggccagtgcaacatggtggtcgagaggctcggcgactacctcgtagagcaaggcctgtgaatggattcatttaacctcgctcgcttgtccatggttcgcagcaacgataccaacacccgcattatttaattggtagcctcctctagctacgcacgcatttttagtctcctacacgcccctggattgtgcgtggctctgtttatcatctctcatccttcgtctgccaatttttcccttgagatttttgtttctttgttgtcccatgcatttttggcaaataatttgggatttcactcccaaatta

SEQ ID NO: 3338 - DNA, 385 bp, Zea mays
  Clone ID: LIB3228-013-P1-K1-C12
aaaacctatcagttccatgacttcgtgtctcccttgctgactagcagcgatttcgatgcgaagccaatggtcatgctgttgggccaatactccacggggaaaacaacattcataaagcatttactaaaaacaagttatccaagcgctcatattgggccagagcctacaacggacaggtttgttgtcatcacttctggaccagacgaaagatgcattcctggaaacaccatcgccgtccaagctgacatgccatacagtggcctgtcattgttcggaacagcatttttgtccaagttcgaatgttctcagatgccccatccactgttagagcacgtgacctttgtggacacttcaggagttttatcaggggagaagcagcggacgc

SEQ ID NO: 3339 - DNA, 161 bp, Zea mays
  Clone ID: LIB3228-013-P1-K1-C2
gattaattcagcagcaggttctttttataaattctttgttgttatgaagcaggcggtacttttgtagttgaaggggatttgtcgccactatcatttacataattcggacaataatttacattgtgtaatcttgagaatcaaagcactgtttgtgtttatag

SEQ ID NO: 3340 - DNA, 196 bp, Zea mays
  Clone ID: LIB3228-013-P1-K1-C3
gccacgcatacgatcactcgtacgatcacgcatccaaagttttaaatcaaacagggagggttttttcttttcttatgcttatccactataatttggagatagatcccgagctcgttcaatcatttgaacatgtcactacttaattgtgccttgccttgcaaagtttttcttaagatctatatcgcttcatgtaata

SEQ ID NO: 3341 - DNA, 270 bp, Zea mays
  unsure (1)..(270): unsure at all n locations; Clone ID: LIB3228-013-P1-K1-C4
ccggccggancccgggcgcccacgcgtcgtgacgcgtgacgcggcttacatatatattcacctccatccattttgaccagggcgaggcagtattgaggaccataagtcggagatctcgcaccagcctagagcagaggagatgaaagacctttgacccagggcgcggctcttattttgatcggatagtgagacatcgctaacctggctcctattcgtcaacggagttttcggacatccacccggcatttcaatttaattatcaaatagtat

SEQ ID NO: 3342 - DNA, 340 bp, Zea mays
  Clone ID: LIB3228-013-P1-K1-C5
acacaaaaggtggggtatagatataagattattatagatggatggtgacacaacacagcagggcacatggctagcctgctaccgtgctgcacccacacaacacaacacaacacactgctcgccgccagaagcgcccgagggggcaggggaggactacaggacacgacgccgccatcaggcatcatcatcatctcagactcagagcatgccagccatggcacgcaactaactgactgactgactcgaaacacacacagcgacgccgctatactttatttagcttataataattagctagctttctccggccggcctgcagggtggagcacctagctcactt

SEQ ID NO: 3343 - DNA, 398 bp, Zea mays
  Clone ID: LIB3228-013-P1-K1-C7
aacgaaacaagcgcacaagaaaaaatacctcgccgccaacaatggcctccatgtcctccatcctgctcgcaacggcgatgctggctgcgctgtttgcggttggtttgtgcaccaccccgctcaccttccaggttggcaagggatccaagcctggccacctgatcctcacccccaatgttgcaaccatatccgatgtggaaatcaaagagcacggtggcgatgacttctcctttacccttaagggggggaccgaccggcacctggacgctcgacaccaaggccttggtcaaagaccccctttgcatccgctttgctggcaaggctggtggctaccggattggcgacgacgtcattcccgccgattttaagggcggcaccacctacaagaccacacttag

SEQ ID NO: 3344 - DNA, 194 bp, Zea mays
  Clone ID: LIB3228-013-P1-K1-C9
gactatgttccatgagtagtctatagaatgatgtctttttaattcaaaagaaatctctcttctaggctggtgcttttcgactataatttggagattgttccgtgtccgtgcaatcatctgaacatgttactacttattgtaccttgtcgtgcaaagttttgctaagatctctattgtttcatgtcttctgatat

SEQ ID NO: 3345 - DNA, 268 bp, Zea mays
  Clone ID: LIB3228-013-P1-K1-D1
gtcgagcagtggctcgccaccgacgccccgcccttcaagctcgaggccgttcgcgactactgcagcggcgacgccaagggcgcctcggcggcgtgatgtggccggcggccggtagaggagagcacagcacacacgcctggactggacctgctgggtggcttggtttggttggttggtgacgagtcgtaataagttgtgggcgcatgggcgccgcgctcgtgagtggcgtgcgccacgatgcatgcgtgtatggtgatgaacttgaatt

SEQ ID NO: 3346 - DNA, 374 bp, Zea mays
  Clone ID: LIB3228-013-P1-K1-D10
gctatagccagctagtaacaagagcaaaaacaccatcatctcatccgcccgtctcaacgccaccccaatggcccagagcacgaggatggtggcgctggccctggtggtcctcctggtggcggcgacggcgtcggtgcccacggccaccgcgtacgggtggtacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggcttcatcggcgcgcgggctcagctcgatatcagcatcatatacaatcgctgctccgtcgctcacgtcagcccatgcatgatctc

SEQ ID NO: 3347 - DNA, 394 bp, Zea mays
  Clone ID: LIB3228-013-P1-K1-D11
cccggggctagggtttcctcccagccgtcatcgcttcacgtccgctacataccggcgaggagacgaaaggagggagttttgagaagcataaatggctcctaaagccgctcctgtcaagaagggtgatgccaaggcccaggccttgaaggtggccaaggctgtgaagtctggggcaggcaagaagaagaccaagaagattcgcacatctgtaacatttcaccagcccaagaccctgaagaaggccagggacccgaagtacccaagaatcagcactactggaagaaacaagcttgatcagtaccaaatcctcaagtaccccctcaccacagaatctgcaatgaagaagattgaagataacaacactctggtctttattgttgacctcaaggcagac

SEQ ID NO: 3348 - DNA, 391 bp, Zea mays
  Clone ID: LIB3228-013-P1-K1-D12
cccacgcgtccgcggacgcgtgggcagcggcatcggcatgaccaagtccgaccttgtcaacaacctcggtaccatcgccaggtccgggacgaaggagttcatggaagcccttgctgccggcgctgatgtgtccatgattggccagttcggcgtcggtttctactctgcctacctcgtcgccgatagagttgtcgtgaccaccaagcacaacgatgacgagcagtacgtgtgggagtcccaagcgggcgggtcgttcactgttactcgtgacacgtcaggggagcagcttggcaggggcactaagatcacactgttccttaaggacgatcagctggagtaccttgaggagcgtcccctcaaggatctggtcaagaagcactctgaggtcatt

SEQ ID NO: 3349 - DNA, 349 bp, Zea mays
  Clone ID: LIB3228-013-P1-K1-D2
ggaacactcagtgcctgcacgcacgagcaaattaccaggcgtttgcgatgggcggagaggccacgaatgccggcggcgggggtatccgcgcgcggatggagcactacctttacagtggcgagaagaagcacgtcgtcgccggcatcgccatcttcgctgccgtcttcggcgtcccatggtacttcatgacgcgaggggcaaagcatcaatctcaccaagattacatggaaaaggctaacaaggcgagatcagagaggctttcttctggacagtcatctgcactaaaagaatgaatgttgtattgcctattctggtccctgacctttagagcttgtcatagatcatacac

SEQ ID NO: 3350 - DNA, 293 bp, Zea mays
  Clone ID: LIB3228-013-P1-K1-D3
gtcacgcgtccggtcacgcgtccgcccacgcgttcggcgttgtcacccacccatgaaggttggggccgccagcagagttcagccgttcctgttcctgataaaacgagagaaggatggcagtgtctcagggagctgtcctattcttgtttctcctcctcgtcgcagcagaggtggcaaccatctatgccaaaatgggagtagccatgcccatgcatgccttgataatggagaaagcgaaacaccaggagaaggagcagaaggaggtgtaaagcaccgagaaagtagagagtcaa

SEQ ID NO: 3351 - DNA, 356 bp, Zea mays
  Clone ID: LIB3228-013-P1-K1-D4
gctgttgctcagagtcttgttattatatgttctcgcacgcattacagtgttgacgttgttgctgcatggtatactgcgaatttggtcgatttctttgctgataataagcttacagaacttgctgatcgatcagtggggtccacatcagtacttcctgtgagtgcaagggataaagataccaagttgaaagacgaaaataccagattgctgaatggtaactatatggattcagctgatcgcgggccacgaacacagatgaatggaaagcaaattgagaatgaaagccatgttgatagtgaaactgtgagaacatgatcaacttttaatggaggggggcttttgtttgcttagagact

SEQ ID NO: 3352 - DNA, 402 bp, Zea mays
  Clone ID: LIB3228-013-P1-K1-D6
gaccgccccaggctgctcttcgacacggtgtgcgcgctcaccgacatgcagtacgtcgtcttccacgctaccgtcggatcccaggggcctcttgccattcaggagtattacatccggcacaaggacgggcgcacggtcgacaacagcgccgagaggcagaaggtctcccggtgcctcgtggccgcggtggagcggagggccactcatggcgtcagggtggaggtgcgcgccgccgaccggtcgggcttgctatcggatttcaccagggtgctgcgggagcacggcctgtcgctgctgagagttgagctcaagaggcacaaggacgaggccttcggcatattttacctcgtcacggacaccggaggcgaggtgcgcgctgagtcgttgcgcgccgtgcaggcg

SEQ ID NO: 3353 - DNA, 153 bp, Zea mays
  Clone ID: LIB3228-013-P1-K1-D7
gagccatgcatgctgccggatcggagagccgagggccatggaccgatggcgtctctctcccccgcttgttttcggcctctcgtattttggctgtagttcttgctctctcgttctcgtggaatgaaacacgtacgtatggattatcctaccagc

SEQ ID NO: 3354 - DNA, 299 bp, Zea mays
  Clone ID: LIB3228-013-P1-K1-D8
cccacgcgtccgcccacgcgtccggcaacctcgaaggaggaggaggtggtggaatcgcccaagaaagaagcggctctgtcgtcgccgccggcgccggaggccatcgttgccgtagcagcagtggaagacgtggtggcggacaagttcgtgacggttgtgaaggaggcgatcaagaagcaggaggcggaggacgagaaggaggaggcaatgcggaggttccagggcagccgtgtgaggacggcgttggaggcgcgagcggagtcggagcagccgcgtcgtcgagaggtggcgcggagcaa

SEQ ID NO: 3355 - DNA, 354 bp, Zea mays
  Clone ID: LIB3228-013-P1-K1-D9
ggacaagatcgcaaaaatccttgctgcatacggccaggcggccgacgcggtcgctgcggccccgcctcccgagaagctcaaagtcatggagaagaccttctcggcggtcgccgccgccgctcatcaggaggcggcggcggctgctgctgctgctgcagtgattaaggtttaagggagagctcctgcatgaaattaaccacacgtccacacgtatacactacggaacaagtgtttccatcagacgaccatcagtgaaaaaaaaccatccttctttgtgtgtgtgccgtgtttttgtcatttctttttttccatggctagaagaaacggggtatcttttttttttttccacaattt

SEQ ID NO: 3356 - DNA, 320 bp, Zea mays
  Clone ID: LIB3228-013-P1-K1-E1
cccacgcgtccgaaaaaaaatataaaaaaaaaaaaaaaaaaaaaaaaaaaaaaaaaaaggaaaaaaaaaaaaaaaaataaaaaaaaaaaaaaaaaaaaaaaaaaaaaaaaaaaaaaaaaaaaaaaaggggggggccgttttagaggatcaaagtttacttccgcgtgtttgcaaagtattaattttttttttgggtcaataaaattaaattaattggccgatgttttaaaacttgggaattgaaaaaaccctgcttttaccaaattaaatggctttgaaacaaatccccttttgaccagttggctaaatagcaaaaaggc

SEQ ID NO: 3357 - DNA, 237 bp, Zea mays
  Clone ID: LIB3228-013-P1-K1-E10
cccacgcgtccgctgaatttgagggtgttacaccgtcgaacataatatagctgtcggatgtctgtcgttttactgttgtgcgttaccaatggatagcatctaatgggcaatgcaaggacgagagaaaaattataactagagagatgggtcagtcgatggagggtctagaagcatgcaagctccttgaggcaacccttggtgctgtccttggcgttcgtgcatattagccatggtcag

SEQ ID NO: 3358 - DNA, 237 bp, Zea mays
  Clone ID: LIB3228-013-P1-K1-E11
gttgcgcaaggcgggcatcattgacatgcagtttcggagggtcaagtgcaagtatggatctaaggtcaccttccacttggagaaggggtgcaaccccaactacctggcattgttggtcaagtacgtcgatggcgatggcgacattgtggcggaggacatcaaggagaagggctccgacacgtacgagcctttaaagcactttctggggcgccatctggaggaaggacagcgacaagc

SEQ ID NO: 3359 - DNA, 190 bp, Zea mays
  Clone ID: LIB3228-013-P1-K1-E2
atcacatcatgcatatgccatcgccaccactcatcaccggatccgggagttcggccgtagattagatctcgcttcgttctcggttcagttcgtccatgtcctctcatgataattgtgtcagcaaactttcaatttatttggcttgtgctaaagcacaataatatatcatatgtttagtactgcataggtt

SEQ ID NO: 3360 - DNA, 393 bp, Zea mays
  Clone ID: LIB3228-013-P1-K1-E3
atccccttcaatccccctcaaaccactagtaaccgaacgtggcctgagggggcgggcgagtctttatattgaatgaaactacataaaatagcatgccgtctctgtcactggcaatggacggtggtgcctagcgcaactcagcgcacaactgtgtgtcttgatttttcttctgtttatcacggcattagtgccatgccgttttatgttacagtgttgtgtgctcgcaagcatccgaaaatatgcgtctgagtttagggttgggtcaaacttgtcgaatttggggttctgttataatatggtgagcatgaataaagatggatgctggtgactctgtcggcatcggcggccatcatgagtgttctgtaattcaacctataattatcatgcatgtat

SEQ ID NO: 3361 - DNA, 74 bp, Zea mays
  Clone ID: LIB3228-013-P1-K1-E4
cccacgcgttcgctgaatttgagggtgttacaccgtctaacataatataggtggcggatgtctgtttttttact

SEQ ID NO: 3362 - DNA, 319 bp, Zea mays
  Clone ID: LIB3228-013-P1-K1-E5
cccacgcgagcgatgaatatgaggcagtcacaccgacgcacataatatagcgggtggatgtcaggcgatttactgttgtgcgtgaccaatggatagcatctaatgggcaatgcaaggacgagagaaaaattataactagagagatgggtcagacgatggagggtttagaagcatgcaagcttcttgaggcaacccttggtgctgcccttggcgatcgtgcatatagtcatggtcagtcgatggagggtctagaagcatgcaagctccttgaggcaacccttggtgctgcccttggctgtcgtgcatatagccatggtct

SEQ ID NO: 3363 - DNA, 115 bp, Zea mays
  Clone ID: LIB3228-013-P1-K1-E6
cggacgcgtgggttattttttttaatatcattatatatttttcaattttaaatgagtgtttttataagttaaatttaaccaataaaaggattaaaatagaaattttttgtaaaaa

SEQ ID NO: 3364 - DNA, 273 bp, Zea mays
  Clone ID: LIB3228-013-P1-K1-E7
cccacgcgtccgcgcagctgcgaggctcagggcggctgcaaacgagaaggcggaggcggagaagatcgtgcagatcaagcgcgcggagggggaggcggaagccaagtacctgtccgggctgggcattgcgcgccagcggcaggccatcgtggacgggctcagggacagcgtgctggggttctccgtcaacgtgccgggcaccaccgccaaggacgtcatggacatggtgctcatcacccagtacttcgacaccatgaaggagatcggcgcgtc

SEQ ID NO: 3365 - DNA, 357 bp, Zea mays
  Clone ID: LIB3228-013-P1-K1-E9
gggggcactgctcgacccccgccagggccggcgctgcctccaacccctccgaccagcaccccaaattgggatattcaccaccgagagagagaacagggagccgtcggaaccctccactgtcgtccggcgtgcactgcactaattggtgccctatgcgtggtcgggagaatccatccaagctctaggatcatgttgatggtggtggctgggagggagtgcgacctgggcgccgccaatttgacgttgtggccacgaattcggggcacgccgtgggcagggaaaggcactacgtggtcactacgagcaagtgaccgaggaccccgatacctatgaggtggaaaacgctgaacatgagct

SEQ ID NO: 3366 - DNA, 233 bp, Zea mays
  Clone ID: LIB3228-013-P1-K1-F10
cccacgcgtccgggccaaatcaggaagatggaggcgatctttcccaagaaacacgcgagattgtcaagcctgttgcagttcattcccagaatccaattaatgttgatgaactcgtgggcatgtcaaagctaagcatatgggagcatggtcaggagacagtgtctacttctctgtcgcttaataagctagggggggaaaaaagggatttggatttctgtgcacacgctcaaaca

SEQ ID NO: 3367 - DNA, 395 bp, Zea mays
  Clone ID: LIB3228-013-P1-K1-F11
cggacgcgtggggccatatttgaaacagttaagaattcatatataagagtgcatgtatatatatataattctgccaagacaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagttcgatggtggacgtttattctatttattggcttacttgattttttttcccctaacaataagaa

SEQ ID NO: 3368 - DNA, 86 bp, Zea mays
  Clone ID: LIB3228-013-P1-K1-F12
cggacgcgtgggcggacgcgtgggtttaattctttgactgttaagagtactactgtttgatcgtttgaattatacacgttcatttg

SEQ ID NO: 3369 - DNA, 344 bp, Zea mays
  Clone ID: LIB3228-013-P1-K1-F2
gggagattcggaggaacccttgccgtaatttattcaaaagaaccattcctgtaattaggatattgcttctgtgctggtatgcaagtatagttctgaaggccagccacctgttcagctgttggtgtccctacttgttgtctttattgttcattcatcatctcaatggaatgtgatcgtaattcataatcgttttatgactgatttgtactgtcattataattgtcgaacctccaaaaaaaaaagttgccgtcgagcatccgaggtatttattagtttgagtgagtaatgggattcaccataacactgtaagcctgttactccaatgcctctaaagcatgtttttt

SEQ ID NO: 3370 - DNA, 251 bp, Zea mays
  Clone ID: LIB3228-013-P1-K1-F3
cttcaggatcggaggatcatttattattctaaaaatgaccacctaaataaaactgctttatatattaaaccatgtacactgtatggcgctaggacaagacatccatatcacctagagctcagaattcttcacacatacaatcctacatttctaaaaatcaatattatgcctcctcattacataatcacaggaaattccaccccaacgttctccaacccaccgaaataataaaaattattattataatatta

SEQ ID NO: 3371 - DNA, 392 bp, Zea mays
  Clone ID: LIB3228-013-P1-K1-F4
ggcaagcccaagcaccagggtatcacccagctcaagttccagaggaacaagaggtctgtcgctgaggagagagctggacgtaagcttggtggactgagggttcttaactcctactgggtgaatgaggatagtacctacaagtactttgagatcatccttgtggacgttgcccacaaagccatcaaaaccgacccgaggatcaactggctatgcaaccctgtgcacaagcaccgtgagctccgtggcctcacctcagcaggcaagaagtaccgtggcctgcgtggcaagggccacacccaccacaagaacaggcccttaaggagagccacctggaagcgcaaccagaccctctcccttcggcggtaccgcttagcagcttgtcgggtgctttg

SEQ ID NO: 3372 - DNA, 354 bp, Zea mays
  Clone ID: LIB3228-013-P1-K1-F5
gacgaagcaaggaacgcaccccgaatcccaactcctgtgtccgccatcgcctcggggcgggcgctcctgcttctgctgctgctgctgctcccccagccgctcccgcccggagcacgccgccggcgccgacgccggcgcgtcgcatggatatggcccccgcgtctgtctacttcaatccgcgctcgggcgaggaaatcttcaaggacttctccggccgccgcgcggggctcgtccgcgccctcacctccgatgtggacgatttctgcagcttgtgcgacccagataaggagaatttgtgtctctacggccttcccaacgggagctagtgaggtgtcgtcgccggcggagggaggt

SEQ ID NO: 3373 - DNA, 376 bp, Zea mays
  Clone ID: LIB3228-013-P1-K1-F6
cggacgcgtgggcgcggacgcaccggtggccgtcgccgacgctcccgctcctgctcctggccccgactccttctcgaccccgtcgccggcaccctccagcagcagctcttccgactagccgcccggcagagatatctacggcgtccgatcagtctttggcgccacctataacctatcggatcctgcaaagctatatatgattctatggtataatgtgtggttgcggcaaacgcgcggaaataatgtgcttgcgtgattgtttttctctctctttttttgtttaataatgtaaaacaggcatacggcgatgttttaacatgtaaactgagatgttgttactctttctcaaagcgagtttgtagccccagttttcatc

SEQ ID NO: 3374 - DNA, 393 bp, Zea mays
  Clone ID: LIB3228-013-P1-K1-F7
cccacgcgtccgggcggaggagcggaggtaggagatctcgagcaaggccggaggcaggaggagatgaagacgttcgacccgtggccggtcttcttccgccgggagtggaagcgcaactggcccttcctcacgggtttcgccatcaccggattcatcatcacgaagatgacggccaacttaaccgaggaggatctcaagaactctaagttcgtccaggaacacaagaagaagcactgacgaaccaggtgaaggagttgtcagaaacgcatgtttggccagccagttctgttatgcttttgaatgaaaaattaagaccctcttttctcgtttcctttaatcgaaatgcttgcactctatgttccatttgtaatgtaattagagggcaatggattg

SEQ ID NO: 3375 - DNA, 384 bp, Zea mays
  Clone ID: LIB3228-013-P1-K1-F9
aagccacaacacatacaggaaaagcaagcaagaatcatcggaataatggctcgtgcatgtgtgttcctcgtcgtgctcctcctggccgccatcgcggtggcaccgttcgcgggcgccgcacgcgtggacgtcgtggagggtaggtccatggcatccgccgatgcaccggaggcggcggccgatgctcccgctcctagccccgactccgcctcatccccagactcatcgtcagaggcgccctccagcagcagctcctccgactagacgcaaaaacctcttcattctctggaataactaacagtatatacgttgcaccctgatgatatagaaacatgtacgtgcatcaatgtatggaatgcgagtggcaaacacatggaatgggct

SEQ ID NO: 3376 - DNA, 227 bp, Zea mays
  Clone ID: LIB3228-013-P1-K1-G10
gcgtggacaacgtgggcggactcataggatgtagggaaccaggcacaggccttgatccataccgtccatgagatagcatcagaacatgcaacgcctgttacaagaccactgcaagagcggtttgggcacacacctgtacaccaatttgttgcaggcgaggttgtgcgagaagtacacacagctacatcgatggatgcgttcatgatcgtagacaactgcgcaaatgt

SEQ ID NO: 3377 - DNA, 360 bp, Zea mays
  Clone ID: LIB3228-013-P1-K1-G5
gtgattcgaaataattgggaataaatagctcgtgaatccctgaagcgtgcatatatatattcctgccaagataaaggtaatggagtcgtcacgcaggttccagccggccgccattctgcttctgctgctcattgagtccaccgatatggcacaggcaagggaatgcgagacgtacagcgagcgatttgttggggcatgcatgatcgcagacaactgcgccaacgtgtgccgcggtgagggcttcttggccggcaggtgcagcaccttccgccgccgctgcatatgcactaggcagagctaaacaagatcgctcgatcgttcgtcatgcatagacaaccctatcttaataacgtccattat

SEQ ID NO: 3378 - DNA, 399 bp, Zea mays
  Clone ID: LIB3228-013-P1-K1-G6
accaaaccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgtaatcgtggccactcgatcgagagatcgatcgatgcttgttattatattt

SEQ ID NO: 3379 - DNA, 104 bp, Zea mays
  Clone ID: LIB3228-013-P1-K1-G7
tccgtttagacgatccaagattacgtacgcttgcatggcgggtcatacctcttgtataggtgtagctaaatttaattcactggccggagtttacaccttttggg

SEQ ID NO: 3380 - DNA, 359 bp, Zea mays
  Clone ID: LIB3228-013-P1-K1-G8
cggacgcgtgggcgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagtcacgaggaggacatctgcgaggtggtcttggtggagagcccgcgcaaggactgcgaccaggtgcaggcggacagggaccgcgccggt

SEQ ID NO: 3381 - DNA, 60 bp, Zea mays
  Clone ID: LIB3228-013-P1-K1-G9
agaccggccgaatcccggcgccacgcgtccggaccatgcacctttacaagctaacatcct

SEQ ID NO: 3382 - DNA, 312 bp, Zea mays
  Clone ID: LIB3228-013-P1-K1-H1
cctcgctcgcttgtccatggttcgcagcaacgataccaacacccgcattatttaattggtagcctcctctagctacgcacgcatttttagtctcctacacgcccttggattgtgcgtggctctgttaatcatctctcatccttcgtctgccatttctcccctgagatttttgttccttgttggtaccatgcattttggcaaataattttgtgattccactcccaaattaaagtttggttgtcgtatggtttgtaaacccagaacaatatatatatgtgtgtgattgaaaaaaaaaaactattttttattttt

SEQ ID NO: 3383 - DNA, 301 bp, Zea mays
  Clone ID: LIB3228-013-P1-K1-H11
gttctccgaggctcgtgaggatctggctgcgctcgagaaggactacgaggagggcgtgctgagtttgacgagggtgaggacggcgactagggtgacgagtactagacgctctactggcgcggcgtcgtcgggcttgtgtgccactgctatcctgtgatctgccctgagtggctcctatcgagttatgtgtctgttggttcttatatatctgtcggtgtgtggtttacaacttacgttgtaagactttatttccctcgctttgtactggggtattaagtatggcgtcattggtttctttgac

SEQ ID NO: 3384 - DNA, 312 bp, Zea mays
  Clone ID: LIB3228-013-P1-K1-H2
cgaacacgcgcacacgaacaaataccttgccgccaataatggcctccagatcctccattgtgctcgccacggcgatgctagctacactattcgcggttggtttgtgcaccaccccgctcaccttccaggtcggtaagggatccaagcctggccacctgatcctcaccccgaacgttgccaccatatccgacgcggagatcaaagagcatggtggcgatgacttctcctttacgctgaaggagggcccgaccggcacctggacactcgacaccaaggccccgcttaagaacccccctttgcatacgcttttgc

SEQ ID NO: 3385 - DNA, 414 bp, Zea mays
  Clone ID: LIB3228-013-P1-K1-H5
cggaaacccggggcgacccacgcgacacggaaaaccgaggaaagagaggaaaaaacagcgcacgagaaggaccacaaggaggggggagcagagaaagacgagggagaagacaaccacaaggacgacgagaaccagacacccaacaggaaacggaaaaacaggcaaagagaccaacaggaaacaaaagaacaggacagaaggcaaaaaaaagaaaagagaaaaggaacacagcaaaaagggagaaggagaaaaaagaaaccgaaaaaaagaaaacacaaagaaaacagaagaaaaagagaaggaaaaaaagaaacaaggaaaaaaaaaaaaaaaaaaaggagaggcaagccaaaagaaacaagaaaaaaaaacacaacaaacaaacagaaaaaaaaaagaaaaaagaaggaaccc

SEQ ID NO: 3386 - DNA, 168 bp, Zea mays
  Clone ID: LIB3228-013-P1-K1-H6
tccactgctatcctttgaacttccctgagtggcttctatcgtgttatgtttctgtctgtccttatctatctatcgctgtgttggtttacaacctaccctgtaagactttattcccccccttttgctcctgcgttatttaaatttatccataattttatttctttgatc

SEQ ID NO: 3387 - DNA, 98 bp, Zea mays
  Clone ID: LIB3228-013-P1-K1-H7
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3388 - DNA, 402 bp, Zea mays
  Clone ID: LIB3228-013-P1-K1-H8
gccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgctggtgatcggcatctacgaccagcccatgacccctggacagtgcaacatggtgggtgagaggctcggggacttccttctatagcaaggcctgtgattggatgcattcaaacaaccacaccaacggcaacattaaattaatttgggggctttcactgcccctgggaattggggtgggcccctttcctataaaaccccacccatatttttttttgggggtttttttttccc

SEQ ID NO: 3389 - DNA, 396 bp, Zea mays
  Clone ID: LIB3228-013-P1-K1-H9
cccacgcgtccgcggacgcgtgggagaacgcctgcatcaccaagagcttcgagtttgagaagctgctgcgcgtcacgctcgacctcatcaccgatgcctcagggtccatgtcggccgaggtcgcactgcctccgtcggcggcatcgggcgccagcgggccggcaccggcgccgttcggaggttacggctcgtccgctggcgccccggcctacggcgcgccgtctcctgctggtgacccagcttatggcgccagcggctcgccggcaccaaccccgctgtagagtgtactgcttccgacgcgtacgcgactgcatgcatgagcgatatataatgtcaccttggtgcagactcctgcgctccgaaggattttttaaatatttttaaatatttttaata

SEQ ID NO: 3390 - DNA, 61 bp, Zea mays
  Clone ID: LIB3228-014-P1-K1-A12
agctgtctctaaatttcacggcaagtcgtgtgcctgaaccttcatcttaagttggtgtcgt

SEQ ID NO: 3391 - DNA, 240 bp, Zea mays
  Clone ID: LIB3228-014-P1-K1-A2
cccacgcgtccgcccacgcgtccgcgtccatgtacttcatggccggctacgccttcttgctgcgcaccaagaaggagccgtcgttcgaaggcttcttcgagagccggttcgcggccaagcagaagcgcgtgatgcgcgcccggggcttcgacctccgcaggtacgaggagctccggagagcctgctgcgtggcggcggcgccgccgccgctccaggcccggaccccctgcgcgggcgcgg

SEQ ID NO: 3392 - DNA, 366 bp, Zea mays
  Clone ID: LIB3228-014-P1-K1-A3
tgctgcacttcgctggcgacgcggagatgtcggtcccgcgggacagctacttccaagagccgagccccgggatgatgtgcctggcggtgatgcaggcgccatttgaaggcgcccccaatgtcatcggcaacgtgcagcagcagaacatgcatgtgctctacgacctgggcaaccgcaagttctcctatgcgcccaccaagtgtgacagcatttgagatgctacttatcacatgcatgcaacgcaactagtaccatgcaaacataattttcgggtgtttttttttgtgcgtctatcttcaaaattcagaggcccagataatttctatagtcgactaattatttcatcaagaaataaagtttttttta

SEQ ID NO: 3393 - DNA, 244 bp, Zea mays
  Clone ID: LIB3228-014-P1-K1-A5
aaattttaaggccgacaccacctacaagaccaccctcagcatctgatcatcctcttatgaggaataatattttgaaagagctcatctgatccatgtgccagcgagctaatatttaattttttttctatggttattttatggcaccacaccacccaagaaataagttatgttacatgtcccttcgtgcaccttgttgtgttgggttaatacggttatataaattgaaatacaatatgtatttaat

SEQ ID NO: 3394 - DNA, 228 bp, Zea mays
  Clone ID: LIB3228-014-P1-K1-A6
cccacgcgtgcgcccacgcgtccgctcccatgttcataaaaaaaaaacataatataaatgaggaaaaatatttagaaagaagctaataaaatccatgtacaaaaagagctaatatataaaaaaaaataatatgaatataataagggggggccgctttaggggatccaagtttatgtccccgggcttgcgagggcatattttttttttgggggcacctaaattaaatta

SEQ ID NO: 3395 - DNA, 386 bp, Zea mays
  Clone ID: LIB3228-014-P1-K1-A7
ggggcccccgtccggaacaagggcaaaaaccacaatgttttaatccgcccgtttaaacgccacccaaatggcccagagcacgaggatggtggcgctgcccctggtggtcctcctggtggcggcgacggcgtcggtgcccacggccaccgtgtacggttgctacgacgactgctacgagcggcgcgccaacggaaggagggccccccctgcttccacaagggtgtccagccgggcggcagcaaccacaaggagggcgccgccggcgcgccgccttgatttacccaaccttcatttttgcgcgggctcggctcgatatcagcatcatatacaatcgctgctccgtcgctcacgtcagcccatgcatgatctcttgacccggcccattg

SEQ ID NO: 3396 - DNA, 391 bp, Zea mays
  Clone ID: LIB3228-014-P1-K1-A9
acctgctcactgacgccaatcccatccaggtggtcgtggacgccattatcaacagtggaccacgtgaggatgccacccgtattggttcagctggtgttgtgagaaggcaggctgtggatatctcacccctgagaagggtgaaccaggccatctacctcctcaccactggtgccagggagagcgctttcaggaacatcaaaaccattgctgagtgccttgcagatgagttgatcaacgctgccaagggctcttccaacagctacgccatcaagaagaaggacgagattgagcgtgttgccaaggccaaccgttgagtggagcttgtatcctggtgcacttgcactagaactacgtttctggcagtcgtatttttttcttgtgtttttaccca

SEQ ID NO: 3397 - DNA, 206 bp, Zea mays
  Clone ID: LIB3228-014-P1-K1-B10
aaaatagtttactagtaagttaattattagcgctatgtaactgtaacataagtaggggcaagttatcggggttctaatatttagaaactttcattcgtgggcagcacttaactatttaagtttgccctcctttattataaattgaacgaggggccatgggcgctacatgtttatattactggacatctcgcctggcatatattatc

SEQ ID NO: 3398 - DNA, 279 bp, Zea mays
  Clone ID: LIB3228-014-P1-K1-B11
gtcttccctgcactattcacaatcttttccatttaaaaaaaaaaaaaaaaaaaaaggaaaaaaaaaaaattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataatggggcgcccctttttaaaatctaaatatattgtccctaaaaaaaaaaaaaaatgtttttttaattgagaccctaaaacaaatgtaaaagtccccgat

SEQ ID NO: 3399 - DNA, 334 bp, Zea mays
  Clone ID: LIB3228-014-P1-K1-B12
cggacgcgtgggcggacgcgtgggcggacgcgtgggcgaccgcgcgctcaaggccgagtttcgccccctctcgggacgcgtcgacgacctccgctggtccccggacggcttacgcatcgttgtctccggggacggcaagggcaagtccttcgtccgcgcattcgtatgggactctggcagcacagttggtgagtttgatgggcactcaaagagggttctgagctgtgacttcaagccaacacgtccatttcgcattgtgacatgcggtgaagattttctggctaacttttatgaaggaccgccattcaaattcaagcattccataagggatcac

SEQ ID NO: 3400 - DNA, 119 bp, Zea mays
  Clone ID: LIB3228-014-P1-K1-B2
cgaacgaacccggcgcccagcgccgccaccgcgccacgcgacgtcccaagggaaccgcgccgcgcggagggggaccacggggaaacggaagagctccttgtcgaacttgataccagaag

SEQ ID NO: 3401 - DNA, 324 bp, Zea mays
  Clone ID: LIB3228-014-P1-K1-B4
cccacgcgttcgtccacgcgttcgcccacgcgttcgcccacgcgttcgaccacgcgttcgtccacgcgttcgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaataaaattaatagaaaataaaattaaaaaataataaaaaaaaaaaaatattgggggggcttttttaaaaattaaatgttttataactgtttattcgcagtgttttttttttttaatgggggctaaaaattaattcctttccc

SEQ ID NO: 3402 - DNA, 396 bp, Zea mays
  Clone ID: LIB3228-014-P1-K1-B5
cccacgcgtccgcggacgcgtgggtaatgatgcgccgcaagtcaagtgcaacattactaaagcagagaagctggatccggcaatagagagttcttaccttctaggggtaatcaatggcctgttgcaggatgacactggctcatcttctggggcgcaaggtgccatggcctacaatgttggtatcagcaacactggcgctggacgaagtgtgccaaccaccaacagtgcctacaccaccaatttgagtggtccaaggtatggcgagtctgcaaaccagctcgcgcagcaggaaagcacgtacaccggggtgaccactccagtgtcggcggcacggaatgtgcagcagacctgcgtgtcttgcgggtcaagtgggcacaacgtgcagaactgccctgc

SEQ ID NO: 3403 - DNA, 370 bp, Zea mays
  Clone ID: LIB3228-014-P1-K1-B6
cccacgcgtccgcccacgcgtccgcccacgcgtccggggagatcgcgactggtaataagcggcgataagatctcacgacttggggccatatgttggatgcagatttgattcagtcggcacttccacatgcatgtgtcatctgttcgtttctcaataaattctgcgtcatttgctgctgattgtacttgacaagtagagacatggatggactcttaaaattccatccatgtgttaaatgacatattcgagacatccttttctcaataaactctgcatcatttggtgaattgcacttgagaagtaaagacatggagccttaaaattccatacttgagtttaatggcacatttgagatatcctttttctcctt

SEQ ID NO: 3404 - DNA, 389 bp, Zea mays
  Clone ID: LIB3228-014-P1-K1-B8
gctgattagccacttctccttgtcgatctagagcctggacgctggcgcgggtgtgcattggtcatggtgccatggagaagatggacggcaaccactacagatacaacgacgagccaatgactcacgagtagcacagacgccaaacgtcggatggctagggttaggacacaaactgatatagagacatttaatcttttatcgtctttactgccagttgagtcattaagatggcattttatatgacatacattcaaaaaagatgacaaaagattagattgtcctgttagatgcgattgtgatggaaaatagtgggtcactgagtgagacatttgggatggtctgaatacctactactatatccactaatcacaacagcccgagcagaatct

SEQ ID NO: 3405 - DNA, 85 bp, Zea mays
  Clone ID: LIB3228-014-P1-K1-C10
cggacgcgtgggcggacgcgtgggcgatgttcttgtcccagttcagaaggccatgttgtttaagcggccacttctattctttaac

SEQ ID NO: 3406 - DNA, 390 bp, Zea mays
  Clone ID: LIB3228-014-P1-K1-C11
atttgaaacagttaagaattcatatataagagtgcatatatatatatataattctgccaagacaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagttcgatggtggacgtttattctatttattggcttacttgattttttttcccctaacaataagaaaacgcacgtgct

SEQ ID NO: 3407 - DNA, 193 bp, Zea mays
  Clone ID: LIB3228-014-P1-K1-C12
aagatagtgaaaacggacgtgcactattatagttctgtaccactactaaacatggggcaattcattgaattatttatttctacccacacgtagtattagttgtcaggcgctctaatactagatacctgtttacctgaacgatagaactcaacgagagggtgttggagatagttggacataaacttgttgactg

SEQ ID NO: 3408 - DNA, 140 bp, Zea mays
  Clone ID: LIB3228-014-P1-K1-C3
cttggcctttgctaggagattagaacagttttcaagtgagcctaggatccatgtgaacgatttgaatatctcgcctcttgtcttgcaagtgttctcatctgctgttaatacaaaatcagcaagagctagtattttgttca

SEQ ID NO: 3409 - DNA, 386 bp, Zea mays
  Clone ID: LIB3228-014-P1-K1-C4
gaacagcatcacggccgtgatccgctacaagggctccaacgccccgccgccggccaaggtgccggagagtcccagcgggtgggcgtggtccatcaaccagtgcaggtccttccgctggaacctgacggcgagcgcggcgcggcccaacccgcaggggtcgtaccactacggccagatcaacatcacccgcaccatcaagctcgccatgggccgcggcaaggtggacggcaaggagcggttcggcttcaacggcgtgtcgcacgtcgaccccgagacccccgtcaagctcgccgagtacttcaacaccaccgacggggtgttccagtacgacatcatcggcgacgtgccgccctccaagttcgcgcccaccaagatggcccccaacg

SEQ ID NO: 3410 - DNA, 394 bp, Zea mays
  Clone ID: LIB3228-014-P1-K1-C5
gcgcgcggagagtgagagcccgggagaagcagcggctgggggcaagatggtgcagcggctcacctaccggaagcggcatagctacgccaccaaatcgaaccagacccgcgtcgtcaagacacctggtgggaaacttgtgtaccagtacaccaagaagcgcgcgagcgggccgaagtgcccagtcaccgggaagaagatccaaggaattccacacctgagacctgctgagtacaagaggtccaggttggcaaggaaccaaaggactgtgaatcgtccatatggtggtgttctgtctggtactgcagttagggagaggatcatccgtgcctttttggtcgaggaacagaagatagtgaagaaggtgttgaagatccaaaagaccaaggataaggcc

SEQ ID NO: 3411 - DNA, 354 bp, Zea mays
  unsure (1)..(354): unsure at all n locations; Clone ID: LIB3228-014-P1-K1-C7
gatgttaccagactcccttcggatccaaggagtattcagcgtaatgagagaccaatgagattgtcaggcgagccatctgaacatcttcagagctccaagtttgagaaccaagatagacaactggctactgagtctggtaaacatagccctgatggatgtttacaatccaacgagccggaagggcaataaaaaattgtgtacttcagctcttcgaagatatttgttttgttacgtagtgttgttatcagcttttaggctgtagctgtagatagagaagttttggaacagtgagcttatacggcttaccggtttacatagtgagcagttaatatgcgagttgcttgnnnnnaaaaa

SEQ ID NO: 3412 - DNA, 389 bp, Zea mays
  Clone ID: LIB3228-014-P1-K1-C8
gggaaatcctgtgccccgttccccaaaggcttcttcttcacgacgtccggagggctgaggagctacgagcaccccatgcacgaggtgaagccggtgccgagggtggacagcaagggcgaggtgtgcggcacgacgtacacggtcgacgcaaccgccaggaaggagaccagcatcccaagggtcggcagcgccgccgattggtcttcgcagtactaaaattcgttatctttctctgtgtgtgttgaacgggttcgagcgcaggtagcaggtgacacgggcgtgggccgtgtttgttcgtatggaaaccgtgtctggtgtttgttcgtatgatttccgttgctgctttgctgcacgcctgtactgtgacaagaattactgcctttgctatc

SEQ ID NO: 3413 - DNA, 334 bp, Zea mays
  Clone ID: LIB3228-014-P1-K1-C9
tggttttggaggttatgcaacgaccagatatacttgcacttgaaaatggagtacatgttgatgaagtggcaaggagacttggaatgccaagcgcacaaattctggccaccgcccagcgtcttgtcaatttggcatgcctctgttccactattgatgattatcatttcaagtctattaaatgattgatcaatgttaccatcttcaagacttggcattttagattattggcagtttttaggcccctttttatttttttctcgaaaggcgtaggaaaactgcacccccatatattaagaagaatgaaagaaggttatgcttatgagttatgaactaa

SEQ ID NO: 3414 - DNA, 287 bp, Zea mays
  Clone ID: LIB3228-014-P1-K1-D1
ccccccgaccccccgcccaattccgggggcgccccgctccgcagaattgacatgctatgcctcggcagttcagcgttgaatatgctctataggaggactggatattgcaaaaaaggagtgctgactatgggccctttggcccgatgcttcgtttcaaggtttagccatgaaattaacgtttatgtactctaagaggaggtgatttgcatctcaactaaacatttgagtatgcagttaagttgatttgtccagttaaatatgtagaacatgttcctccttcataggtc

SEQ ID NO: 3415 - DNA, 371 bp, Zea mays
  Clone ID: LIB3228-014-P1-K1-D10
cccacgcgtccgcccacgcgtccgaaaaaacgatctagcaccgcgaaggggctactgttgggggtctgcttcgtcgccgaaggtcctgtaagaagaaacaccttcagaagatcagcacagaagtaacgccgaagctaccatccagggagctttggcatagcgacacgacttgagacgaagggttgcaccgacttaaagatgaaaagaccgatcggtccatgataatttgtgtcatgattataactagttgtaaaggacataaatgtaattttgaccgggctgcgtcccgtgcctataaataggtgaacagtatccccgtactgttcacgttggcttgtattcgctcgtgcgtcacgcttggacctatacct

SEQ ID NO: 3416 - DNA, 236 bp, Zea mays
  Clone ID: LIB3228-014-P1-K1-D11
accacgcgtacgttaaaatgtgactaataacgttttctcacacggaagcacatgcggctatttaagcattttgctgtctcttgatacatattagtcgcaatcatggactaaactactatatgtttgcacaccgttcttacttattgaaagagagtcagcggctgataccaaaatattgtattggtttcttgaaagaactataaattcatgatgttatattttattgtttagaaagt

SEQ ID NO: 3417 - DNA, 304 bp, Zea mays
  Clone ID: LIB3228-014-P1-K1-D12
aaaatagttaactagtatgtttactattagagttatgtagcactagttaactagtcgttatttcttcaatttcttatatctagaaacatgtttttagttgtcaagcacttcaataatatatgtttgttttcctttattataaatttaaagagagtcgttgttagctttttgtctatagtcttgtttactcaagagttatatatatttgtaatgtgtcgataaatagtataattctacaggtacaatcacaagttcgttgctgtgcaaaaaaaaaaaaaaaataaaatgtaaattcaaaaaagta

SEQ ID NO: 3418 - DNA, 392 bp, Zea mays
  Clone ID: LIB3228-014-P1-K1-D2
cccacgcgtccgctcctcttcccccgccgggcaacaactcagccgccgcaaccgccacatcagccatgggcgcctgcgcaaccaagcccaagacgcttgaggggcaggccccagctgaggccgccgtctccacacccaaggttgcgcccgaggccactccaatctccgttgagatctgaataatggatgtgccatgcatgcacgtacgcacaggttgcggctgatgaacaggtagctgagaaggtggtggtggaggagccggctgcggcggccgacgttgagcatcagaaggctaatgaggtgctcgctccagaggcggccgtcgccgagcccgaccacaaggaggaggaagccgtggagaagaccgtcgtcgaggaggagaagccagcggc

SEQ ID NO: 3419 - DNA, 396 bp, Zea mays
  Clone ID: LIB3228-014-P1-K1-D6
gtgggatccaactgggagatatctcgcgactgcagttacctcagttcatgaaatggagaatggctttcaaatatggtccttcagtggcaagcatctttacaaggtgtcaaaggatcatttctatcagtttatatggcgcccgagaccgccctcactactgacggccgagaaggaagaagagatctcaaggaacctgaagaagtatagcaagaagtacgaacaagaagaccaggatgcattcaatcagttgagcgagcaggaccgcaagaggcggacacagcttcaggaagaatgggactcatgggttgccaagtggaagcagatgcatgaggaggagcgtgtttacaggagggagctcagggatggggaggccagcgacgacgaggaagagtatga

SEQ ID NO: 3420 - DNA, 387 bp, Zea mays
  Clone ID: LIB3228-014-P1-K1-D7
ctgatttggcgtcggatttttgtttgtcatctgtcattcctgtgctgatctgaattgctgtttgtttattattattattattacaattactatcaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaagaatcaaagtttacttacccgtgcatgcaacgtaaaaatttttttatagggccaccaaaattaaattaattggccggggttttaaaacgttggaattggaaaaaccctggctttaccaaattaaatggctttgaaaaaaatccccttttcgccagttggggtaatac

SEQ ID NO: 3421 - DNA, 390 bp, Zea mays
  Clone ID: LIB3228-014-P1-K1-D8
cccacgcgtccggagacgcacatctatctgtcaagcgacgccgcggcctcgatcagagtcggaggcgaacacccccatggcggcggctggcggcggcgcaggagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatcaacccccagcaaagtgcaggcaacgtgtttctgaaacatggttcggagctgcgtctcatccctcgcgatagggttggagctgtagtcatgtcttccggttagaggatatatacagtcca

SEQ ID NO: 3422 - DNA, 387 bp, Zea mays
  Clone ID: LIB3228-014-P1-K1-E10
cccacgcgtccggaacaatgtgaagaagaacttctccctggtgggaggcacatgcgtgtaacaaatgataatgttattacttttatccatcttgtcgccaatcatcggttaaactaccagatccgtgcacaaagtacacacttcttgagaggttttcagcagcttataccaaaagattggattgatatgttcaatgaacatgaaattcaggttcttatatctggatctttagaaagcttggatattgatgacctgcggtcgaacaccaactattctgcaggatatcatccggaccatgagcttattgagatgttttgggaggtcttgaagagcttaagttcggacaaccagaaaaagtttctcaagtttgttactggatgttctcgt

SEQ ID NO: 3423 - DNA, 392 bp, Zea mays
  Clone ID: LIB3228-014-P1-K1-E12
tgacctacattaatcagctttgtgagcgtcttccttctcccatgggagaatgaggcgtggactgtgccagtcttgggtccatgcccgacattgcgttcactattggaggcaagaagttcaagctgaaaccggagcagtacattctgaaggtcggtgaaggacaagctgcccagtgcatcagtggattcacaggtatggacatcccaccacctggtggccccctctggatcctgggcgatgttttcatgggagtctaccacaccgtcttcgactacggcaagctgagggttggcttcgcggagtcggcctaaggaaacgtatggtttggcgcctactccagaggaggcaaaacgcatgcgccgagagagaagcttcgcttggttttaacttgt

SEQ ID NO: 3424 - DNA, 391 bp, Zea mays
  Clone ID: LIB3228-014-P1-K1-E2
cccacgcgtccgccgcgagaaccctcccacattgacaagacctaaaacatccgctagctcacgaggactgcaccacgggagaatcggtcgtcgtcgttgggatgacttcgcggtggctgctcctcggtggttctggggattatcggaggcggagggcgtgccttagcagggagcacgttgcgaccggagcaagttcgccggagaagaacatgcggtcgaagaggagccgcctaacgaggagttcgacttgatcttggtggcgtctcccagtcagcttttgtgtcgccggggaaataatatttagttcgttttatattaatcattcattttgtaagacttatgctatgtaataagtacatttataatatttatgacatttatctctatgcac

SEQ ID NO: 3425 - DNA, 391 bp, Zea mays
  Clone ID: LIB3228-014-P1-K1-E3
ccgcaaggttggtgagtccgttgaggagatagaccgccgcgtccctccagtggtgaaggaagccccaaccttggcccgctcggctgcgaaggaggttcgccaggccggcctggtgggcacggccactggccttgccaagtcagccatcgcccgcgccgagccaaaggcccgggagctctacacccgctacgagcctgtggcagagcggcgtgccgccgaggcctgggtggccctgaaccgtctccctctggtgccctcggtcaccagggccgtcctccccactgccgcacagctctctgccaggtacaattcggcggtgcgtgatggtgccaagcgcgggaacgccgtggccacctatctcccgctggtgcccactgagcggctcgcccgc

SEQ ID NO: 3426 - DNA, 394 bp, Zea mays
  Clone ID: LIB3228-014-P1-K1-E4
ggtcctgagttcaagaaggttgggagcttccttggtcgcttcaagtcgatacctagcattgttgagcttgacagcttgaaggtttccgatgcagtttggttcggatctggaattgtactgaaggggaaagtgaccatcactgcaaaacctggcggcaagctagaaatcccagacggagcagtgattgggaataaggatatcaatggccctgaggaccttttgataagaatcagcgaatcagcaaggaggctcacttcgccaagtggcggatcatttttcgtgtttttttcctgtatattcaaacaggttccatgatattatggagaatattaattgccagtataatccagaaattttacatgtattttactttgagggaaatgttttacacact

SEQ ID NO: 3427 - DNA, 414 bp, Zea mays
  Clone ID: LIB3228-014-P1-K1-E5
cttccaggtcggcaagggctccaagcctggccacctggttctcacccctaacattgccaccatctctgacgtggagatcaaggagcatggcggcgacgatttctcctttacactcaaggagggcccagctggcacttggacgctcgacaccaaggccccgctcaagtaccccctctgcatccgctttgctaccaagtctggcggctaccgtatcgccgatgatgtcatccccgccgatttcaaggccggcaccacctacaagaccactctcagcatctgatgagcctgtgatgagtgatgacgaataatatttccagtccacgtgtcaacgagccaatatttaatttttttcctatgtttattttgtggcacaacaccatctcttcatgtgccttgttgtgttggattgatttt

SEQ ID NO: 3428 - DNA, 400 bp, Zea mays
  Clone ID: LIB3228-014-P1-K1-E6
cggacgcgtgggtcctggtccaagtgatcttgccaagttacgagcagcgagcagagatcagatcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccgccccaccggcaccgttgagcaggtggcgcagacgggccagggcgtggcggcaggcgtcaaggacacggtggcgggcgcggcggttggcgtcacgaacacggtggcgggcgtggcggcgggcgtcacgaacacggtcacgggcgccgtggcgggcgtcacgaacacggtgaccggcgcggcggcgggtgtca

SEQ ID NO: 3429 - DNA, 384 bp, Zea mays
  Clone ID: LIB3228-014-P1-K1-E7
agaaactatcgccagcaaagggagagcgccgaggtgatagagataatgcggtggtggtgctcatggttggatgaatgggggtgtcgggctatgcgcggttgacgtcctcatcggagcaaaccccttcaccgttggttgcctcgtgccgtggcctgggaagtcgatgactgctcatcatggtaggaggccccgaccgaccgtgcaaccgtgtgccgacgctgtggctgtgcgccaatgaaatcacgagcgaggtcacgagtcatctgaagagcaagttggtacctggaatctcaagtgccaggtcaagaacaggtaccacaggatgaggcgcttggaggatgctgtgatgagttcgtgagtggtctaggccgtcgtctcccagtc

SEQ ID NO: 3430 - DNA, 386 bp, Zea mays
  Clone ID: LIB3228-014-P1-K1-E8
ctcgtcgtcgtctcactcaccccgccttcacgcctccctcaccaaataaggtcccgcccttttccgacattcacaggggggacaggaaatcagcggccatggcctcgattccggcgacgaccttcgccgtcatcttatccgtcctcttctgtgccgcggctggcaccgccgtcgacaacgacctccccgactacgtcatccagggccgcgtctactgcgacacctgccgcgccgggttcgtgaccaatgtcaccgagtacatcgcgggcgccaaggtgaggctggagtgcaagcacttcggcaccggcaagctcgagcgctccatcgacggggtgaccgacgcgaacggcacgtacacgatcgagctcaaggacagccacgaggag

SEQ ID NO: 3431 - DNA, 315 bp, Zea mays
  Clone ID: LIB3228-014-P1-K1-F1
cccacgcgtccgcggacgcgtgggctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcaataatcatagtaataacaagttcagagattgattca

SEQ ID NO: 3432 - DNA, 392 bp, Zea mays
  Clone ID: LIB3228-014-P1-K1-F10
agataaggttcctggcttccgagtatttatgattgagaagtttgctactaattgctgtttatacagtgtgcttgataaatcatttgatttacgcgatgcaaactcgcttgtcctttttggtgaaattgtgctggcccagaagattatgtatgaaagatttggggaggaattcattatgaactttgtagctaaaggtcttcctgaagttcactgcccaccggacctagctgaacagtactaccagaagttaaagggaaatgatatcaaggcattcaggtcattttatcaatcacttgttgagaagataagaccacaaggaaatgggagtcttgttttcagatagcatcattctttgattttcaatatgtcttccaccaaaagactcctcaact

SEQ ID NO: 3433 - DNA, 375 bp, Zea mays
  Clone ID: LIB3228-014-P1-K1-F12
cggacgcgtgggcgaatctaccgagggaggaggaggtggtggtggtgaccaggcggacgacgactgcgagtacgcgttccctgagatcaccaagtgggaggccattgcctggctcgcgatcttcactgcctggatctcagtgttctctgactttctagtcggtgcaatcgagggggctgccaaggcttggaagatacctgtcgcgttcatcagcactgtcttgctcccgatcgtagggaatgctgcagaacatgccagcgctgttatgtttgcgatgaaagacaaactggacctttcgcttggagtcgccatcgggtcttagacgcagatatccatgtttgtgataccgttcagtgtaaaggcaggatggatgat

SEQ ID NO: 3434 - DNA, 85 bp, Zea mays
  Clone ID: LIB3228-014-P1-K1-F2
aaaccgggggggacccacgcgtccgcccacgcgtccgcccacgcgtccgcccacgcgttcgcccacgcgtccgcccacgcgtgcg

SEQ ID NO: 3435 - DNA, 388 bp, Zea mays
  Clone ID: LIB3228-014-P1-K1-F3
ggacagcgacatattcaagtgctacgacagctgctccgacgacgtggaggaggccgtcgcccacctcaacggcctcgtccgggagcccaccgacgccaagttcctcgagctcaagtcgtggctctcctccacgctcggcggcacctccacctgcgaggacgcctgcaaggacctgcccaagaccagcgacaaggacgacgtcgtcaacttcagcctcgacttcgagaagctgcagcgcgtcacgctcgacctcatcaccgaggcgtccggcaccatgtccgcaggcatcgccctgccaccctccaacgccggagcgccctcctacggcgcggcggcgccttccgggggctccgccgatgcccccgccggcgcctccgagggccctgcg

SEQ ID NO: 3436 - DNA, 393 bp, Zea mays
  Clone ID: LIB3228-014-P1-K1-F4
ctcaccgagaaggttgttagggacagagttctagtgttcaggtttacagatgttggcagacttcctccacctgtgctgcagtttgttgaagtcaagtttgggtatacaccagataatctcatatacaagagtcttgactttggtgttgatcttgactctagaatcgcattggtcggtactattaactctgtgaagagcactcttctgaagcttatgactggtgaccttgctccattagatggcatggttcggcgccacaatcacctgctcattgcatagaaccatttgtatcttgcggtcaagctggatctggacatgccggctctggcttacatgatgaaggaataccctgggaccgaagaagagaagatgcgagctgctgttggcaggttt

SEQ ID NO: 3437 - DNA, 396 bp, Zea mays
  Clone ID: LIB3228-014-P1-K1-F5
cccacgcgtccggttcttctacttcctgtttttcatgaccgcgtgcttcaactacttcgggttgttcggcatgatgttggtagcgtgcactccctccgcgttgctcgccaacattctcatcacgtttgctctgcctctttggaacctcttcgctggattcctcatcgttagaccggcgataccaatttggtggaggtggtactactgggcgaaccccgtgtcgtggaccatctacggcgtcgttgcgtctcagttcggcgagaaccaaggcgagctttcagttcccggtgggaagcccgtggtggtgaagcagttcttgaaggataatctcggcatccagcatgacttactcggctatgttgtgctcgtccatttcgcctacatcattgcgttctt

SEQ ID NO: 3438 - DNA, 399 bp, Zea mays
  Clone ID: LIB3228-014-P1-K1-F6
attgcctccacctgctcctgtgagctcaccacctccagtggtgaaatcttctccaccaccggcaccagtcagcttaccaccaccgacgcctaagccatctccaccacctactcctgtgagctcaccacctccagtagtaaagtcttctccaccaccaacactagtcagctcaccaccaccagcacctaagtcattacctccacctactcccgtgagctcgccgcctccagaagtgaagtcctctcctccaccaaccccagttagctcaccaccaccagcgccgaagtcgtcacctccacctactccagtgagctcgccacctccagaactgaagtcctctccaccaccagccccagttagctcaccaccatcagcgccaaagtcgtcacctccacctgc

SEQ ID NO: 3439 - DNA, 228 bp, Zea mays
  Clone ID: LIB3228-014-P1-K1-F7
gggcccacgcgtccggcataaggtagcagactttatcacattaactttcacatagagcataacgagggggggggaaaacagtgttttcctaacaccacaagaaaaaaataacccaatcaactcttcgactcgtctgccgaaacttcactgctccaacagataatgtatctaaagaacacgtacgacccacattataagctcggctacataattcgcctcgcggctctt

SEQ ID NO: 3440 - DNA, 64 bp, Zea mays
  Clone ID: LIB3228-014-P1-K1-F8
tgacaagattgcgggctagcccccttttttttttactgtgtgtattgcttggggggagtacaac

SEQ ID NO: 3441 - DNA, 381 bp, Zea mays
  Clone ID: LIB3228-014-P1-K1-G1
ggtgtgccctgatggaaaaaccatcgaagctgaagctgcccatggcacggttacccgtcatttccgtgtccaccagaaaggaggcgaaaccagcacgaacagcattgcttcgatctttgcatggacaagaggacttgcccacagggcaaagctcgacgacaacgctagactactcgacttcgctctcaaactcgaggctgcttgcgttgagaccgtggagtccgggaagatgactaaagatctggcgattcttgtccatggatcttccagcgtcacgagaagccattacctgaacaccgaggagttcatcgacgcagtcgctactgagctccgatcaagactgggagccaactgagcctacaagaaactttgcatggcgac

SEQ ID NO: 3442 - DNA, 392 bp, Zea mays
  Clone ID: LIB3228-014-P1-K1-G10
ggccgagcgggcggtcaaggcccctccaccggagacggagagcatcgtgtggagggaggacaaggggaggttccagacgcccgacggcgaggccttccttcagtaccgcctcctcgacggccgcggggcccccgctgcggcagtgatggacctggtgcacacgtacgtgccgcggagcaagcgcgggcaggggctcgcggcgcggctctgcgacgctgtcttcgcccacgcgcgggcccgcggcatgcgcgtcctccccacctgctcctacatatccgacacgtacctgcctcggaatccggcgttgaaggagctcgtggacaaggatcaagaaccccatcccaaacccagcagcatgtagatggttggttgtacaagaaaccagctgccac

SEQ ID NO: 3443 - DNA, 279 bp, Zea mays
  Clone ID: LIB3228-014-P1-K1-G11
acttgcttgtggtcttttgttttggacggacttcaaagctacgagatctacgttatagctggggtcgacatgctagatactaaattcgggggaaatagtcccacagaggcaggcgtccctctcccaaagatgaggggctggctatatgttaagccgaccgctcaaattggcatgcccgtgcttttcttaaacggggtgggagcgcataccttgcacgttcgcactcggggcgaccgtctactaccttccctccagtccgttgtacgggcgtacttacca

SEQ ID NO: 3444 - DNA, 387 bp, Zea mays
  Clone ID: LIB3228-014-P1-K1-G3
ccgaatcaccctctcgcccaccactacaccaccggcggcggcggcgacccagtcgagaacacgaaggcgatggcgacagcgctgaaccgcgggctccgctccgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatg

SEQ ID NO: 3445 - DNA, 400 bp, Zea mays
  Clone ID: LIB3228-014-P1-K1-G4
gccacaacacatacaggaaaagcaagcaagaatcatcggaataatggctcgtgcatgtgtgttcctcgtcgtgctcctcctggccgccatcgcggtggcaccgttcgcgggcgccgcacgcgtggacgtcgtggagggtaggtccatggcatccgccgatgcaccggaggcggcggccgatgctcccgctcctagccccgactccgcctcatccccagactcatcgtcagaggcgccctccagcagcagctcctccgactagacgcaaaaacctcttcattctctggaataactaacagtatatacgttgcaccctgatgatatagaaacatgtacgtgcatcagtgtatggaatgcgagtggcaaacacatggaatgtgcttgcctaattattgtttat

SEQ ID NO: 3446 - DNA, 401 bp, Zea mays
  Clone ID: LIB3228-014-P1-K1-G5
cccacgcgtccgcccacgcgtgcgcccacgcgtccgcgcttgcggcctctcgaatctgacccatttccacggttcgcgtgcgccgttgccgcggatctgcgtgcttgtggcatcgggttccgtggatctagttgcgcggagatggggctcacgttcacgaagctgttcaggcggctattcgccaagaaggagatgaggattctcatggtcggtctcgatgcagctggtaagaccactatcctctacaagctcaagctcggcgagatcgtcaccaccatccccaccattggatttaacgttgaaactgtcgagtacaagaacattagtttcactgtttgggatgtcggtggtcaggacaagatccggcccctgtggaggcactacttccagaacacccaggg

SEQ ID NO: 3447 - DNA, 402 bp, Zea mays
  Clone ID: LIB3228-014-P1-K1-G6
atcaccctcgagaagccacgctggctcatcgccgccgccaacatcttcgtcgtcgtgcacgtcatcggcagctaccagatctacgccatgcccgtgttcgacatgctcgagacgttcctggtgaagaaactccggttcaagccaggcatgcctctccgtttgatagcgcgctcgctctatgttgtgctgacagctctggttggcatcgccgtgccgttcttcggggggctgctagggttctttggtggcttcgcatttgcgccgacaacctactaccttccgtgcattctgtggttgaagattaagaagccaaagaagttcagcctctcttggttcatcaactggttctgcatcatagtcggcgtgctcctgacggtgcttgcgcccattggaggcctccgg

SEQ ID NO: 3448 - DNA, 212 bp, Zea mays
  Clone ID: LIB3228-014-P1-K1-G7
ttggttttaaaagaaaaaaaaaaaaaaaaaaaaaaaaaaaaaaaaaaaaaaaaaaaaaaaaaaaaaaaaaaaaaaaaaaaataaaaaaaaagggtgcgccgttttaaaagatcaaaaattacgtacgcattaatggaatgtaatatttattttatagtttcatctaaattaaattaattggccggggtttaaaaataaagtaattgttaaaa

SEQ ID NO: 3449 - DNA, 338 bp, Zea mays
  Clone ID: LIB3228-014-P1-K1-G8
caactctcaagtacctcggcttcctcggcatcttccttgtgtttgtgggccatagggctctatcctacctttcctcggtgtcgacaaaacagaagacggcatgagtggacagagttttttccgaccatccatttcttgagggggggccattgcaggcccttgggtgtcttatgagggagggctcggtttatttcagttggctttgcagaatactgataactagaaaaagtagtaggacctcaccttcgtgtattatgatgatgcacatacaattttctgagtagaatggatgttgaatcatagaactaatgaataatatgaacactcgccttcgcccc

SEQ ID NO: 3450 - DNA, 249 bp, Zea mays
  Clone ID: LIB3228-014-P1-K1-H1
gcgtccggttatgctatcattgaaacatcatcttatcttcggctgcggatgttacttctacgggagatttaaaaaaaacaaagtaaggttcctaaaccagctcgaacagcattgcttcgatctttgcatgaacaagaaggcttgcccactttgcaaggtccaggctacatctctcgagtattcgacgttaatgttattctatggggcacctaaattcaaaccactgggcccgggtttacaacttatgat

SEQ ID NO: 3451 - DNA, 294 bp, Zea mays
  Clone ID: LIB3228-014-P1-K1-H10
gccacgcgatgcgtgtactgatgtagctctacgattgaaacttcatctttgggcgggtcacatgtttcaagcaccacataaggattagtaagtgtttgtggaagagacccgcattgatgatattgcaggtccttatgttagcgagtggtgtaggagaaggtactgtggggctacgtgggcaccgactatcaattcatgctggttgtctaccccagtgaaggctaacatacagcgcgctgttcaccaagccatatcatctagcacaaacagtactcctcttaagagggtccacgt

SEQ ID NO: 3452 - DNA, 362 bp, Zea mays
  Clone ID: LIB3228-014-P1-K1-H11
cccacgcgtccgagcgaacgaaaagtatactaatcaaagttaccttcctgctggtggccattcttctattgtgcagaatcttacacgacacttccaccatgccaagcacgttgaacaacgacacgactatccccaacaagccaaacagaaagaacaaggcactgtaccaccccctgcccaaagtcaataaatacaccagcacctgccaacccatacaacactgcaggtgcccccgccgatcaccaaccatatacatatagcacatcacattcttattattgcatgcacgtttatataaaacatcaatgcctcgctgttgtaagtgccaacacaagcatatataaccgctttatatatactac

SEQ ID NO: 3453 - DNA, 193 bp, Zea mays
  Clone ID: LIB3228-014-P1-K1-H2
gtgttgtggcattgttacacatcacagtacagtttggtcaaattttttttccacagaggaagtagggattgatttaatcattgatttaatcccacacgcgtgtatctacgtatacagtttgtataacatgaaccacctctgtttgcgattggtctaaaaataaatataatacttatatattgaattgttttgc

SEQ ID NO: 3454 - DNA, 296 bp, Zea mays
  Clone ID: LIB3228-014-P1-K1-H3
acgctaaccgcgaccattgtgtaaacgccatgtccccaggcctcaacatcaatgtgggggcgctgaactggttcctagcaccacctcaccattatcaactggctcccaccgaatcccgcgaacatacagacacacacgctcttggtagcgtctgctctgcagacactcctgcagccctacgtgcgcacgcactgtcagctaatgctacatgaatacgcctgatacggaatgctaagagccctcgccaccgcccgcaactgggccttcttcaacctgaactcacaaaagtgcctcca

SEQ ID NO: 3455 - DNA, 403 bp, Zea mays
  Clone ID: LIB3228-014-P1-K1-H4
ctcgtggcgacgactgggtgactgccggcgccccaggcctgagcctccatcttcgggcccttcactggctacgagcaccacctgaggattatggattggctggggcagaagcgcgcggagatgctgatgcaggtgctgctggtggcgtctgctgtggcggcgttcctggggggctacgtgcgcgcggacttccagctcatgctgctcgtctacgccggcggcgtcgtgctcacagcgctcgtcaccgtccccaactggcccttcttcaaccgtaacccgcttaagtggctcgacgctgccgaggccgagcgccacccgcgcccccaggtcagcgccggtgcggcagcagggggaaagaagaagaccgggaagaacaagtaatcgatcttttggagcgatatgg

SEQ ID NO: 3456 - DNA, 383 bp, Zea mays
  Clone ID: LIB3228-014-P1-K1-H5
gttgacctgaagcacaagaataaacgcagccgggcatgggcgaagctaagctcaacaacgtgaccgtcctgctggtggccctccttctcctgagcagtggcgttcaggacgctgccgccatgccaggcacgttgaactacgacgcgattgtcgccgacgagccaaacggaaagaacaaggacctgtaccgccccgtcgccaacgccaataaatacacccgcgggtgcgagcccatagaacgctgcaggggcgcgcgctgatcaccaagcatatacatatagcacatcgatttcttattattgcatgcacgtttatataagtgctcattgtcttgctgttgtaagtgccagcacaagcatatatacggcgtttatatatactac

SEQ ID NO: 3457 - DNA, 387 bp, Zea mays
  Clone ID: LIB3228-014-P1-K1-H6
gtcgttctctcttcctggtccaagtgatcttgccaagttacgagcagcgagcagagatcagatcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccgccccaccggcaccgttgagcaggtggcgcagacgggccagggcgtggcggcaggcgtcaaggacacggtggcgggcgcggcggttggcgtcacgaacacggtggcgggcgtggcggcgggcgtcacgaacacggtcacgggcgccgtggcgggcgtcacgaacacagtgaccggcgcg

SEQ ID NO: 3458 - DNA, 347 bp, Zea mays
  Clone ID: LIB3228-014-P1-K1-H8
ccagcaaagggagagcgccgaggtgatagacataatgcggtggtggtgctcatggttggatgaatgggggtgtcgggctatgcgcggttgacgtcctcatcggagcaaaccccttcaccgttggttgcctcgtgccgtggcctgagaagtcgatgactgttcatgatggtaggaggccccgaccgaccgtgcaaccgtgtgccgacgctgtggctgtgcgccaatgaaatcaccagcgaggtcacgagtcatttgaagagcaacgcgttacctggaatctcaagtgccaggtcaagaacaggtaccacaggatgaggcgcttggaggatgctgagatgagttcgtga

SEQ ID NO: 3459 - DNA, 303 bp, Zea mays
  Clone ID: LIB3228-014-P1-K1-H9
cccacgcgaccgccccttcacccaggccggcgtccccaaccccatggggaagtttgacaaggagctcaaccagatggccaacaactgcatggctcttgcaaacatgatatgaaccacgcatgcaaccccagcgtgaggtgccatcgcatgcagggaatgcttgcattcatttttcatttaattaagaattcattgaaattatgagttatatatattgagtaactctatgtatttgttcctgacctgcactatttattcaatagtatgtcatgaaacgaggtagagcgcctttcattgccttta

SEQ ID NO: 3460 - DNA, 370 bp, Zea mays
  Clone ID: LIB3228-015-P1-K1-A11
cccacgcgtccgcccacgcgtccgaattgcttttcgtctcctgtccatcccttgtgcgctaccgctcctctcccttggcgacgacgactggcgccgccgctgccagacttcgctgggcatctcgccggcgacgagctcccaccaggattagagaaggtgatggcgaggagtgacagctgcctggcgcgcgtgggtgccggagttgcgatcggtggcgcggtcggcggagccgtcggtgcttgttatggaacttttgaggcattcagatacaagatccctggattgctaaagatcagacatatcgggcaaactactgttggcagcgctgcaaatttttgggctttctttgggggctgggagcttgattcac

SEQ ID NO: 3461 - DNA, 396 bp, Zea mays
  Clone ID: LIB3228-015-P1-K1-A12
gcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgttttatgaca

SEQ ID NO: 3462 - DNA, 294 bp, Zea mays
  Clone ID: LIB3228-015-P1-K1-A4
ggcgtcttaattcaaattggtgccttccatctcatcgattcagtaaatttgaatctccatatatggacgtgactgggtttaactgccgacataggtttcctctgtgtgctccactgtggcctagaaagaattaaaaagtgcagtgcggttcatagcaatacatatacttgacattgcagaagtaaaaacgtgttccgggcacttggtgaatggagaaccttgtcactgtaaattggttcttaaaccttgttgcgatgtaataatcatgtaaacactgtaaaacatgcgaatttt

SEQ ID NO: 3463 - DNA, 352 bp, Zea mays
  Clone ID: LIB3228-015-P1-K1-A6
gcgactctgagcggtgaccggagtgattacgccatcccatttggtgaagagcctgcggagctttgctacttttgtacaaaggtggttcccaagcaggaggaagaaccgaaaatagaagtgtgttgctgtggatggtgctaagtgccggtgggctcggccttcttaatagtctaagtacctcttctatacttcttattgaggatggtcacttaagctagcatatatttcaaacttacaagtaatttataacatttcaaaatttatttctttgaatcactttgtaatcactccaataaacttaatgtaaatttgatgtaacttgtaaccttttgtaataaagaaattccgctgc

SEQ ID NO: 3464 - DNA, 76 bp, Zea mays
  Clone ID: LIB3228-015-P1-K1-A9
ttcaatgtaatatcttcgattacacggaaaactactattctgtaaagaggaaggtggggccaactgatgtttcctc

SEQ ID NO: 3465 - DNA, 415 bp, Zea mays
  Clone ID: LIB3228-015-P1-K1-B10
gcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgccgaccccgccggccgcaccgtgccctacgtcgccgtcgtgtacgagcaggtctggacccgcacccgccagctcgccttcttcaacccggtgccccgcgccccctgaaaccatacggacacgggtggggccgaagcgaccacgacgatgttctccgtcaattacgtgtcgagctaatcttattattgtttctattattataaataatgcttctccctgttcctatggacctatagtagattactagtatgttgcgagggagcgag

SEQ ID NO: 3466 - DNA, 431 bp, Zea mays
  Clone ID: LIB3228-015-P1-K1-B2
gctttcgttatcctcctcgatcttaattacaggtcatagctaagcaggtctgacaggatgtcgtggcagacatacgtcgatgagcacctgatgtgcgagatcgagggccaccacctgacctccgctgccatagtcggccacgacggcgccgtttgggcccagagcaccgcattcccacagttcaagacagaggagatgaccaacatcatgaaggacttcgacgagcccgggttccttgccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgacta

SEQ ID NO: 3467 - DNA, 82 bp, Zea mays
  Clone ID: LIB3228-015-P1-K1-B4
gttcttcgttgtctccaagatcgcccaccaaaccggcatggagtggttcttcatcatcaccacccccaacccaatctttagc

SEQ ID NO: 3468 - DNA, 235 bp, Zea mays
  Clone ID: LIB3228-015-P1-K1-B5
ctgcttccagagccccccgccgccgctgcgccctcctctcggtcctgccgtccgtcgaggtaaaaggacagcatggtgagggtcagcgtgctcaatgatgctctcaagtccatgtacaatgctgaaaagatagggaaacgtcaggtcatgatcaggccgtcatccaaggtgatcatcaagttcctgacggtcatgcagcgccatggctacattggtgagttcgagtacgtggatg

SEQ ID NO: 3469 - DNA, 252 bp, Zea mays
  Clone ID: LIB3228-015-P1-K1-B6
gcgtacggggctaccagagccccccacctacgattcgccctcacatatgacctgccggcccgcgaggtgtaaatttttcatggttagtctcatcatgctcaatgatgcactcaagttcatgtacaatgctgataagatagggaatcgcattgtctcgatcaggctcgttatccaaggtgttcatatatgtttctgacgttcattcagttcctttgctactatgtatgagtttgtgttcttgtatgaccacag

SEQ ID NO: 3470 - DNA, 424 bp, Zea mays
  Clone ID: LIB3228-015-P1-K1-B7
cccacgcgtccggttcgttcctcaagtgatcttaatcgtcgagaagttaccagctagcggagatcatcggcaatgtcgaacatggggcaatccttccaggccggcaaggcgcaggcccagggcgagtgccaggcggagcgcgcagcgcagtgcgttagggacggcgccggcgccaccgcctgcgccgtgaccgacaccgccggagccgcggccgacagcgcgcagctgcaggagcaccgcgccgccggcaccgttcagcaggctgctgagcaggtggcgcagacggcggcgggcgcggcggcagccgtcaaggacacggtggcgggcgcggcggcggccgtcaaggacacggtggcgggccgcggcggcaggcgccaatgacgcggtgaccggcggccactgaccgactcacgcgcgtgaaccg

SEQ ID NO: 3471 - DNA, 174 bp, Zea mays
  Clone ID: LIB3228-015-P1-K1-B8
ccccgcgtccgcggacgcgtgggaaaaaaaaaaaaaaaaaaaaaaaagaaagagaggaaaaaaaataaatttggaggagaataattgaggataaaattttaagaattcgaaggtggctggcctttttagttggtcctaggtttccctccccgttctttccctgtccttcttttt

SEQ ID NO: 3472 - DNA, 115 bp, Zea mays
  Clone ID: LIB3228-015-P1-K1-B9
aaaatgttccatagatggataagtttattgatgaaatccattattgtatgtttttttaatggaacctttatagatgattgccaccgttgttcattacatgcatgtgacaaaaacg

SEQ ID NO: 3473 - DNA, 403 bp, Zea mays
  Clone ID: LIB3228-015-P1-K1-C1
gcgttatcaattgctatgtggagtagaccaatatatggtcaagcgcttcgatgttttgggtgtggcaatcttcttcagcacagcagcaagactgatcaatattcagattggtgaggcatcaaggaggacttggcttggcgaggaagctgatccacagtactcagatcgactgttgagagcatacaagagacctgtggaggttgacgcggaccaatcaaggtggtttatatccaaggatgcaattgtatctggccttggtcttctaggtatcaagcagggtggacctgaggcaacattttctaagtctcgtcgaaagagagtcatccgcaaaaaggtcacttcaggttgagtttagtggatttggatagcaatgctggaacaattttgcttctgttccactatg

SEQ ID NO: 3474 - DNA, 403 bp, Zea mays
  Clone ID: LIB3228-015-P1-K1-C12
cccacgcgtccggctacccacaagatcccactctctgaggacacgaagaagaatggggtgaccgtgtccaagctgataaattatcctgtgagaggcctggtatttgagggagggaacaccctggacgacctggccactgtggtttctaatgcttgcatttggctgcaagacaacaatgtgccttacaatgtgctcatttctgactgtggcaagagggttttcctgttcccccagtgctacgcagagaagcaggctctgggtgaagtgagccaggagctgctggacactcaggtgaacccagcttggtgggagatcagtggacacatggtgctgaaacggaggatggactatgaggaggcatctgaaacctccgcgtggaaactcctcgctgaggtcttttttt

SEQ ID NO: 3475 - DNA, 210 bp, Zea mays
  Clone ID: LIB3228-015-P1-K1-C3
ataattatggctgtttacgttgttgcttacaaaaaaaaaaaaaaaaaaaaaaaaagaaaaagggaaaaaaaaaaatttaaaaaaaaaaaaaaaaaaaaaaaaaaaaaaaaaaaaaaaaaaaaaaagggggcggccgttttaaaggatccaagtttacttacccgtgcttgcaacgtaatagtttttttatagggtcacctaaattaaatt

SEQ ID NO: 3476 - DNA, 135 bp, Zea mays
  Clone ID: LIB3228-015-P1-K1-C4
gaacctgttgcagggcgccttattttgatacgttttgatgaaccgtctttgtttgttgttgccctgaatcttagtggtatcgcaagcgtcatgcccaatttcttttgcataagaataaagaggtgcccataaaaa

SEQ ID NO: 3477 - DNA, 415 bp, Zea mays
  Clone ID: LIB3228-015-P1-K1-C5
gaagccaaactacttatgagaagatctatcacaaggcttacagtgatgatgagatcatgagaatcctcaccactaggagcaaacctcagctgattgctacattcaatcattacaatgatgcatttggccaccgaatcaacaaggatctgaaggctgacccccaggacgagtacctcagaacgctgcgggcgatcatccggtgcttcagttgccctgacaggtactttgagaaggtggctaggcaggccatagcggggctaggcacagatgagaactccctgaccagggtcatcaccacccgcgctgaggtggacctcaaactgattaaggagggctaccagaagaggaacagcgtgccgctggagcgggccgtcgcggtggacaccttcggcgactacgagagcatgctccttgc

SEQ ID NO: 3478 - DNA, 90 bp, Zea mays
  Clone ID: LIB3228-015-P1-K1-C7
agctctctaacctgttattagtagctaaagtattagctctatttacaacttgacttgagtgctgttggggaaactgaagatggcgatttg

SEQ ID NO: 3479 - DNA, 429 bp, Zea mays
  Clone ID: LIB3228-015-P1-K1-D1
aaaccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggcactacaacaacatcgcgcgtgcagttgctccggctaatgcatgaccggccggggggtgggagggggcttccgaccgttgctctggggctgggccgatgagacatgatgacacttcagtgccaaccatgcatgataccgtgtggtagattatgtgcaacgtgttcattcttattttattcttgtgcttgagcaccctcccacgtttatgtacagtgctgctcgcacgtgactcaacaatgcaccctcccacgtttgtgccacgg

SEQ ID NO: 3480 - DNA, 408 bp, Zea mays
  Clone ID: LIB3228-015-P1-K1-D10
cgacgacgaggagttagatgaccttgagcaaggggaggatgaacctaacacacaacatcttgtacttgcacaatttgataaagtgtcaaggaccaagaatcgttggaagtgcaccttgaaggatggaatcatgcatttgaatggcagggatgtcctttttaacaaggcgacaggtgagtttgatttttgattttttggatgaagatgagctattttagaagcagctgtatggacatatctttgtcttgacataaggacagggaggtgacagtgttcttggtggggtcctggcagcatgacctgcgtcgtgttttctttcctattgaatcttcgttccaccctctttgtttgtcaccgcaactgttatcgctgtaaagaagttactgcttgtgctgtgtagacaatttc

SEQ ID NO: 3481 - DNA, 413 bp, Zea mays
  Clone ID: LIB3228-015-P1-K1-D11
tttaaggagtgacaagaagaacatggccacccttatggcagagtttgacaagattaacacaaagcttggcattcggaaggaggatcttcctaagatcgagaaagaacttgaattggagattgccaaaagtgagctgactgaacttaagaaggaatgtgttgaggcaatggagactcaactcaagagggaggagttccaagatgaggagatgcctgatgtcaggaaactggacatccgaaacttcctgtaggcctgatcgacgataacctttgaggcattgcaaatcacccagcccacctgtgattttttttcttttggttttggtttcaagttgatcggtgctgtaagctacacctatgaatgctgctccttcctttttttgtaataaaaaaaacctgcaccgaggtacacaa

SEQ ID NO: 3482 - DNA, 414 bp, Zea mays
  Clone ID: LIB3228-015-P1-K1-D12
gaaagatgatcaaagtgtacaggaagaatacataaaggcctattatgaggccttgaggaaaaagcaggaagaggaagaagcaaaaaacagaatgcagcaggaaggcaagatttctgtccctgattctcaaactgaacgccaagtgggcaagaaatacaagcgggacgacgatgatgatgaagacattgaatgggaagagcatcaacctacagctgcagggaatgcaaccgaaacatacaaattggcagatttgaatgcggaggcccaagaatctggcgatgatgaagatgataatgtgtgggaagagggctaatgctaaaaagataacagactattcctgtgcggctgcgcccttaggattttggtatcccaccagaggtcgagagtatttcactaatgagcttagttatgttg

SEQ ID NO: 3483 - DNA, 222 bp, Zea mays
  Clone ID: LIB3228-015-P1-K1-D2
tgacagtgtggcgcgtttcttggaatcacggggaatgttggaggaagccctcgagatagcaactgacactaattacagatttgacctggctgagcaacttggacaacttgaaattgcgaaggcgattgctaccgaggtgcaaagtgagtccaagtggaagatattaggggagttagctatgtcaagtggaaagctcgagatggcagaggagtgacttctaca

SEQ ID NO: 3484 - DNA, 412 bp, Zea mays
  Clone ID: LIB3228-015-P1-K1-D4
gacaaagaaggagcaggtcttctccacttactccgacaaccagcccggcgtgctcatccaggtgtacgaaggtgagagggccaggaccaaagacaacaatctgctcggcaagttcgagctctctggcatccctccggcgcccaggggcgtcccccagatcaccgtgtgtttcgacatggatgcgaacggcatcctcaacgtgtcagcggaggacaagaccaccggacagaagaataagatcacgatcaccaacgataagggacggctaagtaaggaggagatcgagaagatggtgcaggaggcagagaagtacaaagccgaggacgaggaacaccagaagaaggtgaccgccaagaacacgctcgagaactatgcctacaatatgcgcaacaccatcagagacgacaagatc

SEQ ID NO: 3485 - DNA, 393 bp, Zea mays
  Clone ID: LIB3228-015-P1-K1-D5
cctgaacttgaaatagcatttaaagctcttgggaagctaatgatggaagttggtttgatgttggctcatcattgtgatcgctatgtaatgaggcaaggagtagggtcgtatgatggtgacagtcttgagcagacaattgctcgttcaaggtgtcacaagggtcgtctgttgtactatttcccacgacagtttagcaagcagacagacttcaagtcggtttcatcatggtgtggatggcacactgatcatggatctctaacagggcttacatgtggcttgtttacaaagaattctatggaggtaccatgtccagacagtgcacctggactatacattcggactcgtgataaccaagttgttaaggttgtgttcgacaggattcagctggcttta

SEQ ID NO: 3486 - DNA, 411 bp, Zea mays
  Clone ID: LIB3228-015-P1-K1-D6
cccacgcgtccgcggacgcgtgggcgtcctctccgcttctaaccgctccgtcctcgccggcgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaggcctttt

SEQ ID NO: 3487 - DNA, 415 bp, Zea mays
  Clone ID: LIB3228-015-P1-K1-D8
cagacctgaagtgttgggagcagaaattggaggaagcgaatgaacttggacagacagttgtggtaaagttcagtgcgacttggtgtggaccatgcaggaacgctgctccactatacgccgagctttccttgaagcattctgatcttgttttcttctccattgacgtcgacgaactgccggaattggtcacgcaattcgatgtacgcgcaactccaacgttcatcttcatgagagacatgaaggagatcgacaagctggtcgggggcaaccaggaagaactccagaagaagttcgatccgtactgccagtgacagtagaggcgatccatggccggattcgtctgtcagtataggatcagaacgagcatggccaaacatctgattggctgaaagaaggagcaagtcaaaaatttgca

SEQ ID NO: 3488 - DNA, 285 bp, Zea mays
  Clone ID: LIB3228-015-P1-K1-D9
cgcagggccatcggcttggtcgaggcgctgatcggccaaggcgcgcggcagatcgcgctgaccggggcgccgccggtggggtgcgtgccctcgcagcggcgcatcgccggcggggttcggatgcagtgcgccacggaccgcaaccagctggcgctcttgttcaaccggaagctgagcctggaggtggccaagctgtccgggaagtaccgcggcgtcaacatcttctacgtcgacctctactccgtcctcgccgacgtggtccagcgctaccaggctctcgggttc

SEQ ID NO: 3489 - DNA, 359 bp, Zea mays
  unsure (1)..(359): unsure at all n locations; Clone ID: LIB3228-015-P1-K1-E1
gatgaaatgaagaccattgctgagcaattcagcgtagaggccatgccaacattcctgttcatgagggagggcgacgtcaaggacagggtcgttggcgcagcaaaggaagagctagcaaggaagcttgaactacacatggcctcgtagatcagtgatgccgtaatgtagtattcgcctaaataagaggacgcctcgcctcaactctgagaaaactagtgcttctgtgatggtaattcgtatgagagagtgccccctttggtggtacttcttcgtatgtagtattaactcctgtcttaatatgttgccctgcttgtgcttttcataccatgtttgctctttcaaaanaaaaaaaaaatata

SEQ ID NO: 3490 - DNA, 357 bp, Zea mays
  Clone ID: LIB3228-015-P1-K1-E11
cgttccacgggctccggcggcggcaggaacgcctcccgatttcgacggcagagcgagagagcgatggcgctgactaacctcatcgtgacggtggccgtggttggcgcgggggtgcttctcttcaccaccgacatccgcaggtctggcgccctcttccgccgcaacgcgcgccagctccggcagtggctcgaggaggacacggcctccgccgcgtccaagtctgcaaaagaagcagctcaaaagaaactcgactcgacggtccccaaggagaagcaaaaggaagatagccactgattggagctgtttatatgaacggtataacccctatttgaagtcgttcaagttctgttttctaca

SEQ ID NO: 3491 - DNA, 395 bp, Zea mays
  Clone ID: LIB3228-015-P1-K1-E2
gtccctgagttcaacgtatctcagccaagtacaactttaagaggttcatctgatgtgttcaggaggtccttaatttctgctggcatttctcattctagaagttcaagcatcccattgcagcaccgtggaaattcatccacatcacatgagattaggaatcatcagccaggatcaagctctcgtgcacatcagcagcaccccttaagacccggtcattcctctgtagacaggcagagctctggttacttggaccttcagtcttttatgcagaccatagcttcaagggaaggaggcagaccaatgtcagagatccgcaatgtcttcgatcagattcgtcaggggagaaaagcacgattggaggatttgctttttattgaccggtcacttattatgag

SEQ ID NO: 3492 - DNA, 421 bp, Zea mays
  Clone ID: LIB3228-015-P1-K1-E3
cgcccatgggtgcccccacccctcgccgctgacctgtgggtacactgccccctgctcccccgccccgctcccgctcgcccacgcgaaccctaggcagctaggctttgctgctagaagagctccagcgaccgacgaggagaggagaataaagctcaaatcttggatgcgcccgaaccgatggcgacacctgccgcagagaagccggaagatgtagagatccgtgaggtttgggcggacaacctcgagacagagttcgccgtgatccgcgacatcgtcgacgactatccgtatgtggctatggacactgagtttccgggcgttgtgtgtcgtccgctcggcacttacaagtcggcggccgagttcaactacgccactcttaaagctaacgtggacatgcttgaggctattcagctcgggctca

SEQ ID NO: 3493 - DNA, 409 bp, Zea mays
  Clone ID: LIB3228-015-P1-K1-E5
cccacgcgtccgccacgcgtccgcccacgcgtccggctgtttactatttgtactccttttgaacggctatttgtacttcgttggaacaataaaaaaaaaaaaaaaaaaaaaaaaaaaaaaaaaaaaaaaaaaaaaaaaaaaaaaaaaaaaaaaaaaaaaaaaaaaaggtaataaaaaaaaaaaaaaataataaaaaaaaaaaaaaaaaaaaaaaaaaggggggcccccttttttttttttttttaccccaaaaaacaaataaaaaaagttttaaaaaaaaaaaaatgttttaaataaaaaaaaaaaaaaaatcataaattttgaactttgggcccttaaaaaaaaaaaaaaaaaaagataaaaaattaaaaattttccaaaataaaataacccccccaaagtttttaat

SEQ ID NO: 3494 - DNA, 407 bp, Zea mays
  unsure (1)..(407): unsure at all n locations; Clone ID: LIB3228-015-P1-K1-E6
gctggatgtgttcttgctgagctgcttcttggccagcctctctttcctggcgaaagtgctgtggatcaacttgttgagataataaaggttcttggtactccaacacgtgaggaaatccgttgtatgaatccaaactacactgagttcagatttcctcagatcaaagctcacccatggcacaagattttccacaagcggatgcctccagaagctatagatctcgcttcacgtttgctccagtattcaccaaatctaagatgcactgctcttgaagcgtgtgcacatccattctttgatgagttgcgagagccacatgcgcggttgccaaatggacggccattttctccactgttcaactttaaacaggaactagcanatgccttccccgagctcattaacaggctgat

SEQ ID NO: 3495 - DNA, 304 bp, Zea mays
  Clone ID: LIB3228-015-P1-K1-F11
cggacgcgtgggtgtagtttctccgtatacacggagcagtagtattctgtaaagaggaaaatggtggaaaccgatgttgcattctgcataaatttattaatagggctagtttcacaaccttattttttctaaggggttttattttttcaagggaatttaattcattttctcttgaaaaaataggatccacttgagaaaatgaagttgtcaaactagcctttataattatataattcatcggggttttcatcttgtttagaaataaaaaattattttttaatatttatttcgctccacatttata

SEQ ID NO: 3496 - DNA, 114 bp, Zea mays
  Clone ID: LIB3228-015-P1-K1-F3
atccatccttgcctccctgagcaccttccaacagatgtggatctcaaaggctgagtatgacgagtcaggacctgtgattgttcatcggaagtgcttctaagctctgggtccccc

SEQ ID NO: 3497 - DNA, 89 bp, Zea mays
  Clone ID: LIB3228-015-P1-K1-F4
gcacattcgcctgccttcgcccgtgcgccggcctcgcgggtcggagacagtcgcgccgtatatcttaagggttgtaagaagagtgaagt

SEQ ID NO: 3498 - DNA, 174 bp, Zea mays
  Clone ID: LIB3228-015-P1-K1-F5
cccacgcgtccggttcttctacttcctgtttttcatgaccgcgtgcttcaactacttcgggttgttcggcatgatgttggtagcgtgcactccctccgcgttgctcgccaacattctcatcacgtttgctctgcctctttggaacctcttcgctggattcctcatcgttagacc

SEQ ID NO: 3499 - DNA, 314 bp, Zea mays
  Clone ID: LIB3228-015-P1-K1-F6
ctacttctgtccagagtgctatagaggcttcccctgtagcaattggcggtcgtcaatgttacgttgaggaaaagagagcacctggttcacgaggctccagcagaggcggcaggttcgcaccaggcaggggcaacaatttcagaagtgaaggtaccagagggcgtggtaactacggtggaggaaggggctacgggaggggtgaatttagttacaggtctgattacggggtcagaagtggtggcagaggtggctcatcacgtggagctgatgttggctaccagagggttgaccatgctggatatgctggtggtcgt

SEQ ID NO: 3500 - DNA, 411 bp, Zea mays
  Clone ID: LIB3228-015-P1-K1-F7
taatgttttcctcatgttcttttttgtcttgtttcccccctaacatttgttgtgtatgcaggaccatccaggttcaaatcgttcttgggaaatgttttgttcttctttatataactatattgctaacttattttcatttgttaattattttgctttattttgatttgcaggtgaacatctctggttctattttcatcgtcgggtaacaagaaactaatcagggagtctcttcccatttcttgcagtggaggaatgtttagctacagccgcgcagcatgctttccagagcataaattggtggaagagaagtttgatgctaccactttgccagaagaaccgagccagacacaataacatcaaactgagtctgagatactgcactttacaaattctttcgatattggcagattg

SEQ ID NO: 3501 - DNA, 404 bp, Zea mays
  Clone ID: LIB3228-015-P1-K1-F8
cgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctactacctccactgagcgacgacgcgcggggcggcaacgttgggatgcatcgtgtttggttcatccgattaattaattgttttttttatttacgtggt

SEQ ID NO: 3502 - DNA, 347 bp, Zea mays
  Clone ID: LIB3228-015-P1-K1-G10
cggacgcgtgggcggacgcgtgggcggacgcgtgggcagcagacttagggcatgtacaagtctgagactccatttttctatgagacagctaagagactatatgacataactttaaaactaagtttaataatgcagttaatagacaacatgcgtagagtcgtaaagaggcgggctcttagcgaagagcttggctcttgtattttttttttatataggcccttagagaactctcaagagatcatatattaaataggggtgtacatgcacttaataattgattgtaggatatgccaaaatcctcgaaacttggtgtgggtctaaccgattatggagcaatttgaactttt

SEQ ID NO: 3503 - DNA, 345 bp, Zea mays
  Clone ID: LIB3228-015-P1-K1-G12
ggctgagaaccaccgccatcacacagagagataataacggggtgttatcgccgccgcgggcgatgccggggaaaccatcgctgatggaggagcacggtcgccatcgatcctggatttaatcgtcgggggtgtggaatttgggccttgtcgggccgagctggtggtgggcatgatctcgggtggcaagaaccggggccagaacaccttgaattctccagcgctctgtcgaggatcatcccactcgcgtgggcagcctcatcggcacttcatctccagtaaagatactcacacacgaattgccctacactctgcttcttgtagagccatttaggttacaggatagag

SEQ ID NO: 3504 - DNA, 291 bp, Zea mays
  Clone ID: LIB3228-015-P1-K1-G2
cccacgcgtccgcccacgcgtccgcccacgcgtccgggacgaggagccggagccggagggaagagaccaaggtggggggagagacttggctgcgctgcgctgctctgctgctcccgcgcattcccgatgcgtgggcgtgctctgattgggcacggcggtggcagtggcacaccttcgtcttccttttgtttgtttttttttccttcctctttctacttgattttcatttaacgaattggtatcgctgatgcaccagtttaatttggtgccctgttatttgttctttccctc

SEQ ID NO: 3505 - DNA, 110 bp, Zea mays
  Clone ID: LIB3228-015-P1-K1-G3
cccacgcgtccgcccacgcgtccgcccacgcgtccgatcagttttaccagatcctatttccatttccaaataaagattgaaccactgcgattacagtggtgtctgatttc

SEQ ID NO: 3506 - DNA, 312 bp, Zea mays
  Clone ID: LIB3228-015-P1-K1-G4
cggacgcgtgggcggacgcgtgggtttagaatgagttgaggcgcttacacaaactttcattccggcctcttgttccatagtttttcttgcatgttacatctcaccgatgaataaaatgtatgtatcagacttgtctcgtttttttgcccatccaagcagcaaattagccgctggcacagcatgcggtaataatcttgtcacagtgctgtaattgggagcgtttttcttgttagaagtgtttttggtttgtttgagcatttacggattcgatttttctttctgaagagtatataaacattttactcaccttgt

SEQ ID NO: 3507 - DNA, 319 bp, Zea mays
  Clone ID: LIB3228-015-P1-K1-G6
cccacgcgtccgcggacgcgtgggcttccagagctggagaggcttctgagggaggagttccagaccctagaggacttcaaggcaaaggagaaagcccgagcgacgacggagaaaggaactggcatcagtagcagcagtgtggtggtggccgcaagtcatagcaaggctgagactaagcaggtctgagtcccgcatgaaaattttcggtggtcgccccagcaaaaagaggaagtagcgttttctttttctttgcgaagaagtaatgattcgggtagacatgtgcagattttgctatatcccctgccagtgccgtgtgttg

SEQ ID NO: 3508 - DNA, 348 bp, Zea mays
  Clone ID: LIB3228-015-P1-K1-G7
tgcaatcccaattttatcatggccaaaaaaaaataaaaaataaaggtctatcaagtgtgccatttgatacttattattatttggttagtttatttggcggtgtaggcagtgttgggcttccagccggcggggatgacatcgtcatagacggtcttagtgcctccctcggtggtgagttggacggtgatgggtcccttgatcggcttgtcgctgtccttcctccagatggcgccccaggagtgctttagaggctcgtacgtgtcggagcccttctccttgatgtccaccgccacaatgtcgccatcgccatcgacgtacttgaccaacaatgccaggtagttgggggtt

SEQ ID NO: 3509 - DNA, 333 bp, Zea mays
  Clone ID: LIB3228-015-P1-K1-G8
catgaatgctgctgagattactgacaagcttggattacactccctgcgccagcgacactggtacatccagagcacttgtgccacaactggcgagggtctgtatgagggcctggactggctgtccagcaacattgcgagcaaggcttgaggcctaccttgaatatcaactgcgaactgactaggagctccggatgtatcatggaaactcaggacagaatcgcagttgcaatctgttagatgtcttctaccggcactatatattttttttttgttggaggggaaatgatgttactgttcaacgctaattaccctacaatacggggggaggttctt

SEQ ID NO: 3510 - DNA, 362 bp, Zea mays
  Clone ID: LIB3228-015-P1-K1-G9
atgactcagtcgcaaatttagtcaggtttctcgggatgtttttttatttctgagaaggaaacgcatttttgtatatcaggctatagttgtacaagagtggaagtgaaatttgaaacgagagatgaggaattgaggattaagctgctggagatagccttggtgaaggcaaaaccatcctaggagctgtccatcatgctatcactcttgtacaactatagcctgatatacaaaagaaatgactcagtcgcaaatttagtcaggtttctcgggatgtttttttatttctgagaaggaaacgcatttttgtaatagtatgttgtaatatttgccagtattactaaattgctgctgtgcattttaac

SEQ ID NO: 3511 - DNA, 419 bp, Zea mays
  Clone ID: LIB3228-015-P1-K1-H1
gcagttcgaccccagcatgaacccgtcctacgccagggggctgcaggacgtgtgcagggactacctcaaggaccccaccatcgccgcgttcaacgacatcatgacgcccggcaagttcgacaacatgtacttcgtcaacctcgagcgcggcctcggcctgctcagcaccgacgaggagctgtggacggacccacgcaccaagcccctggtgcagctctatgcatccaacgccacagccttcttcgacgacttcggccgcgccatggagaagctcagcttgttcggcgtcaagaccggcgccgacggcgaggtcaggcggcgctgcgacgcctacaacagcggccccgccgtcgccgccaccatacccaagatgtgacgacgctgcgcgtggtacgacgacgggcgcgcacgtgcttgtc

SEQ ID NO: 3512 - DNA, 230 bp, Zea mays
  Clone ID: LIB3228-015-P1-K1-H11
cggacgcgtgggggccaaggtgcaacaagcgcagactgccatgagcggcaaatagattattttcccacttcatttgtttattaggcaggagcctcgattgcattccctaaggagtcttatcatctatttgctacagtaacagttcctaatctagccctagctcctagtgttatgcaataattacgtgcggatggtttgcacgggatgataataaacgtaacttcagcttc

SEQ ID NO: 3513 - DNA, 215 bp, Zea mays
  Clone ID: LIB3228-015-P1-K1-H12
cggacgcatgggggccaaggtgcaacaagcgcatactgccatgagcggcaaagagattattttcccacttcattagcttattaggcaggagcctcgattgcattccctaaggagtcttatcatctatttgctacagtaacagttcctaatctagccctagcttctagtgttatgcaataattacgtgcggatggtttgcacgggatgattataaa

SEQ ID NO: 3514 - DNA, 323 bp, Zea mays
  Clone ID: LIB3228-015-P1-K1-H2
cccacgcgtccgctaaggtgcgctcccagatcctctctcaagagtttgggtgggacaaggatcttgccaagaagatttggtgcttcggacctgagaccaccggcccaaacatggttgttgatatgtgcaagggagtgcagtatctcaatgaaatcaaggattctgttgtggctggtttccagtgggcatcgaaggagggtgcactggctgaagagaacatgcgcgggatttgcttcgaggtctgtgatgtcgttcttcatgctgatgctatccacaggggtggtggccaggtcattccaactgccaggaggggtcattatgct

SEQ ID NO: 3515 - DNA, 371 bp, Zea mays
  unsure (1)..(371): unsure at all n locations; Clone ID: LIB3228-015-P1-K1-H5
ctctctctcgtggcgacgactgggtgactgccggcgccccaggcctgagcctccatcttcgggcccttcactggctacgagcaccacctgaggattatggattggctggggcagaagcgcgcggagatgctgatgcaggtgctgctggtggcgtctgctgtggcggcgttcctggggggctacgtgcgcgcggacttccagctcatgctgctcgtctacgccggcggcgtcgtgctcacagcgctcgtcaccgtccccaactggcccttcttcaaccgtaacccgcttaagtggctcgacgctgccgaggccgagcgccacccgcgcccncaggtcagcgccgttgcggcagcagggggaaagaagaagtc

SEQ ID NO: 3516 - DNA, 188 bp, Zea mays
  unsure (1)..(188): unsure at all n locations; Clone ID: LIB3228-015-P1-K1-H6
ccacgcgtccgcggacgcgtgggattttcttttgtcgatctttccaaaaaaaatcgtttccttgtattattacgcttcttggaattataaagagtagaagaaatacaaaggccngaaaaaaaaaaaaaaaaaaaaaaaaaaaaaaaaaaaaatatataattataaatttatattaattttttttaata

SEQ ID NO: 3517 - DNA, 252 bp, Zea mays
  unsure (1)..(252): unsure at all n locations; Clone ID: LIB3228-015-P1-K1-H9
gcagctcgccgtccaggacttcgactcgtgcgaccgccccttcacccaggccggcgtccccaaccccatggggaagtttgacaaggagctcaaccagatggccaacaactgcatggctcttgcaaacatgatatgaaccacgcatgcaaccccagcgtgaggtgccatcgcatgcagggaatgcttgcattcatttttcatttaattaagaattcattgaaattatgtgttnaaaaaaaaaaaaaaaaaata

SEQ ID NO: 3518 - DNA, 172 bp, Zea mays
  Clone ID: LIB3228-016-P1-K1-A10
cgacgtccccgcgcgtgtggctgctcgccatggcactggcgctcgcctgcgtaggggatagtgaggtccgccgacgctcctgccgaggcgtacccgactccaggcggctccacctactggtgcaacccgtccacggacaatgtcgtgcaagcccgagggcgtgggggtggtg

SEQ ID NO: 3519 - DNA, 407 bp, Zea mays
  Clone ID: LIB3228-016-P1-K1-A11
cccacgcgtccgcccacgcgtccgaattgcttttcgtctcctgtccatcccttgtgcgctaccgctcctctcccttggcgacgacgactggcgccgccgctgccagacttcgctgggcatctcgccggcgacgagctcccaccaggattagagaaggtgatggcgaggagtgacagctgcctggcgcgcgtgggtgccggagttgcgatcggtggcgcggtcggcggagccgtcggtgcttgttatggaacttttgaggcattcagatacaagatccctggattgctaaagatcagacatatcgggcaaactactgttggcagcgctgcaatttttgggcttttcttgggggctgggagcttgattcactgcggaaaatcctactagtttggttccctcctttttct

SEQ ID NO: 3520 - DNA, 401 bp, Zea mays
  Clone ID: LIB3228-016-P1-K1-A12
gcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaaccaa

SEQ ID NO: 3521 - DNA, 77 bp, Zea mays
  Clone ID: LIB3228-016-P1-K1-A2
aaaaaaaaaaaaaaaaaaaaaaaaaaaaaaaaaaaaaaaaaaaaaaaaaaaaaaaaaaaaaaaaaaaaaaaaaaaaa

SEQ ID NO: 3522 - DNA, 404 bp, Zea mays
  Clone ID: LIB3228-016-P1-K1-A3
gagacggcggtcaccccgcgccggctggccgagctgctcgtgtacgtgtcggccgaggtgggcatgaccgtggccgcgttcgcgcaccacgagctcaacgccatcaaggacgacgacgtcctgtacaagtgcatcgacacctgctccgaggacatcgaggaggccgtggcgcacctcagcgccctctcccgcgacttctccgacgccaggttcctcgaggtcaagtcctggctcacctccacgctcggcggcaccgccacctgcgaggacgcctgcaaggacgcccccgtcagcgacatcaagaacgtctgcataaccaagagcttcgagttcgagaagctgctgcgcgtcacgctggacctcatcaccgaggctttcggcttcatgtcggccgagtcgcactg

SEQ ID NO: 3523 - DNA, 410 bp, Zea mays
  Clone ID: LIB3228-016-P1-K1-A4
gcgaacgcgtgcatgcgcagacgttgaggtcgagggacacggtatctctgagcttcatcagagagcgacccgccaccgccacgcttggccgcaagccgagaagagtgccgggccgggagaccggacgataattgatccgtagcagattcgctaatggcggagacggcggacatggagcggatcttcaagcggttcgacaccaacggcgacggtaagatctcgctgtcggagctgacggaggcgctacggacgctggggtccacctctgccgacgaggtgcagcgcatgatggccgagatcgacaccgacggcgacggctgcatcgacttcaacgagttcatcaccttctgcaacgccaacccggggctcatgaaagacgtcgcaaaggtcttctgatccattacatcttc

SEQ ID NO: 3524 - DNA, 399 bp, Zea mays
  Clone ID: LIB3228-016-P1-K1-A7
attgaagccaaatttctgcaaacaaagtctttgatttttgacgctttgagtaggtcgaagaacttctgaacctgcggtgtaggtgaatcatgatgatctggtgccagttcaggctgcagatcctcaagcatctggtccatcctatcaacatcatcttcaccatcataaactattagctttgatgctcgttcaacatcttcaccgtggagataccagaccttatagtctggcacgaaaccatgtgagcataggtgtagtgtgacctgcctttgggcgcggctcgtcatatttctacatttatggcatggacacctattattatctatttgtgacaaagtagttgaattggcccagaaacatttgcgtctgggcaaaccattcactagtgtgacacccacc

SEQ ID NO: 3525 - DNA, 392 bp, Zea mays
  unsure (1)..(392): unsure at all n locations; Clone ID: LIB3228-016-P1-K1-A8
gccgggagcggtgcacatcccaccccaatttagtgttctcacactgtagcacttaactttctggctcacgtaccctgcatacggacttggctcctgagtcgtggtgaacctggatttgaagtacgggagctttaagatgtatcctgatgacgtgatgggcagggcgtggatactcataggtccacagtcaacgtgcttttgaagcctgaacatggtcaggaggttatgatcctattgctttttcgaaattcctggacgctgttaggttgctggtatgacctgtacaacccaattatctgcaggtgcaattgtcagcgttgatatatactctntgctatactgaatcaagatattgcacgaaggaattgttagcctggctagtataatcatac

SEQ ID NO: 3526 - DNA, 245 bp, Zea mays
  Clone ID: LIB3228-016-P1-K1-A9
cgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagcccgagggcgtgggggtggtgctgccgggcgtgtgcatcgaccttgacgagcgacggtgactaggacgagctgcctgagttacagccacacttgat

SEQ ID NO: 3527 - DNA, 415 bp, Zea mays
  Clone ID: LIB3228-016-P1-K1-B1
cccacgcgtccggaagttattccgtgctgagtttgtcgagaagcgatatgaaggtttagatgaggatatcgatttgagagctttggagaatggatttatatctgtcacccctctgaatgttcatggacaagtggagcttgaaatcggagccacagcttctgattggctctcagcagctgtatcactagacaaagaaaaggtagctgcttcagctacagctgaccaacaagatgttgcagctgaggaaaaggaagctccctcagcagcctaacaaacacgcagacatgtccacactccgtaggtgtctctagttcctgtggtgatgtcgatcttttattacctcttgtcagtttggttcgtctagtgttttgccctcaatatttgtttgttgcaatgtctattttttttgtcacct

SEQ ID NO: 3528 - DNA, 409 bp, Zea mays
  Clone ID: LIB3228-016-P1-K1-B10
gcgactcgcacatccaggagctaggcgggtgggcgctggggcaggcgaagcaccagaagctggccgccgacgggctgcggttccgccgcgtggtgcgcggcgagcagcaggtcgtgtccgggatgaactaccgcctctacgtcgacgccgccgaccccgccggccgcaccgtgccctacgtcgccgtcgtgtacgagcaggtctggacccgcacccgccagctcgcctccttcaacccggtgccccgcgccccctgaaaccatacggacacgggtgggccgaagcgaccacgacgatgttctccgtcaattacgtgtcgagctaatcttattattggttctattattataataatgcttctccctgttcctatggacctatagtagtatactagtatgttgcgagggag

SEQ ID NO: 3529 - DNA, 415 bp, Zea mays
  Clone ID: LIB3228-016-P1-K1-B2
cccacgcgtccgcccacgcgtccgcggacgcgtggggaaacagttaagaattcatatataagagtgcatatatatatatataattctgccaagacaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagttcgatggtggacgtttattctatttattggcttacttgattttttttcccctaacaataagaaaacgc

SEQ ID NO: 3530 - DNA, 400 bp, Zea mays
  Clone ID: LIB3228-016-P1-K1-B4
aacaaggtcctccatgtgcatcgtctcgattaatttggtgtgaccggctgtcgtgtatacttgagtgaatcaacgaggaaataaatattgctttctagaggctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcggcccctttaaagaaccaaagtttacttccccgtgcatgcaaagaaaaagtttttttatggggccaccaaaattaaattaactgcccgcggtttaaaaacggggggacgggaaaaaccctggggtaaccaaactaaatcgctttgaaaaaaatccccttttcccaagggggcg

SEQ ID NO: 3531 - DNA, 168 bp, Zea mays
  Clone ID: LIB3228-016-P1-K1-B5
caatatctaataacatctcctcgaacgccatgttccttgcaccactatatccaggagcgacaaaatgatcctcccgccagccatggacatgaacaaggcgctctgcaccgtccttgtcgtggtcatttggtccaccgttttgctgccctcatgggattccaagaggcc

SEQ ID NO: 3532 - DNA, 411 bp, Zea mays
  Clone ID: LIB3228-016-P1-K1-B6
ggccctctcaccgaggcgcagtcgctcgtggtccccggcctcggcgccgccgccgggccagccatggagctcatggccgtccctaagaagaaggtctccaagtacaagaaaggtttgaggaatggacccaaagctttgaagcctgtgccggtgattgttcgttgcaggtgctgcggccgagtgaagctaccccacttattgctgcagtggagaaagaggaaacccaagcgagtcgaactcataaatgttttgttttcctactttgctcactatgctacgtctgaaatctggacatcgtaataccaatgaaataaattgtcagatcgctcttggtattcaccttgttctccttccaagcattgaatcaatacacacttactctagtttgaattcaaagtgtaagaccatcaa

SEQ ID NO: 3533 - DNA, 292 bp, Zea mays
  Clone ID: LIB3228-016-P1-K1-B7
gcttccgcccacgcgtccgcccactcttccgcgctcgcttcgtctagcagcgataaaaagggggaggtgaggacatagattttttagcactacagcacatggattaatatcctgacacccgctccgaatgtgcaaggacaagcggagcctgaaatcggagccactgctgacgatcggcacttagcagccgaatcactagacaaagaaaaggtagctgcttcagctacagcaaaccaacaagatgttgcagcagaggaaacggaagctcccacagatgcctaacatacaccca

SEQ ID NO: 3534 - DNA, 247 bp, Zea mays
  Clone ID: LIB3228-016-P1-K1-C1
gttcgacctattcaattttaatgagatgcctgatgaggctacttgcaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaggggacccaagtttacttccccgtgcttgcgacgtaatagtttttttttggggccccctaatttaaatt

SEQ ID NO: 3535 - DNA, 258 bp, Zea mays
  Clone ID: LIB3228-016-P1-K1-C10
ttgagcatgcatcggaggattcttgagggtagaggagagagtgttttttgtgcatgcaggcatgtatacagggagattaggcgcgcgcggtccgtgtgcgcccaagagatgaactgatcatgcggcgtttggaaagctgataggcgttttgtttgagtctttgctgacttttgttaacttccgggcagatcacaaaatcttcgccctgagaataacttattaataataatatttactgcgggggctgttgttatttta

SEQ ID NO: 3536 - DNA, 404 bp, Zea mays
  Clone ID: LIB3228-016-P1-K1-C12
cccacgcgtccggctacccacaagatcccactctctgaggacacgaagaagaatggggtgaccgtgtccaagctgataaattatcctgtgagaggcctggtatttgagggagggaacaccctggacgacctggccactgtggtttctaatgcttgcatttggctgcaagacaacaatgtgccttacaatgtgctcatttctgactgtggcaagagggttttcctgttcccccagtgctacgcagagaagcaggctctgggtgaagtgagccaggagctgctggacactcaggtgaacccagctgtgtgggagatcagtggacacatggtgctgaaacggaggatggactatgaggaggcatctgaaacctccgcgtggaaactccctcgctgaggtctctctct

SEQ ID NO: 3537 - DNA, 413 bp, Zea mays
  Clone ID: LIB3228-016-P1-K1-C3
cccacgcgtccgggcggacaaggtaagcagcaatcgcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctg

SEQ ID NO: 3538 - DNA, 290 bp, Zea mays
  Clone ID: LIB3228-016-P1-K1-C6
aaaaaaaaaaaaaaaaaaaaaaaaaaaaaaaaaaaaaaaaaaaaaaaaaaaaaaaaaaggggggaaaatataaatttttacaaaaataggggccgccgtcttgcgggatcctagcttttttacgggggcatgcgaaatccatatctcttgtttggggttacccaaaattcatttctggggccccccttttacaacccagtttcttggactccccgggcgttcccctttttactgttgtggtaaaacataaccgttccgcccggtgggtttttaccaaaagggccgcaacc

SEQ ID NO: 3539 - DNA, 413 bp, Zea mays
  Clone ID: LIB3228-016-P1-K1-C7
ggcggatatgttaacgccgtcgccgtgagccccgatggatcgctctgcgcctccggcgggaaggacggtgttactctgctgtgggatttggctgaggggaagaggctgtactcgctggatgcgggctccatcatccactccctctgcttctcgcccaaccgctactggctctgcgctgcgacccaggactctgttaagatctgggaccttgagtcgaagcacgtcgtgcaggacctcaagcctgacatccagatctccaagaaccagatcctgtactgcacaagcttgagctggagcgccgatggaagcaccctctacactggctacaccgatgggtctatcagggtctggaagatctctggatatggctacgcaggctagatgtcgaaatccagtcgagggtctaggaggtc

SEQ ID NO: 3540 - DNA, 256 bp, Zea mays
  Clone ID: LIB3228-016-P1-K1-C9
ttgagcatgcatcggtggattcttgagtctgtccgagagagtggttgtagtgcaggcaggcatgtatacagggagattaggcgcgcgcggcccgtgtgcgcccaagagatgaactgatcatgcggcgtttggaaagctgataggcgttttgtttgagtctttgctgacttctgttaacttccgggcagatcacaaaattttcgccctgagaataacttattaataataatattactgcggcggctgctgttatttt

SEQ ID NO: 3541 - DNA, 283 bp, Zea mays
  Clone ID: LIB3228-016-P1-K1-D10
caccgtgtaaactcgactcagtttttttatttgtttttttttgcagacaaatacaaaccacacacatatatatatttgtaaagattcgttcgtattttcattttcaccgggaagatttgtaactgtcctcctccctccttgtaagttgctcctgtaaactcttcctgaattcatggcgtgtcgttgtagcaatcaccacttcctccctgtgaatgcccacagcgtgtcttggtaaaagcatgtatgtatgaatattggagtatatgttactactcagctccac

SEQ ID NO: 3542 - DNA, 387 bp, Zea mays
  Clone ID: LIB3228-016-P1-K1-D11
tttaaggagtgacaagaagaacatggccacccttatggcagagtttgacaagattaacacaaagcttggcattcggaaggaggatcttcctaagatcgagaaagaacttgaattggagattgccaaaagtgagctgactgaacttaagaaggaatgtgttgaggcaatggagactcaactcaagagggaggagttccaagatgaggagatgcctgatgtcaggaaactggacatccgaaacttcctgtaggcctgatcgacgataacctttgaggcattgcaaatcacccagcccacctgtgattttttttcttttggttttggtttcaagttgatcggggctgtaagctacacctatgaatgctgctcccttcttttttttgtaat

SEQ ID NO: 3543 - DNA, 404 bp, Zea mays
  Clone ID: LIB3228-016-P1-K1-D12
tgatctacaggcttcaaaggaaagtccagcaagggctgttgctagcgataagggtacccctgtaccctcaagttctagccaggagaaggatccagtggctaagactatactgaacaaggtgaaggaaaaaagtgatgacgaaggtaaaccattgcccgctgaatttgatggaaaagaaaacccggtggcaaactcaaaaaatgacaagtctgattctggtgtcgaccggagtcgagaaagagagagatcaagagggcgggaacgtgatgccaggggtagggattctgatcgtgatagcaggggtcgcgagtctgatcgtgagagggaccggagacgctgctctagggaaagaagttcaggacactcagacaaggagaaatcaaggcgccattcatcacgcgacc

SEQ ID NO: 3544 - DNA, 262 bp, Zea mays
  Clone ID: LIB3228-016-P1-K1-D2
attagcatatatgtccattggatttgagtaagagtagtttatctagcgatttgaaacgttggttttgatggtgtgttaaatttgggtgtactttgtttggtagttttagtataggttatgtgtgggtgggtgatttagttggatgagttttgtaaagtttaaactggttgattatatagtggtatagatgagagtgcatatttttaattatttattttattttaatgtatttttttttttagtttatttttttttatttttt

SEQ ID NO: 3545 - DNA, 200 bp, Zea mays
  unsure (1)..(200): unsure at all n locations; Clone ID: LIB3228-016-P1-K1-D3
gactatgttccatgagtagtctatagaatgatgtctttttaattcaaaagaaatctctcttctaggctggtgcttttcgactataatttggagattgttccgtgtccgtgcaatcatctgaacatgttactacttattgtaccttgtcgtgcaaagttttgctaagatctctattgtttcatgtcttctgatatgtcnna

SEQ ID NO: 3546 - DNA, 352 bp, Zea mays
  Clone ID: LIB3228-016-P1-K1-D4
cggacgcgtgggaaaaaaaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaaaaaaaaaaaaaaaaattggggggggcctttttaaagaatcaaagtttactaccgcttgcttgcaacttattaatttttttttaggggaaccaaaataaatttaatggccggtgttttaaaaacgtcggaattggaaaaaccttgggttaaccaaattaaatggctttgaaaaaaatccctttttggcaagttgggttattagcaaaaaggcccgaacgaatcgcctttccaaaaatttgcca

SEQ ID NO: 3547 - DNA, 391 bp, Zea mays
  Clone ID: LIB3228-016-P1-K1-D6
cggacgcgtgggaaaaaaaaaaaaaaaaaaaaaaaaaaaaaaaaaaaaaaaaaaagggggggaaaaataaattttttaggtaaacaagattaaaaacaaaagggtgctaaagttttgagtttattttttttctattcgtgggcgtgcttgtcctttttttgtggggggggcgcttctttgggccctccttttttgcgggtggtgtgccaagattaggtttttcctgggggccccctaatttgatttgcggggggggtggtttccccggtcgggcggggaaaaccgtgggtgtgccccattgtggtcggcggggtcattccccttttggcgggggggggtaataggtgggggcgccaatctactcctctttttgctggtgctgccttttttt

SEQ ID NO: 3548 - DNA, 407 bp, Zea mays
  Clone ID: LIB3228-016-P1-K1-D8
attgcaggtttttttttttttttttttttttttttttttttttttttttttttttttttttttttttttttttgggggtttttttggtttccttttttctataatttaaataatgaattatgttaaaccatttttgggggcgggggccacaaggggggcaaaaagggacaaagggggggggggaccccaaagggggggcgccaaaaaaaaaagggggggggggggtgggggggccaaaggggccccccggggggggggggcggaaaaaaaaaaggggggggggcccaaaaagaaaaaacggggccccggcgggaaaaggaaaaaactggtaaacccgtggggggccccaaaaaaaaaaggggggggcgggggtacacagcggcggggggggaaaaacccgggggggc

SEQ ID NO: 3549 - DNA, 216 bp, Zea mays
  Clone ID: LIB3228-016-P1-K1-E11
aaaaaaaaaaaaaaaaaaaaaaaaaaaaaaaaaaaaaaaaaaaaaaataaaagagggggagcttacattcttgtgcttgcaaacagtaataactttttttttgcgttcacctaatttcttttttcgggccgccgtttttcaactgcctttactggggtataatcctggggtgtcccagcttattttgcgtagttcacattcccctttttgccagct

SEQ ID NO: 3550 - DNA, 113 bp, Zea mays
  Clone ID: LIB3228-016-P1-K1-E2
tccgacacgcgtacgaggacagcgtgggcggacgcataaaaaagacacgggaatacaggggggggggcgacagtcgtttctaaaaaaacatcataacagtcaattgaaaattt

SEQ ID NO: 3551 - DNA, 213 bp, Zea mays
  Clone ID: LIB3228-016-P1-K1-E3
aaaaaaaaaaaaaaaaaaaaaaaaaaaaaaaaaaaaaaaaaaaaataaaaaaaaaggggggggaaaataaatgtgtaaaaaataggcataactctttgggggggcgctctttattttcctctctcttttcctcccgtttttcctcctttatttgctgtggtctttattcggggggtgttcccccctctttttttttcccttcctttttccttt

SEQ ID NO: 3552 - DNA, 416 bp, Zea mays
  Clone ID: LIB3228-016-P1-K1-E4
cccacgcgtccgaaacgccaaacgccgctgcgctctctctccttctcgtcctgaccccccagagcgagagggaggggcacccagaggagcctgtcgttttgatcggtgtctctctgcccccgttcccgcgaggagagaacaacctggagaaaatggcgccgatctccggagccacggccgtccttgtgatggccgtcgtcgccacgctcgccgccgcggctaacgccctggcccccgccccagcacctgctaccagtgacggaacaagtgtagaccagggaatcgcctacgtcctcatgctggtggcgcttgtcctcacctacctcatccacccattggacgcctcctccgcctacaagctcttttaaaaccatccgctttgtaatttggcgccaattgagggtgtcattaacggt

SEQ ID NO: 3553 - DNA, 174 bp, Zea mays
  Clone ID: LIB3228-016-P1-K1-E5
cccacgcgttcgcggacgcgtgggtgcgaagccgcctcctcgtctgtaaaaaaagagggaggaaaaatttgaattaaaaaaaaaaaaaaaatgggggggttgtttatgaagttccttgggtaaatttttagagtatttgtcgttaattttttgtccttttttgttacgtttttt

SEQ ID NO: 3554 - DNA, 402 bp, Zea mays
  Clone ID: LIB3228-016-P1-K1-E9
cccacgcgtccgcggacgcgtgggttggcaagaagctactcctttggcagtccttcctttgctttggaccaaatctttgtcgctgaggcaacttgtgcatttcgcttgtgaaacggttgtggttgtacgcagtcaggaaaagtatacgacaacggctgggccacttttgtgttatatatatgaaagttacgtaaacgtttatatcagaccggggtgctgttgtaagttagcctgttgttggaggctacatgcctaaatgctgcacgatgtagtggtgtggagatgtggtggctgtggctcttatgggcctgtgttgtttccctgacaagggtggttcatatggctggcctgagaccgattggtttggggttgttttctataaacaaaacgaggttgaggatt

SEQ ID NO: 3555 - DNA, 409 bp, Zea mays
  Clone ID: LIB3228-016-P1-K1-F10
cactaatccaagacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacaggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgag

SEQ ID NO: 3556 - DNA, 422 bp, Zea mays
  Clone ID: LIB3228-016-P1-K1-F11
cggacgcgtgggtgtagtttctccgtatacacggagcagtagtattctgtaaagaggaaaatggtggaaaccgatgttgcattctgcataaatttattaatagggctagtttcacaaccttattttttctaaggggttttattttttcaagggaatttaattcattttctcttgaaaaaataggatccacttgagaaaatgaagttgtcaaactagcctttataattatataattcatcggggttttcatcttgtttagaaaaaaaaaaaaaaagaaaaaaaaaaaaaagataaaacataaaaataattaataatgcaaaagaggtcgcagtttaagaacttaattattttattttttgtagggggggccgttttagaggacccaagttttcttcccgggggcttgcgaagttttttctttt

SEQ ID NO: 3557 - DNA, 406 bp, Zea mays
  Clone ID: LIB3228-016-P1-K1-F12
tgaaacgcgtggggatccatatcgcgatcttatatctaaaactgccaagataaagggaatgcgagtcgtttcgcaagctccagccaggccgtcatcctgcttctcctgctcattgtgtccaccgatatggcacaggcaaggcaatgcgagaagcacagtgagcgatccgttggggcatgcatgatcgcagacaactgcgccaatgtgtgccgatgagagggcttcttggccagcaggtgcagcaccttaacgccgccgctgcatctgcactagacagcgctaaacaagatcgctcgatcgctcgccatgcatcgacaacctagtcttaataacgttgattatctcattattatttatgacaaatgtgatgtatgttctcgccactgtcatgtatattatgatgact

SEQ ID NO: 3558 - DNA, 315 bp, Zea mays
  Clone ID: LIB3228-016-P1-K1-F2
aaaaaaaaaaaaaaaaaaaaaaaaaaaaaaaaaaaaaaaaaaaaaaaaaaaaaaaataaggggaaaaaaaatattttttacacaacctttcaatagaagacacctttcttttgttgccccgcacgtttttttccctggtcgtcgtttttaaaccccttgtcttggtaaacctggggggcctcccttgttattcccctttcttcccctccccttttagctaattggcctttttcgtatgaggcccccaacatttgcccttcccgacttttgtttagcccttttggggaaacggccccccccccccccctgttcttt

SEQ ID NO: 3559 - DNA, 413 bp, Zea mays
  Clone ID: LIB3228-016-P1-K1-F3
gtggataccaacctggaatcaccaaaggatattgtcccagaaggggtgccattcacaggttcagggtacaggattgctccctactcttccatcttgcttaaggcaaagccttagaatggcggaggcaagtcattctcaagtaagcacgaataatggtgttgtgatccctaactttccaagctcttagccaactgtactgcaagtatagcaaactttggtatgtgaagtcggaccaacccttgcggaaatcaacggaagccatggtttgctaaaggtatactcatggagaattggagatatggcaaacacatacgcaagtaacctccacacatctaagcaagaagagcctttcattaggggatgcatggctcgaggaaactatatttgaatttggttgattcatttttatttgt

SEQ ID NO: 3560 - DNA, 164 bp, Zea mays
  Clone ID: LIB3228-016-P1-K1-F4
aaaaaaaaaaaaaaaaaaaaaaaaaaaaaaaaaaaaaaaaaaaaaaaaaaaaaaaagggggggtagggattttaaaaaatttactaacgctcgcttgcaacgtttaaatatatttttttgtttgatactttatagaatttcttggctgtctggtcaattgcctc

SEQ ID NO: 3561 - DNA, 215 bp, Zea mays
  Clone ID: LIB3228-016-P1-K1-F6
cggaataaatagttccggaattccctaaaccgtcctttaatttttccctgccaagagaagggaatggagtcttttcgcaggttccaacccgccggcattctgcttcttctggttattggggccaaccattttgccccagccaagggattccgagaggtccagggagcgattggtggggccatgcatgatcgcaaccacctgcgccaatgtgggcc

SEQ ID NO: 3562 - DNA, 76 bp, Zea mays
  Clone ID: LIB3228-016-P1-K1-F8
gtagatccttaaatttacaaactccctacaaaacccaatttcactcctacatttaagaacctcgttggaactatct

SEQ ID NO: 3563 - DNA, 280 bp, Zea mays
  Clone ID: LIB3228-016-P1-K1-F9
ccttctccccccaagtgattgcagcaccccccccccaaccctagccgccccccctgctctccatggtgcatcctccccgcttggtaccccgtcgtgtgggtgcgagtcttccattggagtttggagggaggaagaaggaagaatggaaggaggaaaggaggaacccaaggtggtggacttccggatcgtacttagggatttgcccgaacttccggtaaaggtacttgatacatgttgggaatgaggggagtagcagcacgtccacttacactttcacaat

SEQ ID NO: 3564 - DNA, 407 bp, Zea mays
  Clone ID: LIB3228-016-P1-K1-G10
gcgtcaacgaggtggtcggcgacgtctccacctacgacagcggcagggtctggggcgagaagtactacaatggcaacttcgagaggctcgccaggaccaaggccaaggtggacccctgcgactacttcaggaacgagcagagcatcccgccattgctcaagtgatcgatgatacccggtcccatccagatcctttcgaccgcgccaagcaaaaggacgacgagtcgtacatgattctgctgattatattaattagattgatcctgctttgcatgcgttgagccaggtgctttgcatggcgagttagctacgtagttggcatcagccacatgcatgacattaaaacacaagctgacagccggctacccaagtaaataaggatacgcgacatacactgtcgtgccaatt

SEQ ID NO: 3565 - DNA, 294 bp, Zea mays
  Clone ID: LIB3228-016-P1-K1-G11
aggggcggggcaggcgtcccttgacccatgcttttctttaacagcaacgtatcaaaaaagcagagcggaacggggggggagttgttggacactctttggagccccatcagcggtgatggacatggaatatggagggacggaacaaccgctttagtatcctgagggggctgcggaaccagctgaaggcactcgtaccaaaaaaaaaagaagcacggtctgcccagaggatccaggccaacgtacccccgcctgccaagttatagctgtttgtataggggcacctaaatgcaattt

SEQ ID NO: 3566 - DNA, 361 bp, Zea mays
  Clone ID: LIB3228-016-P1-K1-G12
ggctgagaaccaccgccatcacacagagagataataacggggtgttatcgccgccgcgggcgatgccggggaaaccatcgctgatggaggagcacggtcgccatcgatcctggatttaatcgtcgggggtgtggaatttgggccttgtcgggccgagctgatggtgggcatgatctcggttggcaagatcgggggccagaacaccttgtattctccagcgctctgtcgaggatcatcccactcgcgtgggcagcctcattggcactttatcttcagtaaagatactcacacacgaattgccctacactctgcttcttgtagagccatttaggttacaggatagagccctgctgcgaggatt

SEQ ID NO: 3567 - DNA, 270 bp, Zea mays
  Clone ID: LIB3228-016-P1-K1-G2
cgacaaacccctaaaataaatacatgttttagtttgttaattaatatatatatcattatggaataaagataccaggatgtggacccatgaagcagaagcagatcaaatactgctacatgacgggggcatgccctaatgcagcaacggggaatgaagagcagtctgacgagtgtcaataaaataggatatcatgtattttcaaacaaaaacaataatcaaaccgttttcaattctgatttttaattttattttcaacccgatttcagtttt

SEQ ID NO: 3568 - DNA, 312 bp, Zea mays
  Clone ID: LIB3228-016-P1-K1-G3
cgacaaacccctaaaataaatacatgttttagtttgttaattaatatatatatcagtgtggaataaagataccaggatgtggacctataaagcataagcagatcaaatactgatacatgacgggggcgatgccctaatgcagcagcgggaaatgaaaagcaggctgacgagtgttaagaaaataggatatcatgtattgtcaaacaaaaacaataatcaaacctggggcaattataatatttaatttgtgtggcaacctatattgaggtgtaaggaaaaaaaatgggggtggccactttatatgattcaagc

SEQ ID NO: 3569 - DNA, 421 bp, Zea mays
  Clone ID: LIB3228-016-P1-K1-G4
ggaataaatagttcgtgaatccctgaagcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgccgctgcatctgcactaggcagtgctaaacaagatcgctcgatcgctcgccatgcatcgacaacctattcttaataacgttcattatctcgttcttatttatgacgaatgtcatgtatgttctggtgactgtcatgtatattctgatgactgtcatgtatcttgt

SEQ ID NO: 3570 - DNA, 172 bp, Zea mays
  Clone ID: LIB3228-016-P1-K1-G6
ttgacccatgcgtttctttaagagcatcgtcgaataaaagatgactgcagtcagattgctttcttttgatacctcatattggcccatcgggtgtgatggacatgtaatattcagttatggaacagccccatttctatgcttagcgtgctgggaattttgcaaaaggcctcat

SEQ ID NO: 3571 - DNA, 141 bp, Zea mays
  Clone ID: LIB3228-016-P1-K1-G9
gccatggccgaggcggggatgaagcgcagcttgattggtgtcccatgttccatgtgcaaccacctgatagcacgcggcacttgcatccacattgctagcccattatgggaattggtaattgaggcctcctccacagcaatc

SEQ ID NO: 3572 - DNA, 325 bp, Zea mays
  Clone ID: LIB3228-016-P1-K1-H10
cccacgcgtccgcatccgtgatatgttcttgctctccctctttttctttctgtttgatttcgatgtgttatcatgttcttagcctctaattgtatcaattcttgatatcaaggactccaaaattatcgttttttgtgttttcgtgccaaaaaaaaaaaaaaaaaaaaaaaaaaaataaaaaaaaaaaaaaaaaaaaaaaaaaaataattttaaaagaaaaaaaaattaataaaaaaaaaataaaaaaaaaataaatattttatggggcggcctgtttaaaggttccaagtttacttccccgtaatttcaaggttttttttttttt

SEQ ID NO: 3573 - DNA, 289 bp, Zea mays
  Clone ID: LIB3228-016-P1-K1-H11
gagccacccgtccggtcccatgcaccggcgtcaccatggatgacgtcaacgtcgagtatagcggcaccaacaacaagaccatggctatatgcacgaacgccaagggcagcaccaagggttgcctcaaggagctagcatgcttctagaccctccatcgactgacccatctctctagttataatttttctctcgtccttgcattgcccattagatgctatccattggtagcgcacaacagtaaaacggcgggcattcgacaactattttatgttcgacagaacaacaccct

SEQ ID NO: 3574 - DNA, 381 bp, Zea mays
  Clone ID: LIB3228-016-P1-K1-H12
gtctgatgcccagcggcatcactgagagagataatcacggagtgttatggccgcagcagcaaatgcatgggtatccacacgtacgggaagggcacggccagacgtctgtctcagggtgaatgcgtgctggtagacgaattcatcgactggcccgaccgtgcagatagaaggcatgttctgggctggcatgatcgatgaccagctctccattgattactgcagagctttgaaacggctgacaccactcaggtatactatgttagacggtctaaatctccagataagatgctctcacacgtattgccctactatctgccatttgtagggccttttaggttacaggatagagccctgctgggaggattgacgctttttagccat

SEQ ID NO: 3575 - DNA, 403 bp, Zea mays
  Clone ID: LIB3228-016-P1-K1-H3
gttgccggagaggggagacttcgatatgaaggaagtccttgagtctacgtattttttcaactagcacaatcaatgttaacagttgcattatacacgctgctgcccggacatatctgagttctgagtgtagatctaccaactcgaatgatgaaagctaggtcatacatgagcataacccgaagagtggctttgcagaagttatcagaagctaagttggtactctgagcattcacaaatgcatcggcatcatttatcgcgttgaagttggcaatgaggtttgctaaataaaagtgggaaccatatcaaagttaaacgagaatccctgtaaatgtaattatgtaaatttttttttgtctttagtggttttattttccttgatcttggtactgtcgagagatattcg

SEQ ID NO: 3576 - DNA, 421 bp, Zea mays
  Clone ID: LIB3228-016-P1-K1-H4
gtgtttgtgcataacccacgctacagcttctggactcgatcttttacgcactgtgctcctgagatagagaagcttatccagtcggttgcaaggtcctatggagaggaaaggggcagacgatggaatgggtctagcggacggagcccactagggaaaaaatgcctagcatcgaatgaattccaaaaacatcagatgtagttttgctgatatggtatagttagagtaggtctgcgtggtttgctcggaatgaagatggacctgtgctatgctggaagtttagcccatctctatctctaacacaaaatctgcaggggaaaccactggcaactgatcaggcaacatagtccgttagtatgctaatcgttagtttccgcaagcttacaatatcaaccgctcgactgggtcattttgggtttatcat

SEQ ID NO: 3577 - DNA, 188 bp, Zea mays
  Clone ID: LIB3228-016-P1-K1-H5
cggacgcgtgggaaaaaaaaaaaaaaaaaaaaaaaaaaaaaaaaaaaaaaaatagggggggggtaaaagaataatggctatatgcaccatccatagagcctaattagatgttttgttaattgagcctggctttgattttgttccctccttctgctgacgcatctctgtggttttaattatttttttcg

SEQ ID NO: 3578 - DNA, 259 bp, Zea mays
  unsure (1)..(259): unsure at all n locations; Clone ID: LIB3228-016-P1-K1-H6
aaaaaaaaaaaaaaaaaaaaaaaaaaaaaaaaaaaaaaaaaaaaaaaaaaaaaaagggagggataaaaaatatatagttattaaaataaaacataaaaaaaatatcacttatgtttttcaaattgatcactgttagttaacttgtgctncgttatacagggggggggctttttaagggttccaaagtttcgtcccgggggtgggcagggttttgctctttttttgggggcgccgtaatttatttggggggggggggttt

SEQ ID NO: 3579 - DNA, 296 bp, Zea mays
  Clone ID: LIB3228-016-P1-K1-H8
gaaaaggaaggcaagtgatgacacagatgatgacgacgacgacgatgattttgtagcttctaaagcaaagaccaagaggcacaaggcctagttaggtcctagcatctcattatcctagtaatgagacgtgttcttcagacaatttctagctcggatgaccttggatgattgttccttccattggtttgctcatttggggcgcgcaactaaattatgtgaagtagcgtgttgtgttgtgtcaagaagtaccgcttgtcgatggccttttcagatctggaatgaaggtaagttcctgc

SEQ ID NO: 3580 - DNA, 359 bp, Zea mays
  Clone ID: LIB3228-016-P1-K1-H9
cccacgcgtccgcccacgcgtccgcccacgcgtccgcttggtatgaaaccacatgtgtgtgatgttattttgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcgccccttttaaagaatcaaagtttacgtccccgtgcttgcaacgtaaaagcttttttatagggcccccaaattcaaattaactgcccgtcttttaaaaacgtgtgaactggaaaaaccctgggtttcccaaattaaatcgctttgaaaaaaatcccctttt

SEQ ID NO: 3581 - DNA, 234 bp, Zea mays
  Clone ID: LIB3228-017-P1-K1-A10
cccacgcgtacgcagtcgcgtgggttgaaattggaggagatgactaatactattttgagagagcttatctggaccatgtgccatcttgctaatatttaatctttttctttggttatattgaggcaccacatgagccatcaaaaaagttatgttacatgtaactttctcctaccttattgcgttaggattttatgcatgattacactaatttaaaatacacttttatttaatatt

SEQ ID NO: 3582 - DNA, 388 bp, Zea mays
  Clone ID: LIB3228-017-P1-K1-A11
cccacgcgtccgcccacgcgtccgccctccctcactcagccaaacctgacatcagcctattacaagcgtcagtagagatcttccagatggccatggccaagcccccgcttcagacggccgcgatcatcttcctcgtgctcctcgcgaccgcgtcgtgcctccacaccgtcgacgccgccgctttagggttttgctggggcaagtgcagcgctcggtgcgcgcgggcaagcgcgcggcgggcgtgggccgcgtgcatgagctcatgcggcctctgctgcgaggagtgcaactgcgtgccgcgcgacatccatgactgcccctgctacagcaacatgttcaccaccggccccaagaagatgcccaagtgcccctgagactgagactgtga

SEQ ID NO: 3583 - DNA, 191 bp, Zea mays
  Clone ID: LIB3228-017-P1-K1-A12
cagacgcgatgggttacccgctcatattgctgaaagctaatcaacttggggaggcaatatcatttttctttactacaacttatttgggcccatactcgaacgctcaatatgcatactctgtgctttccttgaataaatttaaccgtgatcgctttgtctgaagcgtgttaaaacggacaaattacggttac

SEQ ID NO: 3584 - DNA, 270 bp, Zea mays
  Clone ID: LIB3228-017-P1-K1-A2
gccacttcagtgcttgcgatcgcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagcccgagggcgtggggg

SEQ ID NO: 3585 - DNA, 267 bp, Zea mays
  Clone ID: LIB3228-017-P1-K1-A5
aaaaaaaaaaaaggaacaaagcaaaaaaaaaacaaaaacaaaaaagcaaaaacaaaaaaaaaaaaaaaaaaaaaaaaaagaaaaaaaaacaagaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaa

SEQ ID NO: 3586 - DNA, 364 bp, Zea mays
  Clone ID: LIB3228-017-P1-K1-A8
aaaaaaaacaaaaaaaaacacaaccaaaaaaaaaaaaacaaaacaaaacaacaacaaaaaaaaaaaaaaccaaacaaaaaaaaaaacaaaaaaaaaaaaaaaaaaaaaaaccacaaaaaagacaaaacaaaaaaaaaacaacacaaaaaaacaccaaaaaaaaaaaaaacaaaaaacacaaaaacacaaaaaaaaaaaaaaccaaacaaaaaaaaacaacaaaaaaaaaaaaaaaaaaaacacaaacacaaaaacaaaaacaaaaaaaaaaaaaacaaaaacaaaaaaaaaaaaaacaaagaaaaaaaaaaaaaaaaaaacaaaaaaaaaaaaaaaaaaaaaaaaaaaaaaaaaccgacaaccc

SEQ ID NO: 3587 - DNA, 392 bp, Zea mays
  Clone ID: LIB3228-017-P1-K1-B1
acgttatggaaacaacaatagctatggacatgatactcacataaataattttcagtggggccagttggaagaaaggaaggatggccatttcaggtttttctcagagatgatcaagtttcggcataaccatcctatattgagacgagacaggtttctcaacaaaaatgatgtcacttggcatgaaaatcgttgggagaaccaggacagcaaatttttggcatttacgatacatgatcacagttctggtggagacatctatttggcattcaatgctcatgagtattttgtggatgctgtaattcccccaccaccacaccataaatcttggagtcgtgtggtggataccaacctggaatcaccaaaggatattgtcccagaaggggtgccattca

SEQ ID NO: 3588 - DNA, 166 bp, Zea mays
  Clone ID: LIB3228-017-P1-K1-B10
cggacgcgtgggcggcaacggatatctcggctctcgcatcgatgaagaacgtagcagaatgcgatacctggtgtgaattgcagaatcccgcgaaccatcgagtttttgaacgcaagttgcgcccgaagccttctggcggagggcacgtctgcctgggcgtcacgcc

SEQ ID NO: 3589 - DNA, 106 bp, Zea mays
  Clone ID: LIB3228-017-P1-K1-B11
gccttagtttccttgcattttatcttcagtttaactagtctagggtagcgaatgatacattcatataatgcagaaaggggcccttccgtctcgtcatcatattcct

SEQ ID NO: 3590 - DNA, 205 bp, Zea mays
  unsure (1)..(205): unsure at all n locations; Clone ID: LIB3228-017-P1-K1-B12
aagtatggaaatcagtgataagctgcttgaaatggggatgacggctttccatcctaaataatagctgtccgcccaccccaccccccaatatgcttgttttgtgattgtgtagaataaagtgaactgcgaccggcatgtgtgaagtttgttaaattgtagaatcaacttgtaactatggatggtactcctgatngtttgcctggcc

SEQ ID NO: 3591 - DNA, 394 bp, Zea mays
  Clone ID: LIB3228-017-P1-K1-B2
cggacgcgtgggctccgatccatcaacaatcgccgagagcgatcgagagataaataaagatgaagaaagtggcatcatcgtcagccgttctcttcgtgctagccctgacgctagtttgtgccccgctgatagcagaggcaaagaagaagagagtcgccgccgccgccgccgaggagaagaaggtgcaggacaacttctgctcgacgctgtgcgagggcaggaaggggatggacctggtggtgtgcaaggagtcctgcgacctctcacagcgctccaacctggtgctgtacggccggatccagtgcaagggcaagtgcaccgagcagaagggcatcaccgcgccgcagatgaaggtgtgccaagaggcgtgcgacaaggactacgtggtcaaggc

SEQ ID NO: 3592 - DNA, 399 bp, Zea mays
  Clone ID: LIB3228-017-P1-K1-B4
cggacgcgtgggcggacgcgtgggttttacctcacctcatggtaatataacatcttgaacaaccataatacaaaatgaaatgcagttctgtcacgacaacatcgcattcataagcaataccacccatctagtacctagcaagcatcaccacacgaacctcaaactgacgagtactaacagcgatacaaggaatatcatatctgtaccaagcactgcggagaatgacttaggtctcttcctcttcttcctcctcctcctcgtactcctcatcctcggcagtggcgtcctggtactgctgatactcggccaccaggtcgttcatgttactctctgcctcggtgaactccatctcatccataccctcgcctgtgtaccagtgcaagaaagccttcctcctga

SEQ ID NO: 3593 - DNA, 400 bp, Zea mays
  Clone ID: LIB3228-017-P1-K1-B5
aaccaaaccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgtaatcgtgtccactcgatcgagagatcgatcgatgcttgttattatattt

SEQ ID NO: 3594 - DNA, 229 bp, Zea mays
  unsure (1)..(229): unsure at all n locations; Clone ID: LIB3228-017-P1-K1-B6
ggctgcactcaaatcacgaccaggcacctgccgcagcccagggccagctcaaggcgtgacgccgncagcgcccccgtcaccgtagccgtcgaagggggtgccaccgccagcgaagccgacgaacgggataccgccgtcaccgtcgccgaggggcccgaacccgccgacgccgtccagcgggccgacgccttcgacgccgtccccgacgccgaccaaagggaccgtgacg

SEQ ID NO: 3595 - DNA, 381 bp, Zea mays
  Clone ID: LIB3228-017-P1-K1-B7
cccacgcgtccgcccgaacgccctgggcgcattcttcggactcatccagctgatcctctacttctgctactacaagtcgacccccaagaatgagaagaacgtggagctgcccaccgtctccagcaacgtcggcggcggcaacgtcaccgtcagcgttgagcgatagataatgtagctgccgccgcccgtcgagaacgaactcgacgagacgtgctttacccacaagtagttttggccttgtctaattgctcttctcggatgatcgtttaagtgagtgttagttagttttgccctgcatgtcatgtcaggaacaattaatatatccatgtggctgtgtttgccattctagataattaagaacaatcgtatctgattgctacc

SEQ ID NO: 3596 - DNA, 290 bp, Zea mays
  Clone ID: LIB3228-017-P1-K1-B9
accagaacattgatgcactatctgatggtcaacaaccctgtaaagaaaccacagggacgggttgaattttatttatcctgggcgcgcacccctttgatcttccacacctcttacttcaaggagcttctgagcggagagattgaaggccttctgcagctaccaagtgacaaagccctcctttctgatccatccttccgtccactttggctcaaccacacttaatacgctggcgcaacatttcctttctacaccgtggcctaatagaaaatatgacactcccgatttgcctt

SEQ ID NO: 3597 - DNA, 388 bp, Zea mays
  unsure (1)..(388): unsure at all n locations; Clone ID: LIB3228-017-P1-K1-C1
gcgaccaggacattgttgcgctttctggtggtcacaccctgggaagatgccacaaggacaggtctggatttgagggagcctggacgtccaaccctntgatctttgacaactcttacttcaaggagcttctgagcggagagaaggaaggccttctgcagctaccaagtgacaaagccctcctctctgatccatccttccgcccacttgttgacaaatacgcagcggacgaggacgctttctttgctgactacgccgaggcccacctgaagctttcagaattgggatttgctgaggcgtaacgaaccagaagagtgtggtggctgtcgccggccggccttgtgtttttgttgtctgcttttctcttgaacgaagatgtgatgaactcagc

SEQ ID NO: 3598 - DNA, 393 bp, Zea mays
  Clone ID: LIB3228-017-P1-K1-C11
cggacgcgtgggcttaattgcgccactgctcgttatcctcctcttgcattgcattgcaggtcgtagttgagcagcagcaaccactgcacaggatgtcgtggcagacgtacgtcgatgagcacctcatgtgcgagatcgagggccaccacctgagctctgccgccatagtcggccacgacggcgccgtttgggcccagagcaccgcattcccacagttcaagccagaggagatgaccaacatcattaaggacttcgacgagcctgggtttctggccccgatcggcctcttccttggccccaccaagtacatggtcatccaaggcgagcccggcgctgtcatccgcgggaagaagggatctggaggcataactgtgaagaagaccggacaggcgc

SEQ ID NO: 3599 - DNA, 392 bp, Zea mays
  Clone ID: LIB3228-017-P1-K1-C12
cccacgcgtccgcccacgcgtccgggcggaacatcatcgggcagagcatgtaccagctcctcatgctcggcgtcctcatcttcaagggcaagagcctcctccggctgggcagcggcggcgatgtatccgacgcccagctcaacacgttcatattcaacaccttcgtcttctgccaggtcttcaacgaggttaacagccgggacatggagaaggtcaacgtgttcagcggcatctttagcagctggatcttcccggcggtcgccggcgccaccgccgcgttccaggtgatcatcgtggagttcctggggactttcgcgagcacggtgcacctgagcgggagactctggctcgctagcatgatgatcggctcgggaagcctgctgatgggcgcc

SEQ ID NO: 3600 - DNA, 387 bp, Zea mays
  Clone ID: LIB3228-017-P1-K1-C2
cgagaatatttgtgtacaggatcagcttataaaagaacagagcagatctgaggggttgtcggcagagataatgaaactttcagctgagcttaggaaagcagtccatgcacagaataaccttgcacgcttatacagacctgtattaagagacattgagagcaatctgatgaaaatgaaacatgaaacttatgcgacgatccagtgatacatgttgacatgttgacgaaactcagtcctgtgacatggccgcatgggctccacgttactgattttcgacgaggatgtatttatctcatgccatcttcaagatgctggtgcaaagcagttcttttcgtggccaccatttataagtagagttcagtcgagatcgctgtacttgtatcatac

SEQ ID NO: 3601 - DNA, 75 bp, Zea mays
  Clone ID: LIB3228-017-P1-K1-C3
cccacgcgtccgggtgatattacagttgaattgccactctttatatgtacgaagtaatcgtatgataatgataac

SEQ ID NO: 3602 - DNA, 222 bp, Zea mays
  Clone ID: LIB3228-017-P1-K1-C4
cttcccccaaagaggggggttaaagggggagggaaggggacctggccacatggcccccttaggggatttttggtccgggaattttttttggaagccatatattgattgagaggtggcaattttaaagtattaaatatataagtgccaaagcccaccgtaaagggtggcaatagccttggcacaactatatggaatcctaagaattccccttaacctttccgg

SEQ ID NO: 3603 - DNA, 367 bp, Zea mays
  Clone ID: LIB3228-017-P1-K1-C6
cccacgcgtgcgaaaaaaaaaaaaatgaaccactgctcgatatactaactattgcattgcatggcaggtcgtgctttatcagcaacaaccactgcacaggatgttgtggcagacgtacgtcgatgagcacctaatgtgcgagaatctaggccaccacctgttctctgccttcatattttgccacgacttcaaccaggttaaccagccggacatggagaaggtcaacgtgttcaaggagatgaccaacatcattaaggacttctacgagcctgggtttctggccccgatcggactgtttcttgggcccaccaagtacatgtttatccaaggcgagccccccgcttttattcgtctgaagaaggggtct

SEQ ID NO: 3604 - DNA, 383 bp, Zea mays
  Clone ID: LIB3228-017-P1-K1-C7
ccactttgtgcctgaggagcctgcgtgggtgagagcaaatcgtgtgcgatacgtagctcaagcacaaaacgtctgctccaaacaactcttgaggagcatttcaaaatttcaaggaaaactggattgagaaccaggatgtacaatttagaagtcatcgctggttttgtagtttaggtagagcggttttgtatagtacaaagttgtacagatcatctaaccgatgtagatattagcttatcgccacctatcgtaccagtaaattggtacaggagaatgctctcaagtgttagactgagtttttttcctcttccattttaatgatctgtttaattgaacggaaactcagacatggtacaccatgtaatgtgctgtggttgatttcg

SEQ ID NO: 3605 - DNA, 369 bp, Zea mays
  Clone ID: LIB3228-017-P1-K1-C8
ccaagtcatcaccgccacctactcctgtgagcttgccacctccaatagttaagtcctctccaccaccggcaatggttagctcaccaccgatgacgcctaagtcgtcacctccaccggttgttgtgagctcaccaccaccaactgtgaagtcttctccaccaccggcaccagtcagctcaccaccagcgacacctaagttgtcacctccacctgctcctgtgaacttgccacctgcagaagtaaagtcttctccaccaccgacaccagttagcttgccaccgccagcgcctaagttattaactgcacctgctcccatgagcttgtcaccacctccagaggtgaagttttcttcaccaccagctccagttt

SEQ ID NO: 3606 - DNA, 387 bp, Zea mays
  Clone ID: LIB3228-017-P1-K1-C9
gcctggaaaagcaagcttcagcctgaatcaagggagctgtttgagtttttgcccaatactattcaggagcaacttatgcttgaaagggatccccatggcaatgttcaggtcgcaaaaattgaaaccgagaaaatgctcattagcatggtggaaactgaactggagaagagaaaggcagaggggagatactctgcacatttcagagggcaagctcatttctttgggtacgaaggaagatgcggccttcctactaattttgattctaactattgctatgcattaggctatggcgctggtgcccttctccaaagtgggaagacaggacttatttcctcggttggcaaccttgcggctccagttgaagaatggactgttggtggaacagca

SEQ ID NO: 3607 - DNA, 200 bp, Zea mays
  Clone ID: LIB3228-017-P1-K1-D1
cgcgcgtgtgggttagttaccttctcctccgagaactccatgctcgacgctatcgagaacatgaacggcagggagctcgacggccgtaacatcaccgttaaccaggcccagtcccgtggcggtggcggtggcggcggtggctactgttgctgtcgcggctgtagcggctatggtggcgggcgccgtgacgacttttctgg

SEQ ID NO: 3608 - DNA, 382 bp, Zea mays
  Clone ID: LIB3228-017-P1-K1-D10
accgccctggctagcaccacacaccgcaggtatggagaaggcgacgaggctggccttggcagcggcggtggttctgtgcctgctgctggcgaccgggccgcaggaggccgccggcgccgaggggatgctgtcgtatgataagttgctcagctgcaaggtgctgggcaactgcgacaagaacaggggccccggggccacccgcccggggaagcccgtaaacaagtacacccgcggctgcagcccgctgacccggtgccgcggcggctgatcatatctccggtggttctggtcgatgtgcgcgcaacgtcacgcgcgtgcaggcaccagcgccggccggcccctgagggcggaggcaaagggggcaaccgccctggtgggcctc

SEQ ID NO: 3609 - DNA, 395 bp, Zea mays
  Clone ID: LIB3228-017-P1-K1-D11
gctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttctt

SEQ ID NO: 3610 - DNA, 150 bp, Zea mays
  Clone ID: LIB3228-017-P1-K1-D12
ctcacacgtattgccacgagtacgtgcagttcatcatcggccacagcgaggggcaggttctcagggttggtgtacatcatttacaagggcaagagtctgctatggctgggcacagtgctagatacatacggtgccgtcgcagcgcacgct

SEQ ID NO: 3611 - DNA, 281 bp, Zea mays
  Clone ID: LIB3228-017-P1-K1-D2
ccgagcaaattaaagagggatcggattggaactcgatccgaaggaaggttctgcaagccggctggccggtcgtcgaacgaggaaccaagctgctgctgccgctaccggacgacaccaaccatgaaccgatggactacgtggtgccaaaggcagctgcttctactactggcggcgtcgactgcgacggcacatttctcgatcggcgacgtggacgagtacttgaacaggcgcacgcaggagtcccgccacaggaaccacggcggggcgcaaaaaaagaacct

SEQ ID NO: 3612 - DNA, 393 bp, Zea mays
  Clone ID: LIB3228-017-P1-K1-D3
gatggatcttggaaaatctccgaggctgctgtccgggacctgacgtgatttcggccaactcggcaaacgggctacacaaccattggcgtataggcggcatggcaatcttaacctattaggaatgtgtagtggcactattaggttacctgcagttcaatttgagttctttgcattagttagctgagctccgttgggatgctttgaggtcttgagctgctctcatggtgagcttggccctttggattcaggatttgacacaatagttgctggcagtacagatgctaaccagtgctgattccacattcttccttttccgatatgatgtgaattatgttatctagtttttgagttttacccacgtgtaattgaaatccgtgaccgccattgttcaaa

SEQ ID NO: 3613 - DNA, 350 bp, Zea mays
  Clone ID: LIB3228-017-P1-K1-D4
atccatccttgcctccctgagcaccttccaacagatgtggatctcaaaggctgagtatgacgagtcaggacctgggattgttcatcggaagtgcttctaagctctgggtcccccttcggctccattttatttattccttgagtgtttttcatataagctactatgtttgggattgcatgcctttgagcaggcaatgttgttgaatttatattttgggatttatattttgtggctcactacaatgcatgcattgctccagctcctttccatgccaaatttgttgctagtggtgaaaacatcaaccacaaaaaagagaggatggaaattaataaagtacctaggatcatatt

SEQ ID NO: 3614 - DNA, 399 bp, Zea mays
  Clone ID: LIB3228-017-P1-K1-D5
cctttagttgccaatttaaaggaacagtagaaggaataccgatttgatggcccaaaataagcagatcattgttgtggtggctctcctttttcttgtggtggcaacatcatcatcagtgtgggttgcagaaggagccgatgacttaaaagtttcttgcgttaaagagtgcacccaaaattttaacactcccgagggcaagaagatctgtgaaacgatgtgtgccaaccctaaaggaaggcctatcgacagagttagagctgattgatcaatgctcatctttatttgtagctagctatcatgcatgcgatgatggccttcttgattattattatttcattcctcatgttgtttgttcttgcatgttttttccaccactaatattgtcctaattgatgcata

SEQ ID NO: 3615 - DNA, 386 bp, Zea mays
  Clone ID: LIB3228-017-P1-K1-D7
agcaaattaaagagggatcggattggaactcgatcggaaggaaggtcctgcaggccggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgacgtggacgagtacttgaacaggcgcacgcaggagtcccgccacaggaaccacggcggcgcgcagatcaatgacctcatctccagtgctgcgcgctttcacgccaacgtggatgcacgcgcgtatggtcgccgctccaacctgcagctgcaggaggaggaagcagcaactaccgcggggcgtgt

SEQ ID NO: 3616 - DNA, 106 bp, Zea mays
  Clone ID: LIB3228-017-P1-K1-D8
agcaaattaaagagggatcggattggaactcgttcggaaggaaggtcctgcaggccggttggtcggtcgtcgatcgagtaactaagctgctgctgttgttacctta

SEQ ID NO: 3617 - DNA, 82 bp, Zea mays
  Clone ID: LIB3228-017-P1-K1-D9
aaaaaaaaaaaaaaaaaaaaaaaaaaaaaaaaaaaaaaaaaaggaaaaaaaaaaaaaaaaaaaaaaaaaaaaaaaaaaaaaa

SEQ ID NO: 3618 - DNA, 390 bp, Zea mays
  Clone ID: LIB3228-017-P1-K1-E1
tcgctccacttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgct

SEQ ID NO: 3619 - DNA, 382 bp, Zea mays
  Clone ID: LIB3228-017-P1-K1-E10
aaccaaccgaccgattaacccaccaccgcctcgcctcgtctccgctctcttcctcggacaaagccggggccgttcggcgggaggcaggggacgcacgggcaggcagccatgaacggcatcaaccccaacggcgggttcctgtcgtacgggaacatggagagctacgcgatgtgggtggcgaccggcgtggcgtcggccttcttcgcgtccctcgagcgctgctcctgcatccacctccacaccgcggaggacgacggcgtcgaggaggaggaggacctcgaggaggcccgccgctccttctcccgcccgatccctgagtactactacgaccggtccggctcctccgcctccgtcgccaagatgtgacctgaccgaaccgcgc

SEQ ID NO: 3620 - DNA, 396 bp, Zea mays
  Clone ID: LIB3228-017-P1-K1-E11
ctctctcccttcgtcaccatcacatccagccagccaacaaaaatgtcgcgcgtcacagctgcggtgctcttctacatcctcgccgttgctgccctcagcgcggccgaggccccggcagagtcaccgaaggaaggcagtgctgccaaggcacctgagtctgccaagagaactgctgcccccgctgaagcacccgaagccgcatccacccccgtcgccgccgctgccccatcgccgtcgtctaggaagtctggtccagctaccgcgccagccaccgcctctacacccccttcttccacggacgaggagttgagcccttccccgccagcatccaccgccgcggcgtcccctgcggctgagggaccggctgctgatgactccgccggtgctgctgccctt

SEQ ID NO: 3621 - DNA, 394 bp, Zea mays
  Clone ID: LIB3228-017-P1-K1-E12
cacacacacaaaagcaaaaagcatcatcacaataatggcccgcgcgtgtgtgttcctcgtggtgctcctcctggccgccgtcgcggtggcgccgtttgcgggggctgcgcgtgtggatgtcgtggagggcaggtccatggcgtccgccgacgcgcctgaggcggcggctgacgcgcccgctcccggtcccgactccgcctcatccccggactcgccgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatatataaatatgtgcatcaaatgcgtgcggcaaa

SEQ ID NO: 3622 - DNA, 398 bp, Zea mays
  Clone ID: LIB3228-017-P1-K1-E3
cgtcgttcgttcctcaagtgatcttaatcgtcgagaagttaccagctagcggagatcatcggcaatgtcgaacatggggcaatccttccaggccggcaaggcgcaggcccagggcgagtgccaggcggagcgcgcagagaactgctttagggacggcgccggcgccaccgcctgcgccgtgaccgacaccgccggagccgcggccgacagcgcgcagctgcaggagcaccgcgccgccggcaccgttcagcaggctgctgagcaggtggcgcatacggcggcgggcgcggcggcagccgtcaaggacacggtggcggtcgcggcggcggccgtcaaggacacggtggcgggcgcggcggcaggcgccaatgacgcggtgaccggcggccactgaccga

SEQ ID NO: 3623 - DNA, 397 bp, Zea mays
  unsure (1)..(397): unsure at all n locations; Clone ID: LIB3228-017-P1-K1-E4
cccacgcgtccgacgacatcccgggctacgtggacctgctggtgggccacgccgaggagttcctccgcgagctggtcgtcagctccaggggcgccaggaggatcggcttcgtggggatgccgccggtgggctgcgtgccgtcgcagcgcacgctcgggggcggcctcgccaccagggcctgcgagcccaagcgaaacgaggcggcgctgctgtacaacgccagggcccaggagatgatcgccgccttcaacaccaacaccaacgccgacgccgacgtgctggtcgtcttcctcgacatctaccgcatcctggaccacctcatggagcgcggngaggagtacggcttctccgagaccaccaggggatgcttgcggcaccggcaccatcgaggtcacgg

SEQ ID NO: 3624 - DNA, 234 bp, Zea mays
  Clone ID: LIB3228-017-P1-K1-E5
taaaaaaaaaaaaaaaaaaaaaaaaactacaaacataaaaaaaaaaaaaaaaatcacgtacggggacaaagacactttcgttttgtagaaggcaagcgacgcacgggcctgcagtcatgatcccaatttaccccaacggggggttcctgtcgtaccggaagggtggggagcttctagatgtgtgttgtttacccccgtggcgttgggcttctttttttttctttgggggcgcct

SEQ ID NO: 3625 - DNA, 396 bp, Zea mays
  Clone ID: LIB3228-017-P1-K1-E6
gagcagttcgaccccagcatgaacccgtcctacgccagggggctgcaggacgtgtgcagggactacctcaaggaccccaccatcgccgcgttcaacgacatcatgacgcccggcaagttcgacaacatgtacttcgtcaacctcgagcgcgggctccgtctgctcagcaccgacgaggagctgtggacggacccacgcaccaagcccctggtgcagctctatgcatccaacgccacagccttcttcgacgacttcggccgcgccatggagaagctcagcttgttcggcgtcaagaccggcgccgacggcgaggtcaggcggcgctgcgacgcctacaacagcggccccgccgtcgccgccaccatacccaagatgtgacgacgctgcgcgtggtac

SEQ ID NO: 3626 - DNA, 385 bp, Zea mays
  Clone ID: LIB3228-017-P1-K1-E7
cccacgcgtccgaaacaatactgatggcccaaaacaagatgattgtggtggttctcctccttgccacctttcttgtggtggctagatcgttgtgggttccagaagaaccatcaaatgcggatgacataagaggtgcttgcatcgaggagtgcaccaaagaaaataaggctcctggcgacaagaagacatgcgaagtgttgtgcaccaagctcacaaaaaagcctagcgaagaaggcaaacatgattgatgaagtagcactccgataatatataccctagtggatgagtggtcatctttgtagccatgtctgccacacgatggccttgattatattggcttattgttttgtttttggtttccactagtatcctaattccttgtcat

SEQ ID NO: 3627 - DNA, 302 bp, Zea mays
  Clone ID: LIB3228-017-P1-K1-E9
ggagcacagagctagctagccagccagccagcagccagcttgctcgccgcgcccgtccttcttcctcgcctccgttccgttccgttccgtcccgcccgccgccgccgccgcattcagggatggagatgaagaagatcgcctgcgccgtcctcgtcgccgcctcggcggccaccgtggcgctcgccgcggaggctccggctccgggccccaccagcggctcctccgccgtcgcgcccgccgtcggcgccgccctcggggccgccgtcgcctccttcttcgcctactacattcagggagccggc

SEQ ID NO: 3628 - DNA, 272 bp, Zea mays
  Clone ID: LIB3228-017-P1-K1-F10
cacacacgcctggactggacctgctgggtggcttggtttggttggttggtgacgagtcgtaataagttgtgggcgcatgggcgccgcgctcgtgagtggcgtgcgccacgatgcatgcgtgtatggtgatgaactgaattggagccgtgcagcaagtcgaataatcgggagccacctcgcgtgatgtgtagtggctagtttttgtacatggacgtgttggatcttgatccatgttttgatctgatctttgagaaatggtaatccgcgttttc

SEQ ID NO: 3629 - DNA, 386 bp, Zea mays
  Clone ID: LIB3228-017-P1-K1-F12
ctccgttgtcgtcgtgttcgttaccgttctcttcaagatcctgtttggaggcaagaagccggtggcacctgtgaaacctgcagctgaggcgaagaagcccaaggccacagtgaccgacggtgctggaagcagtggcgacaaggatgagaaagaggacgaaaaggaggagacagcaggcccacgtcggaggacccgaagggagacatagagacctatttttgatgtgtttggatgttctggcgcctgcttattttgaggactcttaatatttctgagtgtataataggaacttgtgtcacccctgcggcttccctgctgcttatttgtttttacatggttagaccaggaaccttcacgagccgtagaatttagttcttggtggtcat

SEQ ID NO: 3630 - DNA, 272 bp, Zea mays
  Clone ID: LIB3228-017-P1-K1-F2
cccacgcgtccgctagcgtaatggttaaggcttccgagtagcacctccaggtcctgggttcgatccccctcgggggcgagtttctggtttggttaaaaaaatatcctctctgtgcctcgcccgctcccggtttagcgcgccacctccggctggaccgttgcagagttggcggtgacggcccgttagtgatagggggaccaggttcggggattttctctcttcttaatatattaccgggagggcggtctttccctccacgatcgagttttttt

SEQ ID NO: 3631 - DNA, 165 bp, Zea mays
  Clone ID: LIB3228-017-P1-K1-F5
catgggctccgcgctcgtgagttgcgtgcgccacgatgcatgcgtgtattgtgatgaactgaattggagccgtgcagtaagtcgaataatttggagccaccttacgtgatgtgttgtggctagattttgttcatggacgtgttggatcttgaatcattgtttgat

SEQ ID NO: 3632 - DNA, 399 bp, Zea mays
  Clone ID: LIB3228-017-P1-K1-F6
cggacgcgtgggccctcgtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtacatcgcgggcgccaaggtgaggctggagtgcaagcacttcggcaccggcaagctcgagcgcgccatcgacggtgtcaccgacgcgaccggcacctacacgatcga

SEQ ID NO: 3633 - DNA, 385 bp, Zea mays
  Clone ID: LIB3228-017-P1-K1-F8
atagaagccagcgccaaggaatacatggaaacctacagggctgatcttgacaagaggattgctgaaaaggaaagattggaggaagagcgcaggaaggagaatatggaaaaattgcagaaagatatgatgaaatccaaaggacaaactgtggtgctcaccactggtttgaaggaaaaaaaatctgtttcagacatgatggatggtgctgatgaggaggaagaagaggaagcattggaagattttgggttttctgaggatgatgaagatgaagacgaaagagaagatgaggaggtggctcattttggcttttgaggggatccaatagttacttgttggtgtgtcttacagagagtccatatggggggctacttgcttgagtggaatg

SEQ ID NO: 3634 - DNA, 275 bp, Zea mays
  Clone ID: LIB3228-017-P1-K1-F9
gtttcaagtcctacaacaccaggaggctccgtttcaagtcctacaacaccaggaggctttatgagatgatgttcatgctgctgtgaaatataatgtaatgtacacaaggatatcttcgacttctcgggagaaattgtacagtacacaaggtcctctaacataccacgggagaaatagttgggaaaaaaaatagagggcaaatctccacaagatccaaatgttgtacatctggtgttatatcagttgtcctgatcaggtgtaatgataagtttttc

SEQ ID NO: 3635 - DNA, 380 bp, Zea mays
  Clone ID: LIB3228-017-P1-K1-G1
cggacgcgtgggcggacgcgtgggaagactgacagcgacgatgatgccacagctgcgtagcctcgtcgcgctggtcctcgtggccacggccatagccgccgctcccggcgttgggtttgtcgtcaccggccgcatctactgcgacaactgccgcgccgggttcgagacaaacgtgtcccacgccatccaaggcgcgacggtggagatggagtgccgccacttcgagtcgcagcaggtccacgacaaggcggaggcgacgacgggccccggcggctggtacaggatggagatcagcggcgaccaccaggacgagatctgcgacgtgcgcctgctcaagagccccgaggcggactgcgccgagatcgaccactcccgcgacc

SEQ ID NO: 3636 - DNA, 395 bp, Zea mays
  Clone ID: LIB3228-017-P1-K1-G10
gcagcagcatccatcgcgtgcgtacattaatctaagcgatcttcatccagccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctcacttcgccggcgatgatggatggtgcccaactgcgactgcccagtctgctccattcgt

SEQ ID NO: 3637 - DNA, 317 bp, Zea mays
  Clone ID: LIB3228-017-P1-K1-G11
tcctccggatgaagcaaacgcaaacaagaagcataccagcactggcccgagcctgcgtcttcctcgtcgcgctcctactaaccgccgacgggatggcgcctttcgcgggcgccgcgcgcattgacgttgtttagggcaggtccatggcgttcgcggacgcaccggaggctgccggcgtctctgccgctcctgctactggacccgacttttactcgacccgcgtgccgggaccctccagcagcatatcttccgactagccgaccggcatgagatatctacggacgacgatcagtctgtgacgccacctattacctatc

SEQ ID NO: 3638 - DNA, 276 bp, Zea mays
  Clone ID: LIB3228-017-P1-K1-G2
catgcatgcatgtatgcatgcgccggggtgacgtggcgttcagctcaggcgctgagcgagtctatacgtacgtcgtcaccggctggccacgcatgcgataaccatctgatatggacggaactatatattgtattcctattaatctggcattttctaagctaattgttttttttccaaatataccgtcgatggaactccaaatgtaatgtcacgcaaatgtgtgtttttcatcgattgaatggataataataaaaaggcatgctggcagttactact

SEQ ID NO: 3639 - DNA, 369 bp, Zea mays
  Clone ID: LIB3228-017-P1-K1-G4
ggaatctttcctgctctatagtgattattccatacatggtttacccaagggaccatgctacctatggaggctttcttgcgtggatgtttgcccctgttcataagcaatgttctctgtacttgtcaatttacttgatgacagattttgggattctaagtgtacacatgaagtatgttggcagtgaacataaaacctgattgaccacctgcagtctgcctgcttgtgatagaaataaagatgtggttgacaatattttttcaattttctgtacgaggggtagaaagtttttcatagatggtctattatgtcccatgggcaaccctaaatatgtgaaaggaagaatcccaacttgaaactgagaggattgct

SEQ ID NO: 3640 - DNA, 170 bp, Zea mays
  Clone ID: LIB3228-017-P1-K1-G6
tgccaaggctgagaacgacaagtatggcccgtccatcgtgcacagaaaatgcctgttattctttgggcccaaaagatgcaaaaccataagggggcctttttttcaggctcccgcccccgattttttttctttttggagatggtcttttataagcatgaccaaaatttttt

SEQ ID NO: 3641 - DNA, 258 bp, Zea mays
  Clone ID: LIB3228-017-P1-K1-G8
tagctcgtgagtgggcgacctgattcgacacatgaacattacgaactaaatgaacaaactgattaaagcatgcatagtgtgatgaaagcatgcaaagagagttgtgtttattgaccggaagtgtttgtgagaataaatttgtcttatctgatagtctaaaacctattatctaatgaatccgactggtggacatcaacaaaattttaacgcacatgctatttttacagttttggatttggtaataaaaaaaaaggatac

SEQ ID NO: 3642 - DNA, 395 bp, Zea mays
  Clone ID: LIB3228-017-P1-K1-G9
aaataattcttcagcagaagaagacaagaatgcaaagccagataatagcaagcgtggagatccaaatgatccacgcgttagattgaagcgggactgtgttggtttactcgcggctttcaagcttagtgatccttgtgatcaaattttgattgtggcaaacacacatatttattgggacccacaatggatcgatgtaaagttggctcaggcaaaatatcttctttcgagagtatctcagtttgagcaactcatctcaaataaatataattgtaaaccttcagtgatcattgctggtgacttcaattcgacacctggtgacaaggtatacaattaccttttatctgccaacctaggatctacggacgaagctccaatcaagttacgcagcctttatg

SEQ ID NO: 3643 - DNA, 403 bp, Zea mays
  Clone ID: LIB3228-017-P1-K1-H10
cccccgcgtacggagaataaatagatcgtgaatccctgacgcgtgcatatatatattcctgccaagataaaggtaatggagtcgtcacgcaggttccagccggccgtcatcctgcttctcctgctcattgtgtccaccgatatggcacaggcaagggaatgcgagaagtacagtgagcgatttgttggggcatgcatgatcgcagacaactgcgccaatgtgtgccgcggtgagggcttcttggccggcaggtgcagcaccttccgccgacgctgcatctgcactaggcagtgctaaacaagatcgctcgatcgctcgccatgcatcgacaacctattcttaataacggtcattatctcgttcttatttatgacgaatgtcatgtatgttctggtgactgtca

SEQ ID NO: 3644 - DNA, 288 bp, Zea mays
  Clone ID: LIB3228-017-P1-K1-H11
tcgaggattacgcggacggccgataagcacataacaggtcagccagctccaggctctccatctttgtatagctgcgcaccctcgaagagagatccggcgcggaccaataaacacccgggtgactacagactcgcagatggccggccttaggatgaacagccatttgactggattaagaaaactttctttgagaaaccccaaccagaggcataaaaggcttgcaagtgtgtaactttggtgacttcacttttatccggtgttcttttttctgagacgaaggtagattaa

SEQ ID NO: 3645 - DNA, 335 bp, Zea mays
  Clone ID: LIB3228-017-P1-K1-H2
cccgcgtccgtggttttccatttgtttgaaaaaaaaaaaaaacaaaaaaaataaaaaaaaaaaaaaaaaataaaaaaaaaaaaaaaaaaatataaaataataataaatatttaaaattatattaaaatatttaaaaataaattattctatataaatattatttatggggggggcctttttttggtttcaaatttttcttcctggggctggcgttgatttttttttttttttgtgcatttataatattttttattggccgttttttaaaacctttgagattggtaaaacctggggattcccaaatttatgttttttggggaaacattccttttttt

SEQ ID NO: 3646 - DNA, 234 bp, Zea mays
  unsure (1)..(234): unsure at all n locations; Clone ID: LIB3228-017-P1-K1-H4
tctagatttatatagatgatatatgcaagcatgtgctgataaataatgttaaactgggcctacgatgttaccggtttttcagcctgtgcacatcttgttatgacatgatgctaattttgcaaaagcacagtaagaaaatttacagaacgtcagaaaatatcaatcatgttttagaagatgtgtaacagtatagtatgccttaagaaaagatgaattttgcctcttgcgnaaaaa

SEQ ID NO: 3647 - DNA, 173 bp, Zea mays
  Clone ID: LIB3228-017-P1-K1-H5
gagccacgccccacgacgtgcgtggacgcgcggaacacagacagtcaaccaggcgcatgggcgccatatctgtagaggtcgagacccttgaagagagaggccgcgcagaccaagaaaatacatgctgactacatgacagcagatatggcggcaaaggaagataccgggatcgg

SEQ ID NO: 3648 - DNA, 407 bp, Zea mays
  Clone ID: LIB3228-017-P1-K1-H6
agattagcggcggcgatggcactcccggcgtcgagctccggcctcttccgcttcgtctccccgcgcagccgcccccagtccaccgacatcgtggctgccgcctcctggggagtcttcgccggcaccgccggcctctacctcgtccagccatttgactggattaagaaaactttcttcgagaaaccccaaccagaggcataaaaggcttgcaagtctgcaactttggtacttcacttttatccgggatggttcctgactgaagagaacttggataactcagcaaataatacgagaccccctcgtgtttccttgtttgtttttttattattcagatgtaggcaatccccacgagggagacagggaacagagaaactgtttggttcacctgtgtctatataatactcctg

SEQ ID NO: 3649 - DNA, 366 bp, Zea mays
  Clone ID: LIB3228-017-P1-K1-H7
aaccaaaccgacgatggcgtcgaataagacggtactcatcgtcgcggcgatgcttctcatcacgctcgtgctggaggccgcccctgcggcgaccgccatggactgcaaggccggatgtgacgaggtcacggccccactccacatgagcatggaggactgcatgaagaggtgcaaggagatcgctgctaagcaggggcctagggacccttacaaggataacaaacttgacatcccatgaactaattaatgctcctatatcatctggctatccatgcatgcatcgcattgcgtatgcacactgtgcgtgcctgcccacaaagttcgacaacacaccgatctcgacggatttgtaatcgtgtccactcg

SEQ ID NO: 3650 - DNA, 392 bp, Zea mays
  Clone ID: LIB3228-017-P1-K1-H8
gccacaggcaaggcacagaggcttgtgagggagagcgaggagcggaggaggacatggtgcacgggacgctggaggtgctgctcgttggggccaagggcctcgagaacaccgattacctctgtaacatggatccgtatgcaattctcaagtgccgttcacaggagcagaagagcagtattgcaactggaaaaggaactacccctgagtggaatgaaaactttatcttcactgtgtctgaccggacaacagacttggtaatcaagattatggacagtgatacaggcacagcagatgactttgttggtgaagcaacgattccattggaagcagtgtatactgaaaggagcattccaccaacactctataatgttgtgaaaggtgaaaaatactgc

SEQ ID NO: 3651 - DNA, 388 bp, Zea mays
  Clone ID: LIB3228-017-P1-K1-H9
cagacctgaagtgttgggagcagaaattggaggaagcgaatgaacttggacagacagttgtggtaaagttcagtgcgacttggtgtggaccatgcaggaacgctgctccactatacgccgagctttccttgaagcattctgatcttgttttcttctccattgacgtcgacgaactgccggaattggtcacgcaattcgatgtacgcgcaactccaacgttcatcttcatgagagacatgaaggagatcgacaagctggtcgggggcaaccaggaagaactccagaagaagttcgatccgtactgccagtgacagtagaagcgatccatggccggattcgtctgtcagtataggatcagaacgagcatggccaaacatctgattggctg

SEQ ID NO: 3652 - DNA, 61 bp, Zea mays
  Clone ID: LIB3228-018-P1-K1-A1
agctgtctctaaatttcacggcaagtcgtgtgcctgaaccttcatcttaagttgttgtcgt

SEQ ID NO: 3653 - DNA, 408 bp, Zea mays
  Clone ID: LIB3228-018-P1-K1-A12
cccacgcgtccgtttttggcaactgaataatagatgcatagaaaactttatatcgagagcccggaatacaagcaaaattgggtacacgatagtaaaaatcttatatcagaacttgataacttgcgtaccattgtaatcacttaatctgatcatacttcaaactaccgtaagcaagtacaaaatcgtcgtcgaattaaccactatgaactcaacgcgaccccagaaacagagattgagaattgagattcaattctcaagtccaggcacctgcatgcgccggctggcctccgacttcttgccgccgaagaactcgtcggggacgaccttgagctgcttgcgcttcttggacttggcgatcttctggatcgtctttgggttggtgacccagtgcagcttggtgcccgtgcg

SEQ ID NO: 3654 - DNA, 346 bp, Zea mays
  Clone ID: LIB3228-018-P1-K1-A2
ccgcgttcaggtgtcccgccccgcccgcgtcggaacgaagagagcttgccccgtcgggcagtcgcggctcgcgagtcggaggagatggaggaggacggcggcgggaggaagcaggacacgacggcggcggcgtccaaggcgcagcgagaggccgcggcggccggcgtctccgtgcacgagtggctgcagcacgtgaaggcctccttcctcggcctggtgggcaaggtgacggcgaggagcgagcaggaggcggcggaggcggacatgcgcgcggccaaggcgcatgtggaggcgaccaacgaggcgtgggccaagaagaagcggctcgcagatggatgatgaacca

SEQ ID NO: 3655 - DNA, 426 bp, Zea mays
  Clone ID: LIB3228-018-P1-K1-A3
cgcggtgatggcgcgtacggggcttcccgcgcgcgatctcagggtgctcgacccgttactctcgtacccgtccacgatcctgggccgcgagcgcgccatcgtcgttaacttggagcgcgtcaaagctctgatcacagccgcggaggtgctgcttcctaacaccaaggatcccgccttcgcgcgcttcgttcgcgacctccagacccgcgtcctcgcatcttcgtctgaccaggcagctgaactcactgacatggaaggtgaatcacctattgttgcttcaccatttcctgtaccaagttcatccaaagggcatgaaatggagatgactaagaagactgctgctgttgtgcctgaaatgactagcagcagcagtatgcccaatttagctgttgcaaaagatggaaataccaaggttttgcctttcga

SEQ ID NO: 3656 - DNA, 422 bp, Zea mays
  Clone ID: LIB3228-018-P1-K1-A7
cccacgcgtccggccttcgtcccgtccaactcctacggcatggcctcgaggaaggtgaggatggttcccgagatgagaccccagatggcgcctctgtccaccgttatcactgtcaccctcggttcaacacgacgggctcatcgaccatgctcccggccatcgccttcgtgctgcatgtgttgcatggacgccttgatgagtagctcaccgttgccgcctttgaccaagcacacacccaattgatcgattaatgaactagatactcattgaggccacgaatgaaagaattatcatcaaaccaacaaatgacggacacaattttcaatcgattatggatgagtgtgagtagtgatgagctgaggaagatgcaatgatagatcgattgtgtacatatataggcactgcgtacgtgctgccccttt

SEQ ID NO: 3657 - DNA, 324 bp, Zea mays
  Clone ID: LIB3228-018-P1-K1-A8
gcgtcgctctctctttctggtccaagtgatcttgccaagttactagcagcgagcagagatcagatcatccatatgcaatgtcaaacatcgggcattccttccaggccggcaaggctgatgcccatggcagagtaccatgcgtagcacgtcttgcagtgcatcaaggacaccgccgaagccgtggtcgacagtgcgcatatgcagcagcaccgtcccaccgtcaccgttgagcaagtggtgcaaacgggtcaaggcgtggcggctggcgtcaaggacacagtggcagtcgcggcggttgacgtcacaaacaccgtggtaagctgt

SEQ ID NO: 3658 - DNA, 179 bp, Zea mays
  Clone ID: LIB3228-018-P1-K1-A9
gcaatggcgggagcttttttttttttttgataatggaagaaacgtgttccagccttttgcatcatatcaaggatgcatatggcttcatagcatattcaacctgacaaaagcagcaacaagtagcaatgaagcacatggttctcatgaacaataataagaaactaagaggcctcaatcct

SEQ ID NO: 3659 - DNA, 405 bp, Zea mays
  Clone ID: LIB3228-018-P1-K1-B10
cctggagcaacgacgcctcggcgctctgctacaactgccagtcgtgcaaggccggcgtggtggccaccttccagctgaactggaagcgcgtcgccgtcgtctgcatcgccttcctcgtcttcatcatcatcgtctactccgtcggctgctgcgccttcaggaacaaccgcagagacaacgcctaccgcggcgggtggaagggctggtacgcttgatccaccatcgcgtcgtttaggagcggagccatgcacgcgcgctcggtgctctgctgtatgatccctgcccgccactgtcagagtacgtacatgtttagtatgctagatgttagctctgtacaggtgatggagatcgcttgtgcggattcttatcggcttcctggatacattattgctatgatctgatcag

SEQ ID NO: 3660 - DNA, 229 bp, Zea mays
  Clone ID: LIB3228-018-P1-K1-B11
tttggcacaggatcgaatgtcacatctttactatataataggagttctatacaaaataaataaataattcatcattaggaaacgatccacaacccaaagttgctgggggacgacggcctaaccactcacgaactcatcacagcatcctcacgcgccttatcctgtggacctgttcttgactgtggggggtgtgagacagcaagagtgagctcacatacgtttatcgctc

SEQ ID NO: 3661 - DNA, 279 bp, Zea mays
  Clone ID: LIB3228-018-P1-K1-B12
aaaaaaaaaaaaaaaaaaaaaaaaaaaaaaaaaaaaaaaagggcaagacgaaataagagaaaacaaaattacaaacacataaatgcagggggcgtaccttttttatgatccaatcttacgttcccttccctggccggtgatttacttcgtttagagtgacaaaactccagattattgccatgttattaacatcgcagatcctggcaataccctggcttgacgtattttataagaggcgcggtacatccgcttttcccaacgtttgcttaatactgaatg

SEQ ID NO: 3662 - DNA, 390 bp, Zea mays
  Clone ID: LIB3228-018-P1-K1-B2
caggaggctagcgccgaggaggcggaggaggaagtggtgagactgtcaccggagctggcgactcacggcgccatcgacccggtgacgctgtcgtcgtcgacatcgaagcggcgcctgtccatcagcgtgagcaagaagctgagcatgaacatcccggacaagctgcggctgagccggcgggagcacaaggaccaccaccacatggtggagtcggaggacacgctgtggaagaagggcttcatccttggggagaagtgcaggatcccaagcgagagggaggcgtagaccgtgtagcccgtcgaccccgtctgtgagatcgccgtcggcagcttccgtcggttcagatacttccggaccgtgtcgtggtcaagctcattcgccgtgttccac

SEQ ID NO: 3663 - DNA, 428 bp, Zea mays
  Clone ID: LIB3228-018-P1-K1-B3
acggcgcctccaaggtcaccgtcaaggatgtcaccttcaagaacatcaccggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataatttttctctcgtccttgcattgcccattagatgctatccattggtaacgcacaacagtaaaacgacagacatccgacagctatattatgttcgacggtgtaacaccctgaatttgagggtataaaatttcttctccaaataccaaccaaattcaggggttacc

SEQ ID NO: 3664 - DNA, 404 bp, Zea mays
  Clone ID: LIB3228-018-P1-K1-B5
aaccggagcttctgttgttaagggccctacggagaaggagcaaatcgacgtacaaggggacatctcatatgatattgtggagttcattacagatacatggcctgatgtacctgagtcggccattttcttcattgaagatggaaggaaggttcctgctgcttgatgccatatggtttataaggcacgagaccaggcatatagggccataccagctcgtctcttgtccgaagtcatgaactgttgttccggtttttaggcctacttcacaagtggcatttttttttaccaccgtcacctgcttccatgtatgaaatcaaatctatacagttaccaatttactatgactgatgtctgttgtatcacttccaaaagtctggacactgtgtgtgaaaaataagatcatc

SEQ ID NO: 3665 - DNA, 425 bp, Zea mays
  Clone ID: LIB3228-018-P1-K1-B7
cccacgcgtccgaccgcatccaggtgtccaacaccaagaagcccctcttcttctacgtaaacctcgccaagaggtatatgcagcagcacggcgatgtggagctatccgctcttggaatggccatagcgacagttgtgaccgtggcagaaattctgaagaataatggatttgctgttgaaaagagacatctactgttgacataaacgacgaatcacgagggcgtccattccaaaaggccaagattgagataatcttgggaaagagtgacagattcgatgagttgatggctgctgctgccgaagagaggggagaagttgaagaaggcgaagagcaggcttgaaagaaaaaaaaaacagtaccgacgacaagcggctgttgttgtggtctgttagttttgcttaatttaatgccatgcgcatgagagc

SEQ ID NO: 3666 - DNA, 166 bp, Zea mays
  Clone ID: LIB3228-018-P1-K1-B8
cggacgcgtgggcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggcgtcacgcc

SEQ ID NO: 3667 - DNA, 406 bp, Zea mays
  Clone ID: LIB3228-018-P1-K1-B9
cccacgcgtccggccaaggctccccaaagatagcatagcagcagcactcacaatagcaaaaaccaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaattttc

SEQ ID NO: 3668 - DNA, 311 bp, Zea mays
  Clone ID: LIB3228-018-P1-K1-C1
cggacgcgtgggcgggcgtggcggcgggcgtcacgaacacggtcacgggcgccgtggcgggcgtcacgaacacggtgaccggcgcggcggcgggtgtcaaggacaccgtgaccggcggccactgatcgacgacccaagaatgcttcatgcatggccaagtgttgagggtttgaggccaaagatggcttgaatttccgtccttttttgctttattttttgacattattgttttaacatgtttcattcacccgtctctgattgggattgtgatcacgaccgcctgcaataaaaaaggccatctttactaaaaa

SEQ ID NO: 3669 - DNA, 412 bp, Zea mays
  Clone ID: LIB3228-018-P1-K1-C10
cccacgcgtccgcaatgcctctgatgtgtgctggattcaccgtatatatgcccatgatttggcacagcatgaaccaacagagtaaatcacttagcgtagtcgtaattggactgggtggattgggccacatggacttcaaatttgggaaggcattttggttgaaggtcaccgtttttagacgagtgaatcgaagagagctcaagccattaatctcctcagataattttgtcatatcatttgacgagaaacagatggaggccctaaaaagctccctgcacttcattattgacactgttgtgggtaaccacccgttcgatccctacctatcgcttctgaaagctggtggtatattgacgatggttggctttccaagtgaattcaacgtgcatccttggaggtggaggaaccaatg

SEQ ID NO: 3670 - DNA, 424 bp, Zea mays
  Clone ID: LIB3228-018-P1-K1-C11
gcgacccacgcgttcgaggacgcgtgggcttaattgcgccactgctcgttatcctcctcttgcattgcatggcaggtcgtagttgagcagcagcaaccactgtacaggatgtcgtggcagacgtacgtcgatgagcacctcatgtgcgagatcgagggccaccacctgagctctgccgccattagtcggccacgacggcgccgtttgggcccagagcaccgcattcccacagttcaagccagaggagatgaccaacatcattaaggactttcacgagcctgggtttctgtccccgatcggccttttccttggccccaccaagttcatggtccattcaaggcgagcccggcgctgtcatccgggggaagaaaggatctgggggcataaccgtgaagaagaccggacaggcgctggtgatcggcat

SEQ ID NO: 3671 - DNA, 342 bp, Zea mays
  Clone ID: LIB3228-018-P1-K1-C12
cccacgcgtccgcggacgcgtgggtgctgaccctgatcgtgtatagcacggcgctgctgctgatgacgggggtgacgctgacaggcgccggagcggcgctcgtcttcccgggccccatcacgcttctgaccaccaccatatggctgccatatgcaacaccgatctccgccatcagggcctccacgctgttaacatgcgcctcatgcggcagggcaactgcgtgtagccacctgtatagaccgttactttacgggccgtcaccccgtgcgcccggaccggttgagactactcacgcaggcggatctgcggacaccgccagagcactgaaggactacgcgcgcg

SEQ ID NO: 3672 - DNA, 425 bp, Zea mays
  Clone ID: LIB3228-018-P1-K1-C2
gccggatgcatgccggcagctagtttcttctctgtccctaattccccactccaagtgtttgtctggtcagtagttgctcttgcggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggtgacgcagacagctccttggacaggctgtggcaaaagaagaaggctgatatcaagcagtagattttacatctagtttaccaagaattggacaccgccttagctatgttttgaattcatgtcactatatgcaatgg

SEQ ID NO: 3673 - DNA, 96 bp, Zea mays
  Clone ID: LIB3228-018-P1-K1-C4
tgagatcaaataagacaaagctgctgtgccttgttgtgtaaaaaaaaaacaaaatagagaagataaaataaaagatatttaataaaaaagctatat

SEQ ID NO: 3674 - DNA, 417 bp, Zea mays
  Clone ID: LIB3228-018-P1-K1-C5
acaaaatggtgtcctgcgcctggatgtgaatacgcagtggaattcgtcatgggcagtggcagctatgatgttaattgcaactgttcatatgggttttgttggaattgcaccgaggaagctcatcgtccagtagactgtgccactgtttcgaagtggatcctcaagaacagtgcagagtcagagaatatgaattggatactggctaattcaaagccttgtcccaaatgcaaacggcctattgaaaaaaatcagggatgcatgcacatcacatgcactccaccatgcaaatttgagttctgctggctatgtcttggtccatggtcagagcatggagagaggactggtggattttatgcttgtaaccgctatgagtcagcaaggcaagaaggagcgtatgatgaatctgaaaggagaaga

SEQ ID NO: 3675 - DNA, 413 bp, Zea mays
  Clone ID: LIB3228-018-P1-K1-C7
aaccggagcttctgttgttaagggccctacggagaaggagcaaatcgacgtacaaggggacatctcatatgatattgtggagttcattacagatacatggcctgatgtacctgagtcggccattttcttcattgaagatggaaggaaggttcctgctgcttgatgccatatggtttataaggcacgagaccaggcatatagggccataccagctcgtctcttgtccgaagtcatgaactgttgttccggtttttaggcctacttcacaagtggcatttttttttaccaccgtcacctgcttccatgtatgaaatcaaatctatacagttaccaatttactatgactgatgtctgttgtatcacttccaaaagtctggacactgtgtgtgaaaaataagatcatcggttaggct

SEQ ID NO: 3676 - DNA, 400 bp, Zea mays
  Clone ID: LIB3228-018-P1-K1-C8
atcgacagaaacgctcctgttcctgttcagctgcaccacacgatcggtttgcttggatcgtgttcagggacctactggacatgacctactcgtccttctccagtgaccggccggacgcggacggcggtggcgcgaaaaacccgccggggccgtcgccgtcgccgtcggtggaggacgcgatgagcttcgtgcagatggtgaaggaggcgttcaaggagcgacagccggacaagtacggcctcttcctccgcgtcatggaggacttcaggaatcagcggctcgacatcgccgaggtggcgtccaccgccaaggccctgttccaggacaaccctgacctggcgctgaggttcaacgtctttctgcccaagggccaccagatccagctcgggcttgatgagct

SEQ ID NO: 3677 - DNA, 249 bp, Zea mays
  Clone ID: LIB3228-018-P1-K1-D10
ttgagcatgcatcggtggattgggcgagcctgctcgagagagcaagcttacgtgcggcagccatgtatacaataagattaggatcgcgcagccagagtgcacccaatagaggactgataagcggcgtgagtaagaaactggggttgccagataatggcgcgtatgcatacccctttcggagcacagaatttagccctgagaccactcagtcgtcctttcttacatgtgccagtgctgatattttaaggg

SEQ ID NO: 3678 - DNA, 411 bp, Zea mays
  Clone ID: LIB3228-018-P1-K1-D12
cttgagtctgcagccatgaaagaatattatttcaaggctgatcgtccgaaaacactctctgctggttcttctaatctgaagtatcgaaacccaaaatatttgtccatgctcaatcatctaagattttacctcccacaagtctatcctaagctgaataaaattcttttcctggatgatgatatagttgtccagagggacctaactggactctgggaggttgatcttaatggaaatgtaaatggagccgtggaaacatgtggagagagttttcaccgatttgataagtacctaaatttctcaaacccaaatattgcccagaattttgatcctaatgcatgtggttgggcttatggaatgaacatgtttgatctggaagaatggaagaagaaagacattactggaatttatcac

SEQ ID NO: 3679 - DNA, 393 bp, Zea mays
  Clone ID: LIB3228-018-P1-K1-D2
taccacgcgttcgcgcaacacacggtaccagaaagcatacgcaaacatgaagcaaaccagggatggcccgcgcctgcgtctttctcgtcgtgctcctcctagccgtcgtcgccatggcgccgttcgcgggcgcggcgcgcatcgacgtcgttgagggcaggtccatggcgttcgcggacgcaccggaggccgacgccgacgctcccgctcctgctcctggccccgactcctactcgaccccgtcgccggcaccctccagcagcagctcttccgactagcctgccggcagagatatctacggcgttcgatcaatctttggcgccacctataacctattcggatcctgcaaagctatatatgattctatggtataatgggtggttgcggcaaacg

SEQ ID NO: 3680 - DNA, 421 bp, Zea mays
  Clone ID: LIB3228-018-P1-K1-D3
cacttaacgccgccgcggagctgctccgcgcccccgacgccggtgattaggagcaggagcaagaggggttcggaatggccaagtctaagaaccacacggcgcataaccagtcgttcaaggcgcacaagaacggcatcaagaagcccaagcgccaccgccagacctccaccaaggggatggaccccaagtttctgaggaacttgaggtactcaaggaagggcaataagaagagttgtgaggctgagtcagaggagtgagatgatgcctgagtttgtggcgacaaatgcatctcttgtatcgttagggtcttagttgtgaacttaattttcacatctgtatgattaaaagagattcatcaattggtactgaagtgttgtttttttgtcttgttgcctatctggagtttatttaactaaaatca

SEQ ID NO: 3681 - DNA, 72 bp, Zea mays
  Clone ID: LIB3228-018-P1-K1-D4
aaaaaaaaaaaaaaaaaaaaaaaaaaaaaaaaaaaaaaaaaaaaaaaaaaaaaaaaaaaaaaaaaaaaaaaa

SEQ ID NO: 3682 - DNA, 417 bp, Zea mays
  Clone ID: LIB3228-018-P1-K1-D6
ggacgattggcaagggaactccattcaattatttcacatatggagctgcatttgcagaagttgagatcgacaccctaactggggatttttacacaaggacagctgatattgttatggatctcggattttcaattaatccagcaattgacattggccagattgaaggagcttttatccaaggattgggctgggcagccatagaagagctaaaatggggggatgataaccataagtggattcgacctggacacctcttcacctgcggtcctggttcttacaaaataccctctgtaaatgatatacctctcaatttcaaggtttctctattaaagggtgttccaaatccaaaggctattcattcttccaaagccgtgggagagccaccatttttcctaggttccgccgtcttatttgcga

SEQ ID NO: 3683 - DNA, 389 bp, Zea mays
  Clone ID: LIB3228-018-P1-K1-D7
cccacgcgtccgcggacgcgtgggaagtgatcttgccaagttacgagcagcgagcggagatcagatcatccatcggcaatgtcgaacatcgggcagtccttccaggccggcaaggctgaggcccagggcgagtaccaggcggagcacgcggcgcagtgcgtcaaggacaccgccgcagccgcggccgacagtgcgcagctgcagcagcaccgccccaccggcaccgttgagcaggtggcgcagacgggccagggcgtggcggcaggcgtcaaggacacggtggcgggcgcggcggttggcgtcacgaacacggtggcgggcgtggcggctggcgtcacgaacacggtcacgggcgccgtggcgggcgtcacgaacacggtgaccggcgc

SEQ ID NO: 3684 - DNA, 395 bp, Zea mays
  Clone ID: LIB3228-018-P1-K1-D8
cggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcctttttagaggtccaaagtttacttccccgtgcttgcaacgtaatagtttttttttgggggccccaaatttaatttcattggccgtgtttttaaaacggtttgattggaaaaaccttgggtttcccaaatttaatcgctttgaaaaaattccccttttcccaagttgggtttataacaaaaaggcccgaaccattcgcctttccaaacatttgcccacctttattggatattgggacccccc

SEQ ID NO: 3685 - DNA, 400 bp, Zea mays
  Clone ID: LIB3228-018-P1-K1-D9
cccacgcgtacggccacgcgttcgtaccgaatgtctgacatggacagctctagcagaaatgctggccatatgcgagatcgtctgacgcttacttacaacatgacacgccaagcatgcatcaccacacagcttactgagattatatctgttgcattatcccttgaaggattggtgaagagactatgtggactgttccctttttccccatttgcgttcctctcacatgaacgcttcttttcttccggaggctcagtttcaacccttctcgggtcactcttccttgataaacctattctcatgctctatcgcaataattaggccaacgacagtgatgatgccgagcgcctttgcatatcgcaaaaagaatgctctacatcaaaaaaaaaaaaaaaagggccgc

SEQ ID NO: 3686 - DNA, 306 bp, Zea mays
  Clone ID: LIB3228-018-P1-K1-E1
ggatgctggtgtgtgtgggcgggagcagagcaccggaagagagagcgggtgccgtctgccgtgcgtgcttggagatgataactgtcccagacgatatcgtctgtacggaacgggcggttgtaaatttacctgatattaataattaatctatttatcggcgagtgacgactaataataaaaaaaataaaaaaaaataattaaaaattaaataatataataatattaaatataaataaatacaaaataataaaaatattaaaatgtttaattttataaaataaaaataataatgggggggccgtttta

SEQ ID NO: 3687 - DNA, 373 bp, Zea mays
  Clone ID: LIB3228-018-P1-K1-E12
cgcctgggcagtgcaacatggtggtggaaaggctgggcgactacctgcttgaacagggcatgtaactactacgtaccagctggaatgcatgtcgacgacgatggtttcgagtttcgacttccaataatagtaacaacaaagcaaaggccttcctcccggcgtatttgctttggctcttctcctccacgccataagatatctagcaattggtcactcgccttaattagttcgctttgcttttgaggttgattcgaccattttgctgtagcgtgaattgcatgcatggacatgcaacgctccaatggcctttggaatgtggaatttttttccccattttctgtatttttcctataaaaaatgaactggttcttat

SEQ ID NO: 3688 - DNA, 411 bp, Zea mays
  Clone ID: LIB3228-018-P1-K1-E2
cggacgcgtgggaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaggggggggccgttttaaagaatcaaagtttacttcccgttgcttgcaaagaaataatttttttttagggccacctaaattaaattaactggccggggtttaaaaacgtcgggattggaaaaaccttgggtttaccaaatttaatggctttgaaaaaaatcccctttttgccagttgggttaaaaaaaaaaaggcccgaaccgatggccttttcaaaaatttgcccaacctaattgggaaatggaaccccccttttatcggccatttaagcgcgggg

SEQ ID NO: 3689 - DNA, 418 bp, Zea mays
  Clone ID: LIB3228-018-P1-K1-E4
cggacgcgtgggcggacgcgtgggcgcggaagaaggcgtgtggaagaactgggtgtggcacacggaggacgacctgttcatgaacggcgccatcttcaatccgtccggcggcgcccccaagcaggtcgacaccaacgagtgggtaaagcccaagccaggaacctacgttacaaggctcacccgcttctccggcacactgtcctgctgcacgggcaagccgtgctgaaggccggtgggcatcaggctgcttcttctagctcatggcctggccatgccaggtcgcgctggctgcgtttcatttcatggaagaaagcaaggatggatcacaggttgtcgttctgctaattaatctacatacgtttgccttcaagtactgtgttgtggcattgttacacatcacagtacagtttggtcaaat

SEQ ID NO: 3690 - DNA, 262 bp, Zea mays
  Clone ID: LIB3228-018-P1-K1-E7
tattttcttattattttatttagctttatattttaaatttttttttttattttttttctttattttattattttgtctgtctttttttttttcttttttcttatttttttttttttttttttttttttttttttttcttttttttgtcttttccttttttttttattctttttttttttttgtttttttttttttttttttcttttttttttttttcttttttttttatattgtctttttctcttttttttttgtttttttt

SEQ ID NO: 3691 - DNA, 374 bp, Zea mays
  Clone ID: LIB3228-018-P1-K1-E8
agacagtctagttttgagacgggatgcatgatatatcaacgtatgcatttgcgtaggactaagctgacatggtgatacacacaggtctgtagcatgcatacaggccgatgaatggaatgcatgctggcttagacatatgtgctcgacaagtcgtaccatagaggggactaactctgactgtgcgtaagacatgggacacagatgtgaaccaaatggatatcacgctgagcgagtttagctaatgaaaaaaaaatagggctgtcaggacatgacgatctatcttacttaggcgctcttgcgaatctatgagtgttgtatagatgaacatatagtcaaataactgaccagcgtgttaaccattagagctgggaaaa

SEQ ID NO: 3692 - DNA, 409 bp, Zea mays
  unsure (1)..(409): unsure at all n locations; Clone ID: LIB3228-018-P1-K1-E9
ccagcaagttagcattctctagaattgccatggaattgtcagtcatgtgagtagttaaccgactcttttgcctgtatgatgaagcctctgttttccgtttaaaataaaaaaggaagcatctgagaggccgcatacttgtgttcccatgaaaccctaccaatctgtaatggccgccaataaaacagtcacacgcaacccatctcgtttccccattttattcgtattctgctacactctttgctgcactcatgttacactgaactctgaactcgcctggtggcatctgacaagttttttgggatgagcagaagataatttgggttcgggcaacgggtaaattataaaatgcttatttgtccttgtctaaaanaaaaaataaattaaataaaaataaattaaaatataaaaa

SEQ ID NO: 3693 - DNA, 414 bp, Zea mays
  Clone ID: LIB3228-018-P1-K1-F10
ttggttggtggcccggcccccctcggtgggttaaaagtatcactggaacgctatgatttgttccatgggcatttttttcttgcatcggagacaggaccggttggaattctctctcctgcgtattccagaaaaagatacacagactagctgagggcacgactactcctaagaaggagctcctgcagcaaaggaatgctctgagcaaagagaaatggcgatgatcagtctgaaggaatgctctgagcaaagggaagcttctgtgtgatgtcgctgctgcctggtgtcttgcctgtggccagggttctgttttgggtcagagtgctgctgcgtttcagtgcgcgtgttcaggaaggatcttggtgttaggcttttggtttcagctatgttgtcgtggtgttctcctcgctaaactgg

SEQ ID NO: 3694 - DNA, 414 bp, Zea mays
  Clone ID: LIB3228-018-P1-K1-F11
cccacgcgtccgtggacgcgtgggctacggcaaggccatggagcagctgaccgccgcaatgggcgcctccgagagctgcgaggacgcgtggaagggcgaggaggaggatgtccccgtcgccgcgcacgacagggagtacggtcggatggcgcacatcgccttcggattcacacaccacgccgccgtcgccgccgccgccgcatgaatcgattaattattatatatatatatgcatgctatctactatgatcgatcgcttctcgaccttcttgcatcgatctgcatgcatattataatttatattatattgatgccacgccgcatgcaggtctttccaaggcgtacgtactatatcaaattattttaatttccttacatgtatatgtatgtgctgctgttggatacgtacgtata

SEQ ID NO: 3695 - DNA, 392 bp, Zea mays
  Clone ID: LIB3228-018-P1-K1-F12
atacgaagatatctatatatgccaaaaatgtcgaggtccttctcctcagattaaattcaaaagacgttcatcgatcagtagtgcctcatgaatcagatcagacacaaaactcagcaaattatttacgtgattccggtcgcaagaaattgaattaatacacgcatccacgtcgcctagttcgctacgccgtggcgagaatgggtgggttggcgtagggtcccctgagccagccatcggcgatgcggtggtacgccgcctcggtgaggtggacgccgtcccagttgacatacgccgacgggttcgggcaggctgccacgccgggcatcccgcacgcggcgctcaggttgaagttgtacttgccgtcgtcaccgccgcagcatacccttagcgcg

SEQ ID NO: 3696 - DNA, 205 bp, Zea mays
  Clone ID: LIB3228-018-P1-K1-F2
gtcgtaacccatggaaattggaaaggggatgaattccgatgtatgtgcccgaacttgattctagggttggtctcgtaagttaatcgggaaaggcgggtgcagacactactgatgagccgtaacgtacccgtcagatcccccagatacaataaaacgagtctgtaatgtggcttttgcatcgtattttctgcatcgtgttaaggag

SEQ ID NO: 3697 - DNA, 416 bp, Zea mays
  Clone ID: LIB3228-018-P1-K1-F3
ggctcaccgaggtggatgtcgtcaagagccccaaccaggtcaagtacctggagcaggtgctcagggaaggcttcgcccaccccaacgtcgacggcatcgtcatgtgggcagcgtggcatgccaggggctgctacgtcatgtgcctcacggacaacagcttcaagaacctccccgtgggcgacctcgtcgacaagctcatcgccgagtggaagacgcaccgcgcgttcgccaccaccgatcacaatggggcggtggagctccacctgcccctaggcgactttaagttcaccgtaagccacccatctttgaaagccgctgctgttcaaaccatgaccgtcgacaattcggcgtcggcgtcccagcataccatcaacgtcaagtcctaggagacgacatcaggcactctgtggcggatc

SEQ ID NO: 3698 - DNA, 238 bp, Zea mays
  Clone ID: LIB3228-018-P1-K1-F4
gtcgaaacccatggaaataggaaaggggatgaataccaatggatgagcccaaacggggggggagggaaggtcatgaaagacaaccaggaaaggcggcagcagacactactgatgagacgaaacgaacccgacagatcccaaagatacaataaaacgagtctgaaatgaggctttagcatcaaaaactatagatagggggaaggagaaaaaaaaaaaaaaagggcgaccgatctaaagg

SEQ ID NO: 3699 - DNA, 419 bp, Zea mays
  Clone ID: LIB3228-018-P1-K1-F6
cctaccccacggtgaacgaggactacctcaaggcggtcgacaaggccaagcgtaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctaccagcttgctggagtcgtggcagtcgaggtaaccggcggacctgatgtccccttccaccctgggaggcaggacaagcctgagcctccaccggaaggccgccttcctgatgccacccaaggttctgatcacctcaggcag

SEQ ID NO: 3700 - DNA, 415 bp, Zea mays
  Clone ID: LIB3228-018-P1-K1-F7
atagaagccagcgccaaggaatacatggaaacctacagggctgatcttgacaagaggattgctgaaaaggaaagattggaggaagagcgcaggaaggagaatatggaaaaattgcagaaagatatgatgaaatccaaaggacaaactgtggtgctcaccactggtttgaaggaaaaaaaatctgtttcagacatgatggatggtgctgatgaggaggaagaagaggaagcattggaagattttgggttttctgaggatgatgaagatgaagacgaaggagaagatgaggaggtggctcattttggcttttgaggggatccaatagttacttgttggtgtgtcttacagagagtccatatggggggctacttgctgaagtggaatgaagaactgtcaatatcagtagggtgttgac

SEQ ID NO: 3701 - DNA, 214 bp, Zea mays
  Clone ID: LIB3228-018-P1-K1-F8
cggacgcgtgggtttgcgtgcacactagtactaacaatgcctaaatgagccctggaatttatgctctaatttttcctggttttctatggagcactgaggtgtttaggtccacctcgtcgtagtattcgtgcgggtcaagctttcttaaatttaatagagagtatattatcaaaaaataaagttataaaataaatgtcattattgcaataaatac

SEQ ID NO: 3702 - DNA, 92 bp, Zea mays
  Clone ID: LIB3228-018-P1-K1-G1
aattttactaatcaaattcttgttgggatatattcctccaattcccctcctcctcccaacaaggcaacaacaatctgttccggccgccaaac

SEQ ID NO: 3703 - DNA, 428 bp, Zea mays
  Clone ID: LIB3228-018-P1-K1-G11
cccacgcgtccgaaaaaaaaaaaaaaaaaaaaaaaaaaaaaaaaaaaaaaaaaaaggaaaaaaaaaaaaaaataaaaaaaaaaaaaaaaaaaaaaaaaaaaaaaaaaacccaaaaaaataaaaaaaaaaagaaaaaaattattaaaaaaaaaaaaggggggggccctttttggggttccaattttttttcccgggggttggggagttttttttttttttttggggcccctaaattaaatttagggggcgggttttttaaacggcgggtttgggaaaccctgggggttcccccattttttggggttggggaaatttccctttttccccgtttggttttttttgaaaggggccccccccttggccttttccaaaattttccccccctttttgggaattgggcccccccttttttggggtttttagggggg

SEQ ID NO: 3704 - DNA, 418 bp, Zea mays
  Clone ID: LIB3228-018-P1-K1-G12
ctctcctcagccaaagttgacagcagcctacaagcgccagcagagctcttcccggtggccatggccaagcccccgcttcagacagcaacgatcatcctgctcgtgctcctcgtggccgcgtcgtgcctccacaccgtcgacgccgccgctttagggttctcctggggcaagtgttgcgttcggtgcgcgagggcgaccacgcggcgggcacgggaggcgtgcatgagctcctgcggcctaaaatgcgagttttgcaaatgcgggcctgcgatgccgccgcgcgacatccatgactgcccctgctaccgcaacatgctcaccgccagccccaagaagaggcccaagtacccttgagactgagactgcgaggccggctcacacgacggcatccatgggactgcgactgctgcttgcaact

SEQ ID NO: 3705 - DNA, 103 bp, Zea mays
  Clone ID: LIB3228-018-P1-K1-G2
aacacgcctatctcaaactcttgcggctagttctagctcgtaagccgctgctcctgcggacacaggaacaccaactatgtgccggcctgccaaacagaaaata

SEQ ID NO: 3706 - DNA, 279 bp, Zea mays
  Clone ID: LIB3228-018-P1-K1-G4
tagctgcagccttttgcttgcaggaagtgcattttgtttaatttgtaagcttgcgcaaaatgctagtagttgctactacgtaggaacctaggtcatgctttaattttgtggtttcgctttgtgaaacgagaatgcaacacgtaataaacgaaaaacaccggttggctttacaatgtggacttgtaacttaaggccgtttggatcttgtcatttttagaggaattggaatctactaagtgtagattatttggcttgaaatttgatgttccaccactttgt

SEQ ID NO: 3707 - DNA, 362 bp, Zea mays
  Clone ID: LIB3228-018-P1-K1-G6
cccacgcgtccgcgaccctgtcagcccagctgatgagcttccacttgacaatttcacgagcctggaagatgcattcccgatcagcgatttcatcggttcaagagatgagcatctgtatgagcactatattggcctggctgacattagccacctgcctcttccaatggatgacccagctttcaatctggatgcagagcttgattggagtgggtttgacttcgctgcgattgaaggtgaacttgatgtcctttgaggctgcaatcagtgatgtgttatactgaaacctgcacttgattatgttgtattcagctgaaagctcctctctatgtttttttatatttgtcagaatacaacaatgaata

SEQ ID NO: 3708 - DNA, 219 bp, Zea mays
  Clone ID: LIB3228-018-P1-K1-G7
gccttttgagcaactacttgcaatgtggagtttgttcgatttgtgaacgcctggttcaaagcaattcccctacctctagttactccagtcatgcaaacactgaagttcatccactgtaatgttgtgtcgatcaggattttgtattaattctatacttgagttttagtccccctgaattgttgaaccagggaatttactcaccattaaacggctttgttt

SEQ ID NO: 3709 - DNA, 164 bp, Zea mays
  Clone ID: LIB3228-018-P1-K1-G8
gtcaccttcaagaacatcaccggcacctcctccaccccggaggtcgttagcctgctctgcactgccaaggtcccatgcaccggcgtcaccatggatgacgtcaacgtcgagtatagcggcaccaacaacaagaccatggctatatgcacgaacgccaagggcag

SEQ ID NO: 3710 - DNA, 414 bp, Zea mays
  Clone ID: LIB3228-018-P1-K1-G9
ccgctttgtagcgtgcagattcgtcattgcgccaggagcgtagggttgcgccgccacggaacctcacctccatcggcgcctagtgcctgaattcggaccgaaggcctgtgcgggacctgtgtgaagccagccacgacaatttcgggtgagattggcggctcatcggccaccaattgctcaccggagttccacactgtcgcggatcctcgcattgccgtgggcaaggagctacgcgtcttaaccaccgacgagcaagtgaccgaggacccaggtgttcagcaagtggaaattgctgaccaggagcttcgtgaaggagaagaataggtggttcaagatgaggcgtagaacgaaatgtacgagctaatctaggtggcgccttccagtcaactttatggcaccgaggaataatattta

SEQ ID NO: 3711 - DNA, 364 bp, Zea mays
  Clone ID: LIB3228-018-P1-K1-H11
agaagagccgaagaacaggaacataggacagacgcctgaagctagacaaagggcggggggaggacaccggcccacaggtagcggaggcaaagaagaagagagcggcggagagcggcgaggcggcggaggcgaataagatccaggacgacttctgctcgacgctgtgcgagggcaagaaggggacggacctggtcgagtgcaaggagacctgcgcactctcccagcaagacaacctggggctgtacggcaggatccagggcaagggcaagggcaccgagcagaagggcatgacggagccggccatgaaggtatgccaggaggagtgggacaaggcggacatggtgaaagcggacgaggtcaccaa

SEQ ID NO: 3712 - DNA, 413 bp, Zea mays
  Clone ID: LIB3228-018-P1-K1-H3
gacaccattaattatattctctctctctctctttcatttctatagccagcaggtagcaggcaggcaaccggccggtatattagtagatcttcgatcgttcatccaagctaataagtcagtaagcagcagtaggtcgaaaatggcgatgaggtcgctagcgctactggtcctcctcagcctgctggttgttggtgtggcgcatgcggtggagttggagatggagttggtgcctgctgatgcaattgcgatgactatggatcatgagccgccgcaggagtgcgcgaccccggtgagcgtggaggaggcgtgccgcggcgcgtttgagacgcacgccggcgtggcctacgaccactgcatggcgtctctgggcgccgacccgcgcagcaaggaggccggcaacaagaacatgcacg

SEQ ID NO: 3713 - DNA, 421 bp, Zea mays
  Clone ID: LIB3228-018-P1-K1-H5
gaaaccagagcaaattccggcgagccggtgcggtgcggcggaggaggccgagggagacgccggcgcgagaaggagcatcaggaggaggcagcggagatggatccggactcggtgaagtcgacgctctctaacctggccttcggcaacgtcatcgccgccgccgcccgcgacctccaaaaggaaatggtggctaaagacaaggctcaatcagcacctgcaagccatgatgaagttgatcttgatgagctgttggatgacccagaacttgagaagttgcacgcggagagaattgctgcccttaagaaagaagttgagaagcgtgaagtgctaaaaaggcaaggtcatggtgaatacagggagataactgaaggggacttcctcggggaggttactggcagtgaaaaagtcatatgccattttt

SEQ ID NO: 3714 - DNA, 274 bp, Zea mays
  Clone ID: LIB3228-018-P1-K1-H8
ggacctgctgggtggcttggtttggttggttggtgacgagtcgtaataagttgtgggcgcatgggcgccgcgctcgtgagtggcgtgcgccacgatgcatgcgtgtatggtgatgaactgaattggagccgtgcagcaagtcgaataatcgggagccacctcgcgtgatgtgtagtggctagtttttgtacatggacgtgttggatcttgatccatgttttgatctgatctttgagaaatggtaatccgcgttatcatgcgtgtttcttgctaa

SEQ ID NO: 3715 - DNA, 96 bp, Zea mays
  Clone ID: LIB3228-019-P1-K1-A10
atgcgtcggttagtcgaactagccgagtgaccttcacaacatctgctttgagatttactcagcctggattgcagttttattttatgttcctgctgg

SEQ ID NO: 3716 - DNA, 178 bp, Zea mays
  Clone ID: LIB3228-019-P1-K1-A2
ccgtacgcgtccgcggacgcgtgggtgaatatctgaacatttgaatgtttgtgctgagtttttcaaagaatttgaatatctgaacaattgaatatctcacttgaacgttatatggcttattttaggcattttttctttttgtatggatttggtttcaaatcataaatacttgttgaaa

SEQ ID NO: 3717 - DNA, 295 bp, Zea mays
  Clone ID: LIB3228-019-P1-K1-A5
ttccgccacgcgtccggaactgcaaagggcttgaatacctccatgagaaggcgaacccacctgtcatttaccgggatctcaagtcccccaacatccttctcgatgagaagtacaaccctaagctctcagattttgggctcgcaaagcttggcccagttgagggaaagacacacatcttcactcgggtgatgggaacgtatgggtactgcgctccggaatacataagaacaggccagctaactgtcaagaccgacgtgtacagttttggggttttcctactggagttgatcacagg

SEQ ID NO: 3718 - DNA, 299 bp, Zea mays
  Clone ID: LIB3228-019-P1-K1-A6
ttccggaaataaagaagagccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgctctctcccagcagtccaacctggagctgtacggcaggatccagtgcaagggcaagtgcaccgagcagaagggc

SEQ ID NO: 3719 - DNA, 288 bp, Zea mays
  Clone ID: LIB3228-019-P1-K1-A7
cggccggcaagagcatcaccctggagagtggagagctcggacacggtcgagaacgtcaaggccaagatccaggacaaggagggcatccctccggaccagcagcgcctcatcttcgccggcaagcagctggacgacggccgcatcttggccgactacaacatccagaaggagtccacgctccacctcgtcctccgccttcgtggtggcggcggccagtgatctggtctgctgatcgccttccgccatggggactggctagctcttgccgctgcctgccagtgcgtgctt

SEQ ID NO: 3720 - DNA, 228 bp, Zea mays
  Clone ID: LIB3228-019-P1-K1-A9
tcgcgtcgctctttttttgttttgacttgcatgctacgggaagcttgaggggattcaattaattctagtatatgtaagtctggtttccagttgaatccatcatttgtcgcaccatcattcttcctttgacagtgcatcagtttttttttggttgatttggatctgtacaattttccttatgtactgatgcttataatagtatacgcaataatattcaggtacagtttt

SEQ ID NO: 3721 - DNA, 293 bp, Zea mays
  Clone ID: LIB3228-019-P1-K1-B1
tccggagagcaaacaacacaaaactgatgaggctggacttaacaacaagctgcaacattctgctgatgacagccagaaaaaaggaaactaatgctatcatgcaatgcttgcctacattggtcctaactagattattgggaggtgcaattgtagtatgcacattaactccttactttattgcagctaattgttaccaggttgtgataatgttgatgccaaccttttgtgagggtgtttcctgtttcagatctatcttggcttatcttttagaagccaagatgtgactgaagcta

SEQ ID NO: 3722 - DNA, 300 bp, Zea mays
  Clone ID: LIB3228-019-P1-K1-B10
tcgcgtcgatagcatcaatcatgtctggtcgttcgtggacaataatggcgcctctcctggcgtcgatgctgctcgtcgggctcgccgtgggctccgaggaggaggaggacggcggcggcaaaaagaagccccacgtcaaccacggcaagtttaaggcggagccgtggacggacgggcacgcgacgtactacggcgggcgcgacgggttaactgacaccacggacggcggcgcgtgcggctacaagggcgagctggggaaagactacggcaccctgacggcggccgtgggcccgtcgctgt

SEQ ID NO: 3723 - DNA, 293 bp, Zea mays
  Clone ID: LIB3228-019-P1-K1-B2
tccgccacgcgtccgcggtcctattgtgttggccttcgggagaaataaagcgcagacatgaatatggagagctagatttgaatagggacttgcttgatagcttggttttgaattttcttaaaggtggatatttttcgagggtgatggagatcattagttacatgtcaaaacataacatttactgtgacaagtggaaatacaggcgtgccttcctgaagctacacaagaacctgtataggaatttgaattcattgcatgacaaaacagaagctcaaagtaaaaggattgaagat

SEQ ID NO: 3724 - DNA, 297 bp, Zea mays
  Clone ID: LIB3228-019-P1-K1-B3
tccgcgacgcgtgggctcactctgagaccgcagatccgttgtccggtgagtggaagccgcacgaacccatggcctccggcgagcttgcctgcacctacgccgctctcatcctcagcgacgatggcatcgccatcaccgccgagaagatcgccacgatcgtgaaggcagccaacatcaaggtcgagtcctactggccggcgctcttcgccaagctcctggagaagcgcaacgtcgaggacctcatcctctccgttggatctggtggcggagctgctccagttgctgctgccgcccctg

SEQ ID NO: 3725 - DNA, 301 bp, Zea mays
  Clone ID: LIB3228-019-P1-K1-B5
atgtccgggcaaccaataatagcaagtgtgatcatccgttgatccatcttgctaataaccctgcgtgcccttcgttctcgtctcgatcccgacgacgctcccttcggctccggcaaaccacatcaagtcgcgatggagatgaagaaggtcgcctgcgccgtcctcgccgccgccgcctccgccaccgtggtcctcgccgccgaggccccggcgcccgcgcccaccagcgcctcctcggctgcgttcccggccgtcggcgccgagctgagcgcctccgtgctctccttcttcgcctactacc

SEQ ID NO: 3726 - DNA, 293 bp, Zea mays
  Clone ID: LIB3228-019-P1-K1-B7
tagcgtcgaagaaattcgccgcttgatgtgtggatccgtcgcggctgccgtcaagcatagacaccaagaaccagaccttggggtggatcattggggtcgcggaggtctactggatggggtcaagaagtatccgggcaagtcgtctctgggaaccctgcttattgctcgccggatgctagcgccgtcgtggactgcgcggctccgagaagttgaggtcgtcatgacatatcccagtgtggacacgaggatctgaagtatcaccctggtaactggaatctcaagtgacacgcaag

SEQ ID NO: 3727 - DNA, 290 bp, Zea mays
  Clone ID: LIB3228-019-P1-K1-B8
ggatgaaatgaagaccattgctgagcaattcagcgtagaggccatgccaacattcctgttcatgagggagggcgacgtcaaggacagggtcgttggcgcagcaaaggaagagctagcaaggaagcttgaactacacatggcctcgtagatcagtgatgccggaatgtagtattcgcctaaataagaggacgcctcgcctcaactctgagaaaactagtgcttctgtgatggtaattcgtatgagagaatgccccctttggtggtacttcttcgtatggaatattaactcc

SEQ ID NO: 3728 - DNA, 298 bp, Zea mays
  Clone ID: LIB3228-019-P1-K1-C1
tccgctcggaaagggaaaacgccaccacacgcggatcgaattaggctctccgagtctccggttccctcctctcggcggcggctcaagtccctctccatctccggcgtggcgcttggcgtctgacctcaacaagcaagaaagcaaatggcaggcggcagggttgcacatgccaccctcaagggcccgagtgtggtgaaggagatcttcattggactgaccctgggtctgatcgcgggaggcatgtggaagatgcaccactggaacgagcagaggaagactaggtccttctatgacatgg

SEQ ID NO: 3729 - DNA, 291 bp, Zea mays
  Clone ID: LIB3228-019-P1-K1-C11
tgcgtcgaaaaaaaaaaaaaaaaaaaaaaaaaaaaaaataaaaaaaaaaaaaaaaaaaaaaaaaaaaaaaaaaaaaaaaaaaaataaaaaaaaaaaaaaaataaattggggcggccgttttagagaatccaagcttacttacgcgtgcatgcaacgtttaagttcttctttagtggcacctaaattaaattaattggccgtggtttaacaactgtttgactggtaaaaccttggtgtttccaaacttaatcccttggtaataaatccccctttttccagttggttttatat

SEQ ID NO: 3730 - DNA, 250 bp, Zea mays
  Clone ID: LIB3228-019-P1-K1-C12
ctgcagtccgtccggaattcgggtcgccatgctgcatgagaacgtggtgatgaaatgtgacaattgggggaagagggtggtgcatgtcatttggtgattgggattagatagcattgatcagaaaatgaaaatccagtgatagaaagattgcctacgtaagagtgattaccagtcacaagctgcagatgggcaattttaaagaaggacgagacaattttaaggattaccattagtctactattttattgat

SEQ ID NO: 3731 - DNA, 291 bp, Zea mays
  Clone ID: LIB3228-019-P1-K1-C2
tccgcgggagaagagtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtccggggcggcgagctcttcgcccgcgtcgcccgcggccggctcaaggaggacgccgcgagaaggtacttccaccagctcgtcggcgccgtcgacttctgccacagccgcggcgtctaccaccgcgacctcaagcccgagaacc

SEQ ID NO: 3732 - DNA, 296 bp, Zea mays
  Clone ID: LIB3228-019-P1-K1-C3
tccgccacgcgtccgcgcagggatcgagtagcccaccaccccacccggcgacgctaaccgacgcaatggcgacgctcaccgttccttcctccgtcccggccgtcgccgaggactgcgagcagctccacaaggccttcgaaggttggggcaccaacgagaaactgatcatctccatcctggcccaccgcaacgccgcgcagcgccgcgcgatccgccgcggctatgccgaggcgtacgggaaggagctgctccgcgctctcggcgacgagatccacggcaagttcgagagggcggtg

SEQ ID NO: 3733 - DNA, 269 bp, Zea mays
  Clone ID: LIB3228-019-P1-K1-C4
atgccgggaagggacgttgggtgggggtgagccaaatgagaacgcacggatatatctatagatgtaatcttgagatgccctctcaaatcactgtaatggggtttaaaaaacaatcattgtaatgggagttatatatacttttatcttaacatttatttacaccagcaagtcctggtgtatgcatgctgtaccgtgtttactagtgaacactacactggcggacgggtccgcgccaccgcgatcagattaactcgggaaattattgctaa

SEQ ID NO: 3734 - DNA, 273 bp, Zea mays
  Clone ID: LIB3228-019-P1-K1-C5
agttccgagcttcaagcaaaaaaaaaaaaaaaaataaaaaaaaataaaaaaaaaaaaaaaaaaaaaataaaaaaaaaaaaaaaaaaaaaaaaaaaataaaaaaaaaaaaaaaaaaaataaaaaaagggggcggccgttttaaagaatcaaagcttacttccccgagcatgcaattaaaaattttttatatagggcaaccaaaattaaattaatgggccgtcgttgaaaaacccggaaattataaaaaccataggggcttccaaaataaatcct

SEQ ID NO: 3735 - DNA, 300 bp, Zea mays
  Clone ID: LIB3228-019-P1-K1-C6
tgccgcgacgcgtgggttcgttccccgcctcaccccgagccagccgtctcgctagggtttcgccgccgccgccgccgccgccgccgctatgcctcgccgcagctcaagaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagagccatggcacacagggctgttgatgctgg

SEQ ID NO: 3736 - DNA, 293 bp, Zea mays
  Clone ID: LIB3228-019-P1-K1-C7
gaatagctccgtttcgccgcatagccgagaggaagcaggcggcggcgagaatccagtccaacgcgagcagacggcggcgatggcatggcgggcgagcctgtctcggagtgtaaaggagatacgcgtcctcttctgccagtcctcccccgctagcgcccccgcccgggagttcgtgaagaagaactatggtgacatcaaggcccgcaacccctccctccccttccttgtccgcgagtgctccggtagtccagccccagctctgggcgcgctacgatatgggtgtggagagatgc

SEQ ID NO: 3737 - DNA, 201 bp, Zea mays
  Clone ID: LIB3228-019-P1-K1-C8
tcgcgtcgtttcaatcgagggcgaggccagaagaagccaaattattgcaaatactcgttaagccttgtttagttattttcatttcatttggattaaatgggattgaaagaagttagcaggaattttgacttgctatagattgaaagctacctaatcttgttcaatccacatggattgagattaatcggaaataaaaatgaa

SEQ ID NO: 3738 - DNA, 294 bp, Zea mays
  Clone ID: LIB3228-019-P1-K1-C9
tcgcgtcgcccacgcgtccggagtcttctgtgctgttctactatcctgaatagggaaaaaaaaagacttacagatttatacagaggacccaagatgcagaaacctgaagatatgattcggcaagtccacggtgtcaggcattcaggccttcgtagaggattctggtgagcatgaagcggtcggtcccttctgagatgggaacgggcctcgattcccaattcaccatgggaaattctttcattagagacagtgaagtttcttttcccacgaggatataaacgtgtaaagagggac

SEQ ID NO: 3739 - DNA, 265 bp, Zea mays
  Clone ID: LIB3228-019-P1-K1-D1
ttccgagaaagagaaaggcatgtcatcgaaatctgataagcttaagccccagaagaaaccccacaagaagtcatcgaagaaaaaggcttaggtccacatctttcaggtgaccacagttttgaaagctcaagcaaggaggcctgtcagcatattcaattgtatttttctgctttgaatctatgagagaaatattgttattccgtttactggctatgacacaaaaacctgaatgctgttataatatatgcccatcttgtaccttttc

SEQ ID NO: 3740 - DNA, 298 bp, Zea mays
  Clone ID: LIB3228-019-P1-K1-D11
agcgtcgcgccggcaagagcatcaccctggaggtggagagctcggacacggtcgagaacgtgaaggccaagatccaggacaaggagggcatccctccggaccagcagcgcctcatcttcgccggcaagcagctggacgacggccgcatcttggccgactacaacatccagaaggagtccacgctccacctcgtcctccgcctccgaggaggcggcggccagtgatctggtctgctgatcgcctcccgccatggggactggctagctcttgccgctgcctgccagagcgtgctcgtttc

SEQ ID NO: 3741 - DNA, 292 bp, Zea mays
  Clone ID: LIB3228-019-P1-K1-D12
gcggacgcgtgggcaaatacgcatctccgcctcctcctctattccaaggatattaagctctatggagagatggtcgaccaagaatgaattgaacaacaatatataaggtcgcatgcgcaaccaaacagctacatgtacattgcaggcgtgtgtgaaattgtttatttattttttgcatgtgcacgcgtgagtatttgcttctccgtacatactctatgtatgaacgtgtgcatgtgtgaactaactacatgagacgacaaggtgcaagaaacatgtctggggcatcatttgt

SEQ ID NO: 3742 - DNA, 297 bp, Zea mays
  Clone ID: LIB3228-019-P1-K1-D3
agtccgcgcccggtgacagccccaacacggacggcatccacatgggcgactcgtccgggggcaccatcaccaacaccgtcatcggcgtcggcgacgactgcatctccatcggccccgggacctccaaggtgaacatcaccggcgtgacctgcggccccggccacggcatcagcatcggcagcctagggcgggacaaggacgagaaggacgtcacggatatcaacgtcaaggactgcacgcttaagaagacggccaacggcgtccgcatcaaggcgtttgatgacgccgcctccgtgc

SEQ ID NO: 3743 - DNA, 281 bp, Zea mays
  Clone ID: LIB3228-019-P1-K1-D4
ccgctctctctcgtccatcaacccagggggaaggagcgggagggagcgagccatggtagtcagcacgttcaatggacccgggattgggatcgggttcggtgtcggctgcgggttcggcgtcgggtgggggttcggaggaatgcctcttaacatgttcggcttgggtatcggtgggggttgaggatttggtcttggactaggatggggctttggaaatgcttctggatgtcagtatcgatcttcaagagttcagttccaaggcattgaatttcagatgaagg

SEQ ID NO: 3744 - DNA, 270 bp, Zea mays
  Clone ID: LIB3228-019-P1-K1-D5
tgccgcgagttcctcaacctcatggcccgcaagatgaaggacaccgactccgaggaggagctcaaggaggcgttcagggtgttcgacaaggaccagaacggcttcatctctgcggcggagctccgccacgtgatgaccaacctcggcgagaagctgaccgacgaggaggtcgatgagatgatccgcgaggccgacgtcgatggcgatggccagatcaactacgaggagttcgtcaaggtcatgatggccaagtgagttaagcctgcggta

SEQ ID NO: 3745 - DNA, 262 bp, Zea mays
  Clone ID: LIB3228-019-P1-K1-D6
tccgcgacgcgtgggtcgccagcaaagggagagcgccgaggtgatagagataatgcggtggtggtgctcatggttggatgaatgggggtgtcggtctatgcgcggctgacgtcctcatcggagcaaaccccttcaccgttggttgcctcgtgccgtggcctggaaagtcgattactgctcatcatggtcggtggccccttccgaccgtactaccgtgtgccgacgctgttggctgagcgcctattaaattaccagctaggtc

SEQ ID NO: 3746 - DNA, 295 bp, Zea mays
  Clone ID: LIB3228-019-P1-K1-D8
tcgcgtcgtcctaaagccatgaatgctgctgagatcactgacaagcttggattacactccctgcggcagcgacactggtacatccagagcacttgtgccacaactggcgagggtctgtacgagggcctggactggctgtccagcaacattgcgagcaaggctcgaatatcaaatgcgaactgactaggagctccggatgtatcatggaaacttaagacagaatcgcctctacaacctgttaggtggtttctaccggcacaatatattttttggttggaatatggaatgatgttac

SEQ ID NO: 3747 - DNA, 300 bp, Zea mays
  Clone ID: LIB3228-019-P1-K1-E11
tcgtccatccagccttctgctctgctccctcgaaatggaggcgacgagcaaggcgatggcttcaggcctcctcgttctgctgcttctcatcaacacaggctttgtcctgcccgtccattccgaggactgctgggccgacacccgcgtcatctgcaccaagacgcacaactgccgggacgacacttgcgcggggcgcggcatgccggacggccgctgccactgggagttccccaacctggtgcccttctgccagtgcctgcgccccaactgccactagtccgggcgcctcggattggctca

SEQ ID NO: 3748 - DNA, 243 bp, Zea mays
  Clone ID: LIB3228-019-P1-K1-E4
gaaaaaaaaaaaagaaacgggaaaaaaaaaaaaaaaaaaaaaaaaaaaaagagggggggaaggaaaaagaggagggggcaaagggagcgaaaacggagaagcggagaataggggaaaggaaaaaaagaaaaaaaagaaaaggggggggaaggggaaagggaggaagggaaaaatggggggggggggaagagggaagagctgaagaggggggagcgggaatgaatagatgggggagggggaaaa

SEQ ID NO: 3749 - DNA, 299 bp, Zea mays
  Clone ID: LIB3228-019-P1-K1-E5
tccgccacgcgtccgcccacgcgtccgcaaccgtcaccggtgagctacgtgatgatcttacgtgctgggatgcactacgagctgcattgccagttggaacagttagtggagctccaaaggtgagagcaatggagttgatcgacgagctagaagcggacatgcgtgggccgtacagcggtggcttcggagggatttccttcaacggcgacatggacatcgcgctcgcccttcgcaccatcgtcttccccaccgcatcccggttcgacaccatgtactcctacgcgaacgggaagtcacgg

SEQ ID NO: 3750 - DNA, 302 bp, Zea mays
  Clone ID: LIB3228-019-P1-K1-E7
tagcgtcgtaccccatcatcatcgacatgaagtactgccccaacaagttatgcaccgccaatggtgcctccaaggtcaccgtcaaggacgtcaccttcaagaacatcaccggcacctcctccaccccggaggccgtcaacctgctctgctctgccaagatcccatgcaccggcgtcaccatggacgacgtcaacatcaagtacagtggcaccaacaacaagaccatggccgtatgcaagaacgctaagggcagcgccaagggttgcctcaaggagctcgcatgcttctagaaccaccatcgg

SEQ ID NO: 3751 - DNA, 300 bp, Zea mays
  Clone ID: LIB3228-019-P1-K1-E8
tcgcgtcggccagaaaaaggcttcgccttggtccttggatccccccacacaacgcagcacccgcactctccaggcgtctgccaatccgaaacgaaacccacccgtaggcaaaccaggactgagattgagcggagagcagcacagtcatggcggggcaggaggtggcgaacaagcgggtggtactgaagcgctacgtgacggggttccccggcgcggacgacatggaggtggtcaccggcaccgcgcgcgtggccgtgccgccggggtcgacggccatggtgctcaagaacctctacgtgt

SEQ ID NO: 3752 - DNA, 217 bp, Zea mays
  Clone ID: LIB3228-019-P1-K1-F1
attccgagagaatgaaaactcatatgttctccaatggaatatgaacatcaagaggttaatgtgcatcactttatgccatcatgatccctatgttaatcttctgaaataagaacctataggtctatattagtcttatatctgaacttcattaattgcttccagacaattgtatgacaaatggcactcggaaatgtttcagcaatgtttttgtttgctg

SEQ ID NO: 3753 - DNA, 145 bp, Zea mays
  Clone ID: LIB3228-019-P1-K1-F12
aactgcgtagttttttagtttttctgtcttgaagaataataaccatggtaaattgcgctgttatagagctctatgatcttctctgatgtaccagcacccttgcgttcaatcaaatgctaccatgcatgccgacgttgcgattggg

SEQ ID NO: 3754 - DNA, 266 bp, Zea mays
  Clone ID: LIB3228-019-P1-K1-F3
ttccgccacgcgtccgcgccaacctcctgcttctgggcctcttccagtctctgcggtcatggagcgtctcgtcggggtgcctgggttcacgcccggggtaccctatcgtctattcagtaaccggtatcgtacccggaggaacacaaaatacgtggcggcctctccgtgctcagtacctgcaacgcactagcactgcgtctttggcgccgacgtgtgatcaccgtctactcgctcgctgcagggcatacattccacgatcttttcta

SEQ ID NO: 3755 - DNA, 298 bp, Zea mays
  Clone ID: LIB3228-019-P1-K1-F4
gtccatccgagtgtctcctcctcctccgccgccgccgccgccgcttccctcgtctccgcccgccgaagccatgccgtcgcacaagaccttccggatcaagaagaagctggccaagaagatgcgccagaaccgccccatcccctactggatccgcatgcgcaccgacaacaccatcaggtacaacgccaagcgcaggcactggcgtcgcaccaaactcggattctgagcggtggaagaaatgctggctaaagacgcctagagggtatagggctctgcaagctaggaagctcttgtttaa

SEQ ID NO: 3756 - DNA, 265 bp, Zea mays
  Clone ID: LIB3228-019-P1-K1-F5
gcaagacttaggaagagatggaaaacttacttagagaggtatagtttgcagagagaggctaatcatgtaattggcaggaagcacagcaatacaggattggctggcatcaagggtagcgattgagctgatgaaggaaggtgcgatgcatacggtgttaaatggcatcatttaagcatttgcagtgcctactaccttgatatctaccgcggtctttatcaacagcaaatagggtgttactattgacagtgcaaacaaagttgggaaa

SEQ ID NO: 3757 - DNA, 298 bp, Zea mays
  Clone ID: LIB3228-019-P1-K1-F7
tcgcgtcgcggacgcgtgggcggacgcgtgggcggacgcgtgggtgccccgaccggcctcttcctcggccccaccaagtacatggtcatccaaggcgagcccggcgctgtcatccgcgggaagaagggatctggaggcataactgtgaagaagacagggcaagcgatggtggtcggcatctacgacgagcccatgacccccggccagtgcaacatggtggtcgagaggctcggcgactacctcgtagagcaaggcctgtgaatggattcatttaacctcgctcgcttgtccatggttc

SEQ ID NO: 3758 - DNA, 300 bp, Zea mays
  Clone ID: LIB3228-019-P1-K1-F8
atgcgcgtcggtcgcgtctgtctcgtttcgtccgtctctctctcagcagccatggcgcctagggtttgcgccaccagcgccagccatcgccgctcactccatttgtaggaaacatgtccccattccgagatccattgctgccctccatccccacgcgcccatgaatcaggagtggtcgttctcagccatttacaaccgcgttttaggagccgtatttcgagatcgtatagcgaagaatcgctcgttctcagccacagatcaggagtgatcgttctcagccacggtgcacggatgtagagt

SEQ ID NO: 3759 - DNA, 166 bp, Zea mays
  Clone ID: LIB3228-019-P1-K1-F9
gcggacgcgtgggggccgtcgctgtaagagatgtacagacccagtattgcgagggggaccataatctggaggatcttgacgacgaactcttgggtcttgtcctccttgaattactgggtctgtacgtccttattatgtcggtcatcaagcccttattcgctcattg

SEQ ID NO: 3760 - DNA, 294 bp, Zea mays
  Clone ID: LIB3228-019-P1-K1-G1
attccgacacacatccgtgaaagaaacaagcacatagaaacaaatacatcgctagctcgccaccaacaaaggcctcaaggtactctatcctgcttgccacaacgacactggctatgttgttcgcattcggttcgtgcaccaccccactcaccttccaagtcaggcaagggctccaagcctggccacctggttctcacccctaacattgccaccatctctgacgtggagatcaaggagcatggcggcgacgatttctcctttacactcaaggagagcccagctggcacttagact

SEQ ID NO: 3761 - DNA, 197 bp, Zea mays
  Clone ID: LIB3228-019-P1-K1-G10
tttcttcaggggatgggtgcctactttggttgggtaccagagctcaaggggcttggaaggttggcttctatgaattctttaaaaaggattactcggacattgcagggcctggatttgccccaaaggaccagactcttatttacctcgcaagatccggatttggtgaaggaattgctgatggggctctcttgcctttt

SEQ ID NO: 3762 - DNA, 262 bp, Zea mays
  Clone ID: LIB3228-019-P1-K1-G12
aaactatcgccagcaaagggagaacgccgaggtgagagagataatgcggtggtggtgctcatggtcggatgaatgggggtgtcgagctatgcgcggttgacgtcctcatcggagcaaaccccttcaccgttggttgccttgtaccgtggcctgtgaagtcggtgactgctcatcatggtaggaggccccgaccgaccgtgcaaccgtgtgccgacgctgtggctgtgcgccaatgaaatcacgtgaggtcgtgagttatctg

SEQ ID NO: 3763 - DNA, 77 bp, Zea mays
  Clone ID: LIB3228-019-P1-K1-G3
agtccgccacgcgtccgcccacgcgtccgtccatgcgttcgtagactctttaactatacgcgggggcagtctcgttg

SEQ ID NO: 3764 - DNA, 297 bp, Zea mays
  Clone ID: LIB3228-019-P1-K1-G5
gcggcgcgtgggtgccaaggcgctcaagggccccttctccatccgcctcaccagcgagtccggcaagaaggtcatcgccaaagacgtcatcccggcgaactggagacccgatgccgtctacacttccaacgtccaattctactagactttgaattcccttcgattcatccggcacagcgggctatggaccttcagcagcaagctaattaagttggcagcatgcaccgctaaccttatatactactgagacttccaaattctaagatatgtaatccttttgttcgggttcatgatcga

SEQ ID NO: 3765 - DNA, 282 bp, Zea mays
  Clone ID: LIB3228-019-P1-K1-G6
gtggaaggctgggcgactacctgcttgaacagggcatgtatctactacgtaccagctggaatgcatgtcgacgacgatggttccgagtttcaacttccaataatagtaacaacacagcaaagagccttactcccggcgtattagctttggctcttctcctacacagccataagatatctagcaattggacacgtcgccttaattaggtcgctttgctagagacgttgatacaaccattgtgctgtaacgagaattgcatgcatggacatgcaacgctccaat

SEQ ID NO: 3766 - DNA, 284 bp, Zea mays
  Clone ID: LIB3228-019-P1-K1-G8
tcgcgtcggctaagcagttggtcagccaaggccatgtgttagatgtttttgcatctgctctcgatcaggttggactagctgagatgaaagttgctattgagagaacaggtggccttgttgtcttatctgaaagttttggacattcagtattcaaggattctttcaaacgcatttttgagggaggtgaacagtctctaggcctttcattcaatggtacaattgaaataaactattcgaaggatattaaagtccaaggtattattggaccatgcacatctttggag

SEQ ID NO: 3767 - DNA, 146 bp, Zea mays
  Clone ID: LIB3228-019-P1-K1-H10
gctactatcaggcagtttggttgtctgttggatgtcacggtttacttatgttcttatggattgctactatacaagtatttgttttggatgtgtcatgtgttgtataacctttcgggatgtaacattttattattgcacaaaataat

SEQ ID NO: 3768 - DNA, 278 bp, Zea mays
  Clone ID: LIB3228-019-P1-K1-H4
tgcgaagaaggcgcctaattctttcgatcgaattaggcgccttcttcgtcccacgctcggtctttatttgtaatctgaagcttacaggaacatttgagtggatcatggacggattggtaggcctcttgaaagcccgggtggtgaggggcatcaaccttgcctaccgtgacgcaagaggcagcgatccgtatgtcgtcctacgactcggcaagaagaaactcaagacgagcgtgaagaagagatctgcgaaccccatttggacgaggagctaactttga

SEQ ID NO: 3769 - DNA, 285 bp, Zea mays
  Clone ID: LIB3228-019-P1-K1-H5
ggttgatggctctgctctcagcgccgatctccattcccaatgcgatcaacaactacgaacgaagatgatcgccggcagtgggatcggcgacggcgaaagtgaagagctggacaagggcggcagcggcggcagcggccaccacaagcacgagggctacaagaacaaggatggcaagggaaacctgaagccctctcagtgctgcggggagtgccgactgcggagctccaaaacgcaccacaagaagccgtgcctcttcttctacaacaagtgctgcgccaagtgcct

SEQ ID NO: 3770 - DNA, 88 bp, Zea mays
  Clone ID: LIB3228-020-P1-K1-A10
cccacgcgtccgagcgaacggcaagagtaccaatcttaggtgacttggtgtgggttgtgtctgaaataagtgaattgtattttaattt

SEQ ID NO: 3771 - DNA, 397 bp, Zea mays
  Clone ID: LIB3228-020-P1-K1-A11
gccatgcaacacggccaacaccaagatggcacccaacgtcatcagcgccgagtggcgcacgttcatcgaggtggtcttcgagaaccccgagaagagcatcgacaccatccacatagacggctacgccttcttcgccgtcggcatggggcccggcaaatggacggcagcgtcgcggagtacgtacaacctcctggacacggtgagccggcacacgatccaggtgtacccaaggtcgtggacggcggtgatgatgacgttcgacaacgcggtcatgtggagcgtccgctccaacatctgggagaggcagtacctcggcgagcagctgtacgtgagcgtcatctcgccggagcggtcgctcagggacgagtacaacatgccggagaccagccttcgctgc

SEQ ID NO: 3772 - DNA, 443 bp, Zea mays
  Clone ID: LIB3228-020-P1-K1-A3
cacgcggccgtcccgggacgaccgaggcgacccacgcagcctggcgccgacaggcctgttcctcggacctaccaagtacatggtcatccaaggcgagcctggtgccgtcatccgtggcaagaagggatcaggaggcatcaccgtgaagaagacagggcaggcactcgtcgttggcatctacgacgagccgatgacgcctgggcagtgcaacatggtggtggaaaggctgggcgactacctgcttgaacagggcatgtaactactacgtaccagctggaatgcatgtcgacgacgatggtttcgagtttcgacttccaataatagtaacaacaaagcaaaggccttcctcccggcgtatttgctttggctcttctcctccacgccataagatatctagcaattggtcactcgccttaattagttcgctttgcttttgaggttga

SEQ ID NO: 3773 - DNA, 381 bp, Zea mays
  Clone ID: LIB3228-020-P1-K1-A4
ccccattcgttcgagaactgtgaaatgacacttgtttgattgagatctaaaaaaaaagagagccagatgcaagaataaaaaaaaaagaaaggataaggaggcattaaacgtgaagaagtcagggcaggcactcgtcgttggcatatacgacaagccgatgacacctggacaagagcagcgggggggcggtttagggggttcgagtttttgttccggcggcggggggggactactactttctttgggggcaccaaaatcaacttagggggcggcgtgtttccaccgccggtattgggaacacctgggtttaccccattttattggcttttgagcaaatcctcttttccccggtggcgtaaataataaaggggccggcccctt

SEQ ID NO: 3774 - DNA, 391 bp, Zea mays
  unsure (1)..(391): unsure at all n locations; Clone ID: LIB3228-020-P1-K1-A5
aaataattgatttaggccttgtccgttttatcttgagatagtgatttagactggtaggaaattgaaaccctaaaaaaaaaaaaaaaaaaaaaaaaaaaaaaaaaaaaaaccaaaaaaaaaaaaaaaaaaaaaaaaaaaaaaaaaaaacattaaaaaaaaaaaaaaaaaaaaaaaaaaaaaaaaaaaaaaaaaaaaaaaaaaaaaaaaaaaanggggggggggggttaaagggaaaaaaggttaagtaagggggaagggaaaggaaaaattttttaaagggggaaaaaaaaaaaaaataaaggggggggggaaaaaaaagggggaagggggaaaaaccggggggtaaaaaaaaaaaaggggggggggaaaaagccccttttggagggggggg

SEQ ID NO: 3775 - DNA, 180 bp, Zea mays
  Clone ID: LIB3228-020-P1-K1-A6
cccacgcgtccgcccacgcgtccgcggacgcgtgggctggagtatgtacttgtgtaaatcgaggcatgctatgttctttttcttgtggaatgtacttcaaatccccttttaaatagaaataagacgaacgcttgtaatgtgtttcatatgcagtaaaaggtttgaggcaaacattaagcg

SEQ ID NO: 3776 - DNA, 374 bp, Zea mays
  Clone ID: LIB3228-020-P1-K1-A7
ggactttagtgttacgtttgaaggataatgcagtagacaacgttggtggtgtgtggtggtgaggctccacgtaagagggagcatcacactacgtaacaggaatgatctttggtggattggggcgtcttaattcaaattggtgccttccatctcatcgattcaggttaattcttttctttgttgattgatttgttgacccctcttgctttgtccttctgtcaataaggacatacacaggttaaaattcaatttctttgctcgtagttgttgcacattgattgttctatcattattcattattatgttgatgcaaagtatattatgatgtcagactcatctgttacaaaaatgagattaacaactgttctatttgg

SEQ ID NO: 3777 - DNA, 232 bp, Zea mays
  Clone ID: LIB3228-020-P1-K1-A8
cggacgcgtgggcggacgcgtgggcggacgcgtgggaaaaaaaaaaaaaaaaagagaaaaaaaaaaaaaaaaaaataagaaaaaaaataaaataaaaaaaaaaatgtaaactggggtggtgttatctggggttccgctctctttgggtgcgcccctctcttcgttttgtcgcgtggctgtggtgttacctgttgggggggtgcctttttcggggcctttgtctttgttcttt

SEQ ID NO: 3778 - DNA, 292 bp, Zea mays
  Clone ID: LIB3228-020-P1-K1-A9
aagacggtgggaaatatacgcctgcctaccgtggggctccggaggggactgcaattctgctaatttgtgacagatcatacatgattagtctgttatgaggtgtatctgcaaccccaatgaagatggcaccaggacgatgaaaccctgtccaccggattttggttacccatcatagttgctttacgtaagatcaagatgtcgtcaactcacatactaagtgatagattcccttcgatgcacctttcttgctctttcgctctttgtacctgctaagtaaaatggccttctcaag

SEQ ID NO: 3779 - DNA, 396 bp, Zea mays
  Clone ID: LIB3228-020-P1-K1-B10
cgcacatctcctgagcctggttcctctccgacccgattgcgccgcgcctacgcccccgtcttctgtgagatcatctccggcggcacgcggacatgactacttcaaggcgtcttgctgacaggaagagtgcaaagttgcagaagaacatcacatcgaggggctttgtgcctcacaccaccctgaaaaagagcaaagactaccatgttcgacctatacatcttggattattgatttttgtggccattggatcatacttgctccagataatcaggacagctacaagcggggggttggactgaattcactgagctaaaaccagaaatttattctgatcgtgagctgcgaggcagtatctgtgctggtagcaaacttgttcatggatatgtagtgcgaatg

SEQ ID NO: 3780 - DNA, 357 bp, Zea mays
  Clone ID: LIB3228-020-P1-K1-B11
gcagcagggaacatcgtccatccgagctaagtaattaggtcgaaaatgacccgtgccagcagcagtagcagcagccggcgtgtgacgctggtactgctcggtctccgcctgctgcttctggttggtgttgcgcaggcggtagtggagttggtgcctgctgatgataatatcgccgccgccgctgctggcacggcggtggacgatggcgagcctcctcagcagtgcgcgaccccggtgagcgtggaggaggcttgcgcgcgtccgagacgcacgccggcgtgggctacgaccactgcatggcgtcgctgggcgccgacccgcgcagcaaggaggccggcaacaagaacatgcacgggc

SEQ ID NO: 3781 - DNA, 362 bp, Zea mays
  Clone ID: LIB3228-020-P1-K1-B2
gcaaggagccgctccccaactgcggcgagctgctccgcgcctacgacctctacaacgagacgtccgagaattcctaagcgtccaaacaaaagttctctcgctcgctttttttttaaaaaaaaaatcccatatacatatagcacatttgtttcggtttgttgatgcgcgcatgcatgctagcagacatctttcctaaaaaaaatttaaataatttccatctcgcattattttagtagctaccattcatgttttctgagtagttgtataaatgctaccaccgtcatcttttgtacccggccggaacaaacgaaaaacacactatctatgctgtgttgtgaattcaattcttgaccatcttctct

SEQ ID NO: 3782 - DNA, 55 bp, Zea mays
  Clone ID: LIB3228-020-P1-K1-B3
acggcaaggcgtggtttcatcacctagaccgagcatccattagcctgcgagcggt

SEQ ID NO: 3783 - DNA, 405 bp, Zea mays
  Clone ID: LIB3228-020-P1-K1-B4
ctagcgggcaccgcgttcggtgccatggccaagaagggtgaggaggagaagttgcgcaaggcgggcatcattgacatgcagtttcggagggtcaagtgcaagtatggatctaaggtcaccttccacttggagaaggggtgcaaccccaactacctggcattgttggtcaagtacgtcgatggcgatggcgacattgtggcggtggacatcaaggagaagggctccgacacgtacgagcctctaaagcactcctggggcgccatctggaggaaggacagcgacaagccgatcaagggacccatcaccgtccaactcaccaccgagggaggcactaagaccgtctatgacgatgtcatccccgccggctggaagcccaacactgcctacaccgccaaataaactaac

SEQ ID NO: 3784 - DNA, 405 bp, Zea mays
  Clone ID: LIB3228-020-P1-K1-B5
aggcttggggcagtcaacttgtgtaggcattggtggtgacccattcaatggcacaaattttgttgattgccttgaaaaatttgtcgatgaccctcaaacagaaggcattgttctcatcggtgaaattggaggtacggctgaggaggatgctgcaacgttcatccaggaaagcaaaacacaaaagcctgttgttgcattcattgctggacttacggcacccccaggccgtcgcatgggtcatgctggagctatcgtggcaggaggaaagggtactgcccaggacaaaatcaaggcactcagagaggctggtgttaccgttgtcgagtcaccagcgaagattgtttctacccatgttgaaatcttcaaacagcgtggaatggtagaatagacacagtggtacagtag

SEQ ID NO: 3785 - DNA, 69 bp, Zea mays
  Clone ID: LIB3228-020-P1-K1-B7
tggtcttcctgttgtatgtatgtatgtatgtatttgagctaaggaataaaaattgtggctttgtgggtt

SEQ ID NO: 3786 - DNA, 401 bp, Zea mays
  Clone ID: LIB3228-020-P1-K1-B9
ctggccgcgacctcaccgactacctcatgaagatcctgactgaacgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatccacgagaccacctacaactccatcatgaagtgcgacgtggatattaggaaggatctgtatggcaacatcgtcctctccggtggtaccactatgttccctggcattgctgacaggatgagg

SEQ ID NO: 3787 - DNA, 399 bp, Zea mays
  Clone ID: LIB3228-020-P1-K1-C10
gccgcaacatcaccgttaacgaggcccagtcccgcggcggccgtggaggcggcggtggcggatacggtggcgggcgccgtgatggaggcggctacggcggtggcggtggaggctacggcggtggtcgtggaggctacggcggcggtgggggatacggtggtgcaaaccgcggcggcggctacggcaacaacgacgggaactggaggaactgagcggtggggtccgctgaggcctagttatcttgttcgcttctgctaccgtgttcaccctagtctagagggggtttatcttcgtctgtggtcgtctcgtgtccgtatgtttcgtttcgtgttcgttgttgttgttgcccatctgtgtttttgaccgcaagctcgctcctctgatgttgttagtgatgtc

SEQ ID NO: 3788 - DNA, 399 bp, Zea mays
  Clone ID: LIB3228-020-P1-K1-C11
cccacgcgtccgagctctgatccatatgtggtcgagcaaactatcgatgaaaatactgagtttttaattctagcaagtgatggcttgtggaaggtgatgtccaaccaggaggctgtcgacgagatcaaggattgcaaggacgcgcaggcagctgccaagcacctgacggagcaggccgtgaaccggaagagcaaagacgacatttcagttatcgtagtcaagttcatgtgctagcacatcgtcaggttaaatggtctcccgattgtataccgtgttaaattatcttttaagtcttgtgctcgctggtgtcggacattttgtttaccttctttggttttgggaccccacaaagagggtcaaggcttgtaacatattgttgtttgtttaaggctccaaata

SEQ ID NO: 3789 - DNA, 147 bp, Zea mays
  Clone ID: LIB3228-020-P1-K1-C12
gaataatcaagcaccaaaggaatgtgcttgcatcactcactactagtaccttggttttatatatgtttcctctcctgacgctctccgattttaatcttcatgtatgcaacatatgtgatgaatggaaaaatcgatttgtatttgtta

SEQ ID NO: 3790 - DNA, 117 bp, Zea mays
  Clone ID: LIB3228-020-P1-K1-C2
cccacgcgtccgcggacgcgtgggctccaaacagacgctcttttgtacccaccaaatttgtatcggtgtcgggacattgtaccatgccgttattttgtatcggtttgtcactcactc

SEQ ID NO: 3791 - DNA, 329 bp, Zea mays
  Clone ID: LIB3228-020-P1-K1-C3
ccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactgcctgcgagtcgtccgccgaggctcccgctggcgctggcgctggcgctgccgctggcgccgccgcctcggggccctccgccagcagcggcgcgc

SEQ ID NO: 3792 - DNA, 257 bp, Zea mays
  Clone ID: LIB3228-020-P1-K1-C4
gagaagggccccagtatgggcgtgccccaaaagagaacgcacggttttatttatggatggggtcgtcatacgccccgtcacatcactgaaagggattttaaaaaacaataccagcactgggagttatgcaagctgttatctaaacatttatttacaccagcacgatctggtgcatgcatgtctgaccgggtttactagtgaacactactcttgcggacggatccgctccacctgcgatcagattatacttggtaaat

SEQ ID NO: 3793 - DNA, 405 bp, Zea mays
  unsure (1)..(405): unsure at all n locations; Clone ID: LIB3228-020-P1-K1-C5
cggacgcgtgggccctatgcattttcttagtacttgccttacatggagatactactttggcagaaacttgcaggcagtatgttgaagggcagccattctgctttaaagcaatgtgcaaggcaaattgttttatggagggaaaattctctgatggttcttatgtaaagggttacagatgtgaatcaggtggattccactcggtgtgtgtttgccttttgtgcaaaaattagttatctaaagacaagcggtatatctccttatgttcctatccattatttagaagtattgtccaaataattatacaatagcttagttaaatagtttgtttatttatagacaaatgtagcactagttaactagttgtgattntttaaatttctcagctataaatcaggaaatattttt

SEQ ID NO: 3794 - DNA, 287 bp, Zea mays
  Clone ID: LIB3228-020-P1-K1-C6
gatattctccaacctttttgacaagaaggtcagcatattttcaaagaagaatgtgagatcgtcggaggtgccaccggcatccacttcatcttcttcgcctgggccatttgacgagagtgaatggacgattttgtagttggaactcctgtattgtttctttttgtacaacatgtagagggggggtgccccagagatgtcgggaataatcttaagctgtacatattcagtctaattcattgaacattttgaaataaattgaaaatataaaaattccatgtggtctgagc

SEQ ID NO: 3795 - DNA, 248 bp, Zea mays
  Clone ID: LIB3228-020-P1-K1-C7
catagctgtcgccgccgcctccagcccgggcccctccgcgcccctctcctgccgcggcccggcgcctcgctggcgacgttcgagcgtgagggcgcgcaccggggccggcggcggcggcgggcagagggagtccccgtacgaggtgctcggcgtgtcgccgtcggcggcgcccaacgagatcaagcgcgcgtaccggcgcctcgcgctcaagtaccacccggacgtgaacaaggaggaagaaaaaaaga

SEQ ID NO: 3796 - DNA, 399 bp, Zea mays
  Clone ID: LIB3228-020-P1-K1-C9
gccgcagcatggcatcatcggccgcgctcttggtgctagccctcgcgctagtggcggccaccgccccacaggtagcggaggcaaagaagaagagagcggcggagagcggcgaggcggcggaggcgaagaagatccaggacgacttctgctcgacgctgtgcgagggcaagaaggggacggacctggtcgtgtgcaaggagtcctgcgcgctctcccagcagtccaacctggtgctgtacggcaggatccagtgcaagggcaagtgcaccgagcagaagggcatcacggcgccggccatgaaggtctgccaggaggagtgcgacaaggcgtacgtggtgaaggcggccgaggtcaccaaggcctgcagcgtcacctgcgccaaggagaagaacccgcgcc

SEQ ID NO: 3797 - DNA, 324 bp, Zea mays
  unsure (1)..(324): unsure at all n locations; Clone ID: LIB3228-020-P1-K1-D10
accaccgcccagcaataatggcgcagagcatgaggatngnggcgctggccctggcggccctgctggaggnggcggcggcggcgcccgnggccaccgcgtacggctgctacgacgactgctacgagcgctgcgccaacggcaagaaagaccccgcctgcaccaagatgtgcaaccaggcgtgcggctccacggatcagggcgccggtgccgncggcgccgcgccggcttgatcgcccagcgcattcatcgcttcagctcgatataatcgctgctccgtcagcaacccacatatgattcgatcaattttcctcctctaatttctcg

SEQ ID NO: 3798 - DNA, 405 bp, Zea mays
  Clone ID: LIB3228-020-P1-K1-D3
gttcgttcctcaagtgatcttaatcgtcgagaagttaccagctagcggagatcatcggcaatgtcgaacatggggcaatccttccaggccggcaaggcgcaggcccagggcgagtgccaggcggagcgcgcagcgcagtgcgttagggacggcgccggcgccaccgcctgcgccgtgaccgacaccgccggagccgcggccgacagcgcgcagctgcaggagcaccgcgccgccggcaccgttcagcaggctgctgagcaggtggcgcagacggcggcgggcgcggcggcagccgtcaaggacacggtggcgggcgcggcggcggccgtcaaggacacggtggcgggcgcggcggcaggcgccaatgacgcggtgaccggcggccactgaccgactcacgcgcgt

SEQ ID NO: 3799 - DNA, 407 bp, Zea mays
  Clone ID: LIB3228-020-P1-K1-D4
ggcgacgacaccgcccactctctgtcaacacgaggagagagtagactgcggcagcggagtgcagagagcggacgcaacgcaacaccgtccactctttgtcactgatgatcgaattgaggagcgcactgaagctaaccgccttcgccgccgatgagtcgcctcctctcgcggcagcaccttgccgtcgtccgtcgatctgcaccctttgcgtgcgtgtccaggtgatcccgcctctcgccccctttccccgcgatcaatcgcgcgtgcaaactgaggtgtcgttgcgtggtctgatgcgaattggggggatcgcactaatggtggaaatggaaccatgtgactgttcgccaggctacatgcgtgtgttcacactttccaactgaacaggatatgttttttacacctgc

SEQ ID NO: 3800 - DNA, 389 bp, Zea mays
  Clone ID: LIB3228-020-P1-K1-D5
aggctccccaaagatagcatagcagcagcactcacaatagcaaaaaccaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcagggcgccggtgccgccggcgccgcgccggcttgatcgcccagcgcattcatcgcttcagctcgatataatcgctgctccgtcagcaacccacatatgattcgatcaatttt

SEQ ID NO: 3801 - DNA, 411 bp, Zea mays
  Clone ID: LIB3228-020-P1-K1-D6
tcgcccacgcgtacgcccacgcgtacggttggctgccgctttgccagaaggtggaggggtgctgcgagagaatgttagattatacaaggaggaagagaagaacgaacctgagtttgctaagaagctagcatctgttgctgacctttatgtcaatgatgcttttggcacggcacacagagctcatgctttaaccgaaggagttaccaagtatttgaagcctgctgttgccggcttcctcatgcagaaggaacttgactaccttgttggagctgttgccaacccaaagaagccatgtgccgctattgttggtggatccaaggtctcaagtaagattggtgtcattgagtccttgctggcgaaggtcgatatccttatccttggtggtggtatgatctacacattttacaaggg

SEQ ID NO: 3802 - DNA, 399 bp, Zea mays
  Clone ID: LIB3228-020-P1-K1-D7
cggacgcgtgggcaccggccgtcgagcgagcagtctcccaattccacccaatagctaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgtcgtcgccgtcgtgcccgccgccggggcgctcgtcgactccttcctcgtctactacctccactgagcgacgaccctgcggggctggaacgttgggatgcatcttgtttggtttattccgttaat

SEQ ID NO: 3803 - DNA, 366 bp, Zea mays
  Clone ID: LIB3228-020-P1-K1-D9
cccacgcgtccgggatgaagatgatgtagtggacagagacagcaatgaccctgatggtgatatcgctcatccacagaagcatgccaagagccctgaacttgcaagagaatttctcctggatgctgctgctgttatcttcaaagaacagattgagaaggctttcagagaaggcacagcgcggcaaaatgcacatagcgttttcgtgtcccttgctctaaaactgttagaagaacgagttcatgttgcctgcaaggaaataattacattggaaaaacagaccaagctttttgaggaagaagagaaagaaaagcgtgaagaagaggagcgcacggagaggaggagaacatatgaaaaaaaaatataata

SEQ ID NO: 3804 - DNA, 403 bp, Zea mays
  Clone ID: LIB3228-020-P1-K1-E11
tgatggcaaagatctccacatctctgttactatgccatctattgaggttggcacagttggtggaggcacgcagctggcctcacaatctgcctgcttggacctgcttggcgtcaaaggtgccaacagggaatctccggggtccaacgcgaggctcttggccacggtggttgcgggtgcggtcctagctggggagctgtcccttatctctgcgcaggccgctggccatctggtcaagagccacatgaaatacaacagatccagcaaggatatgtccaagacccttgcagaggaaacagacaaacccaagaaatgctgaataatatcaagtagttgttctatagccctttgggagaaaaggagcagaaagggtcgtacaggatgactttcttgcggcatgctcagg

SEQ ID NO: 3805 - DNA, 410 bp, Zea mays
  Clone ID: LIB3228-020-P1-K1-E12
cgagcaaggagttatagaggatgatgaccactcaccaccgtaagatcgatatgatccgtcccaaggaatttattcctgccctttttgttatcgcgcgttgttttattaccacgcaccagtcaatagtgtggaggcaatatacattgattccccttgactggacaatacaaagataaccttatgtatttcaaaaaaaaaaaaaaaaaaaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcctttttaggggaccaaagtttagtccccggggttggcaagttataaatttttttttggggcccccaaattcaatttaagtgcccgg

SEQ ID NO: 3806 - DNA, 358 bp, Zea mays
  Clone ID: LIB3228-020-P1-K1-E2
ttcaaaaggtgctgatgacattctatcaacctttgttttagggggaaaattctaaaactgacacattgcagtatatgattcaggtaaaatagcctgttcgtttcggattaaagcgaactgtttaaaccgctatatctgcaatctgtgtagagacaaaacactgtcgacactgtttaaaatcaagcaagctgtcactttggagaccgtgactttggagagccttccaatctggacgccagaaaaacatggggaagaaaatgtgggacagcatcgacatgagaaaacaatgcaagttcactactttttcttgccggtgacacccgcaaccacatcatttagaggtggtggaggaactttt

SEQ ID NO: 3807 - DNA, 374 bp, Zea mays
  Clone ID: LIB3228-020-P1-K1-E3
gtgtatataactatgtcatctatagaaataaaagttccgagaatctcttaagtgaaaaaagaaaaaaaaaaaaaaaaaaaaaaaaaaaaaaaaaaaaaaaaaaaaaaaaaaccaaaaaaaaaaaaaaaaaaaaaaaaaaaaaaaaaaaaaaaaaggggggggccgttttaggggatcaaagtttacttccgcgtgcatgcaacgtaatagtttttttatggggccacctaaattaaattaattggccggggtttaaaaacgtggggattggaaaaacctgggggttcccaaattaaatggcttggaagaaaatcccctttttgccagttggggtaatagcaaaaaggcccgaaccgatcgcctttccaaaaagt

SEQ ID NO: 3808 - DNA, 408 bp, Zea mays
  Clone ID: LIB3228-020-P1-K1-E4
cgtcaacaaaacaggtgcacacaaataaatacctggctcgctagattgccaagagcaatggcctttaggtcatccatcctgctcgccatggtggcgctggctacgctattcgcggtcggttcatgcaccaccccgctcaccttccaggtcggcaggggctccaagcctggccacttggtcctcacccccaacgttgccaccatctttgacgtggagatcaaggagcacgggggtgacgacttctcctttacgctcaaggagggtccgactggcacttggacgcttgacaccaagaccccgctcaagtatcccctctgcatccgcttcgctgtcaagtctggtggctaccgcatcgccgacgacgtaatcccctcaaatttcaaggccggcaccacctacaagaccacc

SEQ ID NO: 3809 - DNA, 407 bp, Zea mays
  Clone ID: LIB3228-020-P1-K1-E5
ctactactaccacgcgcggtcggacatgtcggggttcatgcagacgtccttcttcttcggctacatgacctgcgtgtgctacggcttcttcctcatgctgggaacggtcggcttccgcgcgtcgctcttcttcgtgcgccacatctaccgctccatcaagtgcgagtaagcgccggacgtgcgcacgcggtctggcatgctcatggctgttgtttgggtggcttgggatccaattgcagaaaccgtcaccagttgggttgtgcatgaatttatatgctgaagcgccagcagttgccctcagtatggacctcttcgcctttagcctttatatatatacgttggagctcccggagaggaggatctatgtagtgtaggactgtcgccagaggcagtgtctgtattattat

SEQ ID NO: 3810 - DNA, 409 bp, Zea mays
  Clone ID: LIB3228-020-P1-K1-E6
cccacgcgtccgcggacgcgtgggcgacagctcccttgaattcctcatccttgctagtgatggactctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcctgtagggatccctcatgcgtgtgttttcttctggctgttgtatctgatgctcaaagtagatgctccgtgtgtcttccgctgctgttccgcaaggaaactgactcccccgaccgtcgtcgtgatgctgccc

SEQ ID NO: 3811 - DNA, 398 bp, Zea mays
  Clone ID: LIB3228-020-P1-K1-E7
cgcacggagagcaagcaagaaagcaaccaccgcactgccactacctaacaatggcccgcgcctacgtgtttctcgtcgtgctcctcctggccgctgtcatcgtggcaccgttcgcgggagcgacgcgtgtcgacgtcgttgagggcaggtccatggcgtccgccgacgcgccggaggccgccgcaccatcacccgggcctgactccgcctcgtcaccggactcctcgtcggatgcgccctccagcagcagctcctcggactagatagctagccgctcgacgcacgatctcgctctccatctacacggcgatcgagttctagctttgtcggcatgcaatgcaaaattccgattcttcgggaataatcaagcaccaaaggaatgtgcttgcatcactcac

SEQ ID NO: 3812 - DNA, 380 bp, Zea mays
  unsure (1)..(380): unsure at all n locations; Clone ID: LIB3228-020-P1-K1-E8
cggacgcgtgggcggacgcgtgggcgagagtgagttcctcgaggagcaggtggaagccataaataaggtctccaagtatgtcgcacagctgaggagagtgggcaacaaggggcacggggtgtggcactttgatcagatgctgcttcaggaaggggcctgaaggccaacaagggtggcgtggacggagctgagctctgggtggtgtattattttcttttctttccagttggttagtgttttagttgtagaacggtgttgcgttgcccacatgacatgatggatgttacgtggaggattgtctcttatatttgaacattataattgcgntcgtttttgcatggcttttgcccttgcttgactttaaagaatggatctacccc

SEQ ID NO: 3813 - DNA, 400 bp, Zea mays
  Clone ID: LIB3228-020-P1-K1-E9
cggacgcgtgggcggacgcgtggggttcgtctcaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaaaaataaaataaaaaaaatataaaataaaaattaaaaaaaaaaaaaaaaaaataaaaaaggggggggttttttaaaatataaaatttttttatttgttttttttaaaaaaaatttttttttttttgttaattaaattttatttatttggcggtttttaaaaaataatttttttttaaaaaatttttgtttataaaaattaaatatttttgtaaaaaaattcctttttttaatattgggttaaaaagaaaaaggcgcttaaaattttttttttt

SEQ ID NO: 3814 - DNA, 273 bp, Zea mays
  Clone ID: LIB3228-020-P1-K1-F1
cccacgcgtccgcggtatagttgtattctcacagaataaatcagtcactggcttttgctgacaccgcacgagcagctttagtatagaatgatgatcgattgaataagagggtggatattgaactgatgtaatgcctctgccgaaacaatatgtctccctatcttgttaggcgtgttgtgtgttgtgcacgatttcagctgtagcttgtaaattgtacgacccgttgatgtaatgtataccctgcgtttgtgctgagaaatcacttcttttgcc

SEQ ID NO: 3815 - DNA, 400 bp, Zea mays
  Clone ID: LIB3228-020-P1-K1-F10
tgccgaattggtgggagagggtggcgttcgtgcttctcagctttaccatctgcgggatccagcacgtccaattctgcctgaaccacttctcgtccgatgtgtacgtcgggccacccaagggcaacgactggttcgagaagcagacggcaggcacgctcgacatcctgtgccctccttggatggattggttccatggcggcctgcagttccagattgagcaccatctgttcccccgcctgcctcggtgccaccttcggaaggttgcgccggcggtgcgtgacctttgcaagaagcatgggctgacctattccgcagcctccttctgggacgcaaatgtgcttacatggaagacactcagggctgccgcattgcaggccaggagcgccacaggcggcggcgg

SEQ ID NO: 3816 - DNA, 404 bp, Zea mays
  Clone ID: LIB3228-020-P1-K1-F11
cggacgcgtgggcaggttgtacgtcttcctcacctccggcgaccacttcccggggtcatggacggcaatcatgctgacgttcgacaacgcgggcatgtggagcgtgcattccaacatctgggagcggtactacctcggggagcagttctacatcagcgtcgtctcgccggcgcgatcactgcgcgacgagtacaacatgcccgacaacgccctccgctgcggcaaggtcgtggggctgccgctgccgccgtcctacgcccccgcgcgctaagacgacgaaggcctcgttttctcctcgtggtctgaccatccaatccaaactcaaaagaacaaatacgaaagaagcgtagtgaaggggaacaaatgaatggatatatgtaatcttgagatgcatgccctctcaa

SEQ ID NO: 3817 - DNA, 384 bp, Zea mays
  Clone ID: LIB3228-020-P1-K1-F12
cggacgcatgtacaggttgtacgttttcctcacctccggcaaccactggcgcggggtcatgttttttattcatgctcactttcgacaacgcggtcatgtggagcgtgcattccaacatctgggagcggtactacctcggtgagcagttctacatcagcgtcgtctcgccggcgcgatcactgcgcgacgagtacaacatgcccgacaacgccctccgatgcggtaaggtcgtggggctgccgctgcctgccatcctacgcccccttacgctaagacgactaatgcctcgttttcttctcgtggtctgaccatccaatccaaactcaaatgaacaaatactaaagaagcttagtgaatgtgatcaaatgaatggaaatatttaat

SEQ ID NO: 3818 - DNA, 402 bp, Zea mays
  Clone ID: LIB3228-020-P1-K1-F2
tgctcagtggggaatttacgatgcattcaaagtgatggttggactcccaacaacgggaggtgttacacctgccccagcagcagaggctgaattgaaagccagtgcttgatttttttttctgtgttccctgagatcatatttggtggagtggaattgtatcagccggtcgagagcttagttcccgaatcttttttaatcttaacggaaaatttgtccgtcatccttctgatgagaggaactcattaaacaggcgaaataggtctttttttgcgctgggaaaagtttacgcttgatgcataataatttgtaggacggcaacgctctagagcgcaggttttgttcacctcctgtaccgaggaatgcttaaagttacatttcacattatggtctttatgaaagagt

SEQ ID NO: 3819 - DNA, 403 bp, Zea mays
  Clone ID: LIB3228-020-P1-K1-F3
aagctcaaagtctactacggttgagggacaaaggcagagtttggacgaaacacggcagctgcttgatcaaagaaaggagttgattacaaagtacagaggctctgtcgaagagctccttaagggagatcaaagataaagaaagcatcataaagttaatatttaaggatttattgtcgtcaatacttgaactctgttacttgaattcggtggtatgcatcaatagagccggaagatgttctggagtaaggacctggcagtgtgatacgggaatttgacatctgaatagatattctcccttgtccctctggtaaaaaaaactgttgtcacatttgccttcgctgtgacttggatgtatcatgtatatctttgaccattgatatcttggttaatcagacggtgcatt

SEQ ID NO: 3820 - DNA, 403 bp, Zea mays
  Clone ID: LIB3228-020-P1-K1-F4
cgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaaactggctaatcttctatgctgggaggaggaagcggatgccatggaggag

SEQ ID NO: 3821 - DNA, 398 bp, Zea mays
  Clone ID: LIB3228-020-P1-K1-F5
aaaaaaaactgcaccgaggtacacataataaaaaaaaaaaaaaaaaaaaaaaaaaaaaaaaaaaaaaaaaaaaaaaaataaaaaaaaaaataaaaaaaaaaaaaaaataaaaaaaataaaaaataaaaataaaaatattttaattaaaataaaaaattaatatataaataataaggggggggcctttttggggtttccagttttttttccggttttttggaattttttatttttttttttgggtcccttaatttaatttcttgggcggtgttttacaaccttgggttttggaaaacccttgtttttcccaatttttttttctttgggaactttcctttttttgcgggtggggttttaaggaagggggccctccctgattcctttttcaaatatttgcc

SEQ ID NO: 3822 - DNA, 406 bp, Zea mays
  Clone ID: LIB3228-020-P1-K1-F6
cggacgcgtgggtgcgtgatgctgtgttgcttgtgtttgctaacaagcaagatcttccaaatgctatgaatgccgctgagatcactgataagcttggactgcattcacttcgccagcgtcattggtacattcaaagcacttgtgctacaacgggtgagggattgtatgaaggcctggactggctgtccagcaacattgcaaccaagtcctaaattgtcaagcaaggtttggatcatctaggagcctttggatgatgatgatggtgctggatatttagggttgggttggtatttccgtatgtaagatgtatgcccctgagctcggcagtttttgagctctgcttaagattctcacagttaaattgttttatgtaatttgggccttgagatgtttctgaaccaaacag

SEQ ID NO: 3823 - DNA, 196 bp, Zea mays
  Clone ID: LIB3228-020-P1-K1-F7
cccacgcgtccggaatgttatttatcgttccccctgcctatgttttaagtacatctattatctatctattagagatgagatgcttgtgacaagagggactgatgtttgtttcatggatatgatattctcgaatattttatcgctagtttatttttaactaaaccgcggcaaataaaaaaaggagggagtaatattg

SEQ ID NO: 3824 - DNA, 122 bp, Zea mays
  Clone ID: LIB3228-020-P1-K1-F8
cgcacgcgtgggtagtataattcaacatctctctcagcggccattcggtgtagaggttccacgcttacgcgcccgtccatgccacttactacatgtgctatagacatgcctaaattcaatga

SEQ ID NO: 3825 - DNA, 375 bp, Zea mays
  Clone ID: LIB3228-020-P1-K1-G1
tgtacagctggtgaagaacggtaagaagattgccgcctttgtgccgaacgatggctgcttgaactacatcgaggaaaacgatgaggtgctgatcgcggggttcggtcgtaagggccacgctgtgggagatattcccggtgtccgtttcaaggttgtgaaggtctcgggcgtttccctgctcgccctcttcaaggagaagaaggagaagccgagatcttaaaaaccctatccccctcgccacaaatgaatcatgtaatgcttttggagttctgggacctcatgttgagaacctagcgattgttttgccatagttttgtttagaagattctgaattgaattctatatccgtaaccgcttgccagtgcgtgatctgtg

SEQ ID NO: 3826 - DNA, 405 bp, Zea mays
  Clone ID: LIB3228-020-P1-K1-G11
atccactatgagaatatcaagatggaggactcgggctaccccatcatcatcgacatgaagtactgccccaacaagttatgcaccgccaatggtgcctccaaggtcaccgtcaaggacgtcaccttcaagaacatcaccggcacctcctccaccccggaggccgtcaacctgctctgctctgccaagatcccatgcaccggcgtcaccatggacgacgtcaacatcaagtacagtggcaccaacaacaagaccatggccgtatgcaagaacgctaagggcagcgccaagggttgcctcaaggagctcgcatgcttctagaaccaccatcgacccatctctctagttatacaatgtgtttggttgttggatgctgagagattggttctcagctcagatgcaagctgc

SEQ ID NO: 3827 - DNA, 377 bp, Zea mays
  Clone ID: LIB3228-020-P1-K1-G12
ggtttctacagaactatcagaagaattacaggattttgttttctaggtggatcatcaaaatgcatatcctttttttttggctgcgtatagatctgggttcacattgttattgtagtttttgctggctgcttcaataccttatttcattttgtttaagaaaaaaaaaatcgcagggatttagaatgtagtcaatcaaatgtatgaatgttgtatagccatacagatatcttgctgtttcgcatctatgtggataatctggaatggactgctgaagcctgaataagtgaattactctgttttaccatttcgtttgggtgtgtggactgtagaacagttagttttctcggttctcgttttaagcgaagttgttgagattg

SEQ ID NO: 3828 - DNA, 159 bp, Zea mays
  Clone ID: LIB3228-020-P1-K1-G2
cggacgcgtgggcggacgcgtgggaaaaaaacaaattataaaaaacaaaatataagaacgcgggcatcgagcctaccaattcatatgtcttctaaattaaaggaaacgatgaggcgcgtgatgtacagcttgatcaaagggacaacgctgggataaaaa

SEQ ID NO: 3829 - DNA, 414 bp, Zea mays
  Clone ID: LIB3228-020-P1-K1-G5
cgaactcaaaccctaaaaaacggaagccatggattcagaaaggcggaggagggagcggagcgcacaaggcggactagggctccgcgccctcgccggcgcctaaccccacggcgatgctttcggcgctcatgagcaagcgcgccaagcgtgcaggaggagctccggtccatcgagcgccaggtttatgatatggagaccacctacctacaggagactaatcaatttggaagtgtgctgaagggtttcgaatcttttttgtgatactcaaaaaacacctctaaccttaagcgctctcggaaatttcaggctgacgagaggttattctacctgttatgcgctacttctccagcggttgatgaacatttggctggacgagatgatggaagagagtctggagcaggtcgttctaagggg

SEQ ID NO: 3830 - DNA, 83 bp, Zea mays
  Clone ID: LIB3228-020-P1-K1-G6
cccacgcgtccgcccacgcgtccgcccacgcgtccgcccacgcgtccgcccacgcgtccgcccacgcgtccgcccacgcgtcc

SEQ ID NO: 3831 - DNA, 381 bp, Zea mays
  Clone ID: LIB3228-020-P1-K1-G7
cggacgcgtgggaaaaaaaaaaaaaaaaaaaaaaaaaaaaaaaaaaaaaaaaaaaggaaaaaaaaaaaaaaaaaaaaaaataaataaaaaaatataaaaaaaaaaaaaaaaaataaaaaaaaaaaaaaattaatataaaaaagggggggtcctttcccttccatattttttttggcaattttttttttttaaagacccttttctggatgtaaaatttttttatattgggcttttttgggctttttcaaatttttaaacccaaatacttttttttttaaccggttttttattggtgccctttcgtttcacccatttttttgtttttttttattgaaaaaaaaaaaaaaagggctgtccttttttaaattacaagtttttttt

SEQ ID NO: 3832 - DNA, 397 bp, Zea mays
  Clone ID: LIB3228-020-P1-K1-G9
tcccatccgagtgtcttctactgctccggcgccgtcgccgccgtttacctcgtctgcgcccgccgaagccatgccgtcgcacaagaccttgcggatcaagaagaagctggtcaagaagatgcgccagaaccgccccatcccctactggatccgcatgcgcaccgacaacaccatcaggtacaacgcctagcgcaggcactggcgttgcaccaaactcggattctgagcggtggaagaaatgctggctaaagacgcctagagggtatagggctctgcaagctaggaagctcttgtttaattttttttgcttgtgttatttgtcattgcagtaccatgttttgtctgatggttaaagaaccgtctttatgctatggtgaatttatttaaccttgcagcg

SEQ ID NO: 3833 - DNA, 401 bp, Zea mays
  Clone ID: LIB3228-020-P1-K1-H11
gctactgccgggaccattggggtcttaccaccagggctccaggggttgcccaggctctgctgcactgtgcgcagattgctaccgccatactcctgtacgtctgcaacctacagtttgctctcgtgtacgccatcggattgagctatgcgttgatgatgttgcacgcctcgcttcggaagttgactccctcgagtctaccagatcccagcagcaagaagaacaggagggcgcagccgagacggatctaggttaacatgccggacagtacagatgttcatcaggacataaactggagtattatacgcacacactgaagctccgcccttggatttaatcctcagctttcttttgcaatataatattagctgatcgttgatcaaaattaataaaatttgtgtttt

SEQ ID NO: 3834 - DNA, 404 bp, Zea mays
  Clone ID: LIB3228-020-P1-K1-H2
agatgagcctacagaaaaaattgatttatcttgttttttgagtattcttcatcgtgatcccgaggagaaaagtcgcaattgttggacagtacctgatagcaagatcttcaaagttcgtagcaaaaacttcccacaagacaaatcaaagatacctgcagcaagttatctcatggagcttgcagccattgactggtttaaggacaccaaacgtatggataatgttgccaggcagaagggttgtgttgctcaggttgctgctgatcgagggatgcatacatttgttgtcaacatacaaattcctggatcaactcagtacagcttggtcatgtattttgtcacaaataccttgagaaagggatccttactacaacgcttttttgatggcgatgacgaattccgcaata

SEQ ID NO: 3835 - DNA, 67 bp, Zea mays
  Clone ID: LIB3228-020-P1-K1-H4
aaaaaaaaaaaaaaaaaaaaaaaaaaaaaaaaaaaaaaaaaaaaaaaaataaaaagggaggaaggtg

SEQ ID NO: 3836 - DNA, 370 bp, Zea mays
  Clone ID: LIB3228-020-P1-K1-H5
cccggaacgaccgacgcgaacgaacgcacggcgcaagctctcgcgccgagcaccatacccaacgcgaccaacaactacgaacgagagagaacgccgtgagcgcgaacggcgaccgccaacgcgaagagccggacaagggcggcggcggcggcggcggccaccacaagcacgagggctacaagaacaaggaaggcaagggaaacctgaagccctctcaatgcgacggagagtgccggcagtggtgctacaagacgcaccacatgaagccgtgccttttcttttgcaacaagtgcagaaccaagtgcctgtgcgtgccgtctggcacctactgcaacaaggagacctgcccctgctacaacaactggaagac

SEQ ID NO: 3837 - DNA, 360 bp, Zea mays
  Clone ID: LIB3228-020-P1-K1-H6
cccacgcgtccgccgagaaatgcaagccgtgggggagccgttaccgccgccagcctctcctgcccccgttttcgttgccgtttcttcattagcgcgaacaaagttttgtgccggtctatcggccgccgctttcctcccctattcatcaagactgcaataactgtcgctacctatgcttctcacctgtgatttttggacacaatatgttaaggtccattcaattctaatgagacgcctgatgaggctactagcaaacaacaccatgtgttcggattgtcattggttattgatgtcttgtgaatgaataatataaattttttttggtcactttgagctcaaaaaaaaaaaaataatattatt

SEQ ID NO: 3838 - DNA, 399 bp, Zea mays
  Clone ID: LIB3228-020-P1-K1-H7
ggagaacctcatgtccaagcttaacccctccgcgcaggagttcgtgccgtcgtcgcgccgcacggccccagccgccgtgtcggcggcgaagccggcgggaggaagggtgctctcagccgacgcgcccgtgttcgtgtccgccgccgagtactacggcgctgccggcgggcacctggagataggcggcggcggcggcaaagtcgtcgttggcggcgagggcagggactccagcagcgacggatccagcaacggcggcggcggcggcagtcgccaccaaccgaatcgccggaggaggaacagcttcaaccacgggaggcgggagggggccggaggccggccccggcggggtgatagggaggacagcgtgcgccggaccgtctacgtgtccgacattgatca

SEQ ID NO: 3839 - DNA, 302 bp, Zea mays
  Clone ID: LIB3228-021-P1-K1-A10
caggcagcgagaggcatcatctcagccagaggcagtcttcttctgctggaatatgactgcatatggagacttgttttgagcgacatttttttgaagttaaaagcttggacttcatcctatcttggttgttgcctgatactgcattttcttaccataagttgtaacctcgtttcttgcggtttggtgtaggacacgacttttctgttaataatgttgtggcttgaactttccaggctgtggagattggtgaaaactcagcgctgatatcatttggtaaaaaaaaaaaagggtgtaaaatattt

SEQ ID NO: 3840 - DNA, 296 bp, Zea mays
  Clone ID: LIB3228-021-P1-K1-A11
cccacacatccggggacgcgtgtgctcaagtaccgatgctaccaccagttgtgggtctacctcctgctcacctttctcggctacatccccggaatgatttacgccatttaccccatcaccaagaacaactagctaggcattcttgccgaccaccatccatgtctctttatctgcgttttgtcatattcctgatgcccacttgggctggatgcagttgcttgaattcaaacgtgttttgctgccgtacccaccccatgcatcatctgtcaccgcgacgcaataatcataggaataac

SEQ ID NO: 3841 - DNA, 392 bp, Zea mays
  Clone ID: LIB3228-021-P1-K1-A3
aaatcatggcatgtgcttggcttatggtacaatccaaccattgagcgctcagagatagacaatgctgctgtcatccactacaatggtaacatgaagccctggctggaaattgcaatgataaagtatcggccttactggacaaaagtcatcaattatcaacattcctacattcatggatgcaagatcagccaatagaaaccaccctcagatattcttctgtgatgaacattgaagttggatgggactcaaaatgaaatcagtataactatcacatgttctttattcgtgttatattagatttggtagttatcatgtgtatgtaggttcggcggccttttggggtgctttttcccctaactcattgttgggtcttggctccttttggcatgaaa

SEQ ID NO: 3842 - DNA, 400 bp, Zea mays
  Clone ID: LIB3228-021-P1-K1-A4
acttcttgagcgatttaatgagcatcaacaacagctacaacagtagctgcagcagcggcagcagcagcggaggaagaaaagtttatcagactcgagcaagagcacgagcagatcttggacatgacatggaagaatgattgcatcgctgaacttctcggcgacatagtgaggaccaccaagcaccttagtggaaattgagtttattgcttgtagtcttgggagtcagagcttgatttcaaggcgaagcaaaatcttgtagagaaggctgaggaactgcctcgtgtagcctgtttcctaaaatagtgttcagtttgtttacttgcctgtagcttctttattttttatttgcttattccatgtaaccggataataattaatgtatttctatactcaatttttc

SEQ ID NO: 3843 - DNA, 413 bp, Zea mays
  Clone ID: LIB3228-021-P1-K1-A5
ggctggctcgctgcccgccggcttttaagagcgcgctaggacagtaggacgcgaacgagtctgcggccagccagcaagcagtgcgagtacaggcatggcggctgccggcggacgcgcggttgcggtggcagccatggtggcggtggtggcggcggcggcgctgcctctgctcgcgtgtggcggttacgcggagtgctacgactactgcttcaaggactgcatctccaaggacaagtccatgagagactactgcagctacgcctgcgacaagacctgcgcgcccgacgcccggcagcggcgccccgcggtcgtccccatgaactgccagctcgcctgcgtcagggagtcctgccaccgtcgccgcgcggctgatggcgacgacgacacgaagacgaatgcctgctacgggcagt

SEQ ID NO: 3844 - DNA, 269 bp, Zea mays
  Clone ID: LIB3228-021-P1-K1-A6
cccacgcgtccgatcaccggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcggcgccgcctcggccaccgccgtgctggccttggtcgccttcgaggcgccctccgaggcgcccgccggctctgacggtggtgctggctggtcctagcgcaa

SEQ ID NO: 3845 - DNA, 404 bp, Zea mays
  Clone ID: LIB3228-021-P1-K1-A7
ggctccccaaagatagcatagcagcagcactcacaatagcaaaaaccaccatccgtcgtcgccaaccgtagcaagaacatcaccaccgcccagcaataatggcgcagagcatgaggattgtggcgctggccctggtggccctgctggtggtggcggcggcggcgcccgtggccaccgcgtacggctgctacgacgactgctacgagcgctgcgccaacggcaagaaagaccccgcctgcaccaagatgtgcaaccaggcgtgcggctccacggatcaaggcgccggtgccgccggcgccgcgccggcttgatcgcccagcgcattcatcgcttcagctcgatataatcgctgctccgtcagcaacccacatatgattcgatcaattttcctcctctaatttctc

SEQ ID NO: 3846 - DNA, 292 bp, Zea mays
  Clone ID: LIB3228-021-P1-K1-A8
ggtcatcactatgtaaaaaaaaaaaaataaaaaaaaaaaaaaaacaaataaatacaaagagataaaaaaaacggggggccgccgtactagaggaaacatgatttacgaccgcttcctacaaagtaaaagttctattatagggccaaaaaaaaataaactagccgccgttttataacaacgtgacgagtaaaaaacccccggtcccaaccaaattaatcgggttgaaaataatccttttctcagctggtggatttataaaaaagaggccaccacttgtcgcttctaacaatat

SEQ ID NO: 3847 - DNA, 118 bp, Zea mays
  Clone ID: LIB3228-021-P1-K1-B11
gtcatacagtggatcaaccgtagcttgtacttcccagctcccccactcttgaagggctactgatacctttcctattgcgcgatctcagatccattcatttacgctggttcaacctact

SEQ ID NO: 3848 - DNA, 269 bp, Zea mays
  Clone ID: LIB3228-021-P1-K1-B3
catacaaatactctatacgcaccacgcttaaaatcaaatttaaaaaaggggcggtcgatctagaggatccaatcttacctacggctacttgcgaaattatacctcttctattgcggcacctaaatacaattaactgacctgcgttatacaccattattattgcgaaaacccttgtatgtccgaacttaatcgacttgcaagacatgcccctttgctcaggtggattataaccgatgaggacagttcggatctcttttccgaacaatctc

SEQ ID NO: 3849 - DNA, 154 bp, Zea mays
  Clone ID: LIB3228-021-P1-K1-B4
ctagcgggcaccgcgttcattgccatagccaagaagggcgaggagtagaaatagggcggggcgggcattatttacatgcattttcagaaggtcaagtgcaagtttggttctaagtttacacctcacttggagaatgggtgcaacctttactacc

SEQ ID NO: 3850 - DNA, 108 bp, Zea mays
  unsure (1)..(108): unsure at all n locations; Clone ID: LIB3228-021-P1-K1-B5
accntccgaatcccgggcgccacgcgtccgggcttgagcagtcaacttgtgtaggcatcggtggtgacccattcaatggcacgggggttagcgattgtcttgaaaaat

SEQ ID NO: 3851 - DNA, 410 bp, Zea mays
  Clone ID: LIB3228-021-P1-K1-B8
gtttctgacccagagtttctcgcacaaccaatgttgttaactgaatagttaaactgaataaaaggtatgatgtttcacatttttaattttaaaaattatttcttttattataggcaagaggttacctctattgaaggagatgacaggtgtctattattatagcagtaaatcatctttgttgctcctactacacccgttttgagctagaaatttcgtacttaatcaccattacaatatgacagaagtgtaggatatgcacaaaagcacttattgagttgagtggtaatatatactgccaactccaagggaatttgattttattactcaacgtttatgcctttcatttactaccttcattttttttccagaagtgtttagtgcatcaacatttgtttcagtaaatgtctttg

SEQ ID NO: 3852 - DNA, 418 bp, Zea mays
  Clone ID: LIB3228-021-P1-K1-B9
cccacgcgtccgcccacgcgtccgcccacgcgtccgctcgcctatgatgggtttctctccaaggtgccgattcctcctggacaagtttatgccataaatgatgcgttgtcagctgaaggagcggcagacgactacgaagcgtgcctgaagcagcttgttaagaacggtgtgatttctatgtcagcggcgactggatttcctaggtttgatctccagcttctgggaatgggacctgatggccacattgcgtctctcttccctggccaccctcttgttaacgagaaagagaggtgggtcacatacattaaggattctccaaagccacctccagagagaattacattcacgtttccagtaatcaactcatccgcatacgttgcgatggtggtgactggagctggaaaggcggcagcggtgc

SEQ ID NO: 3853 - DNA, 222 bp, Zea mays
  Clone ID: LIB3228-021-P1-K1-C1
gggcgaataagcaccaagccctccgcttggatcgaccatcgtgcgcgtcccttgctcgcgtcgagagatttccaacgccgagctagcgcacagggaaaggagaggaaaggtgggtgcacccgggggaccaagggaacctgaactaacaactatcggttcctggaggtggggcccggggaatcttccggcctggaaggaggaaggtggaaccactttttccgg

SEQ ID NO: 3854 - DNA, 378 bp, Zea mays
  Clone ID: LIB3228-021-P1-K1-C10
ccctcgtttctgtcgagcagtctcgtcctgcactttcacatcttccacggggggggcgcggtcagtttaaccatggcggactccaaggccacctttacggtcaccctccgcaccctcaagttcatgaccaaccgcctcctggcccgcaagcaattcgcgcttgtggtgatccaccccggccgatccaacgtcttcaaggcgggggcgaaggagaggcttgccaaggcgtacgaggtgaaggaccccaacaacatctttgtctttatgttccggacccactttggaggaggaaagtacactgttttcggtctcatctactacaacctagaggctgccaagaagttcgagccgaaataccggcttttcacgaatggtctt

SEQ ID NO: 3855 - DNA, 353 bp, Zea mays
  Clone ID: LIB3228-021-P1-K1-C11
acgtggtgctgccaccagtcaaatcggtaagcctgctgtccacatggcgagtgttgacttaaaaggaaaagcatatgagttgttgagacaaaattcttctagcttcatgatggaagacatctaccgaaaccctgggccacttcagttcgaagggtcaggtgctgatacaaagcctatttcattgtgcgttgaagatcaggattacatgggaagaatcaagaagttgcaggagtatttggagaaggtgaaaagcattgtgaagcccgggtgctcgcaggatgtccttaaagcagcggtaagcgccatggcttctgtgacggagatgttgaccatcatgtcttccctttcattta

SEQ ID NO: 3856 - DNA, 410 bp, Zea mays
  Clone ID: LIB3228-021-P1-K1-C12
ggcaaccagtggaacaacgggggcatgtactacgcggcgcccccgttctacaacggctacggttaccctgcggcggccccgttccctgatccaggcatgtacgctgctccagcctacggtgcctacccgttctatggcaatcagcagcaagtgagctgacctggactaccgcgacacgcacgcctcgctcggagctggagactggaggtgttaggcgcttaggtgtagctctcggtagaagaagaagaggaagaaggtagacgacgacggtttcttaggtgagctagataccgtgactagtctcgtatagtgcgatttgttatacgtgctatggtctagcgccgccgacgactgagagtccgagtgtccgacacacctattgactggccacggcatgtcgaattgaacga

SEQ ID NO: 3857 - DNA, 353 bp, Zea mays
  Clone ID: LIB3228-021-P1-K1-C2
gaaccagaaagcaaacgcaaacaagaagcaaaccagcaatggcccgcgccggcgtcttcctcgtcgtgctcctcctagccgccgtcgccatggcgccgttcgcgggcgcggcgcgcatcgacgtcgtcgagggcaggtccatggcgtccgcggacgcaccggaggccgtcgtcgacgctcccgctcctgctcctggccccgactcctactcgaccccgtcggcggcacccttcagcagcagctctttcgactagccgcccggcagagatatctacggcgtccgatcagtctttggcgccacctataacctatcggatcctgcaaagctatatatgattctatgggataatgtg

SEQ ID NO: 3858 - DNA, 324 bp, Zea mays
  Clone ID: LIB3228-021-P1-K1-C3
gcccaccatggcatcatcggccgctctcttggtgctagccctcgcgctggtgggggtcaccgttcttcacgtagcggaggcaaagaacaagagagctgcggagagcggagaggcggccgaggcaaaaaagatccaggactacttctgctcaacgctgatcgatggcaataaggggacggacctattcgtgagcaaggagttctgcgcgctctcccagcagtccaacctggtgctgtacggtaggatccattgcaagggctagtgcacctagcagaatggcatttcagcgccggccatgaatgtctgccatgtggagtgcgacaa

SEQ ID NO: 3859 - DNA, 324 bp, Zea mays
  Clone ID: LIB3228-021-P1-K1-C4
cggacgcgtgggtagaggtgatcttggaagggaccagcgccggagcaggagccgaagcagagaccgtgaaagggaaaggaggagggagaggagaagagaacatgattatgagagaagggagcgtgaccgggatcgggaccgccgccataggtgaagatagaaataacaaggctttctgttcgtacactgcatttgccaatttttgtagccatgcgacccgtggtcttgtgttagtaactgggggcgtgcattgttgctctgaatctgatttttgctttgaatgattcgctgcactggcattttattcagatattctgtttcttc

SEQ ID NO: 3860 - DNA, 418 bp, Zea mays
  Clone ID: LIB3228-021-P1-K1-C5
agaggagagagcaacgacgccatcggagggaggaaagagaagaagacgatccgctagcgtgtgcgtggcgacgagatgtggcggaggcgagtgggcgccctccttctccgatctccacgaacttcttcctgggcctcctcgtcctgccagagccgccgccaccatcttctccccagcgaggaacctcttgctctcaaccgtcttgccaggctcttcacgtcccaggctggaagtgatggtggcgatacccagaagccctttattgcttttgtcttaggtggtcctgggagtggcaaaggaacacagtgcactaagattgcttcggattttggatttgcccatctgagcgctggtgatattctccgacatgaaatagcatctggcagcgagaaaggggagttgatcctagaaatcataa

SEQ ID NO: 3861 - DNA, 417 bp, Zea mays
  Clone ID: LIB3228-021-P1-K1-C7
cccacgcgtccgcccacgcgtccgggacctgaaagccagaatagatggccctgctcaggcttttgtggtggaggcaagggtggacaggggcaggggtccactcgcaacagctatagtcaagtatggcacattagttagtgggcaacacattgttgtgggagcagagtggggaaggattaggtctcttagagacacagcagggaatataacgcagtctgcaaaacctgcaatgcctattgagattgaggggttaaagggccttccaatggctggggatgatgttgtagttgttgattcagaggagagggcaagaatgctaagtcatgggcggaagaagaagcaggagaaagacaggcttcgaaaaattgatgaggggatggcagaggagctagaaattaaagaaagagactcctgaag

SEQ ID NO: 3862 - DNA, 234 bp, Zea mays
  Clone ID: LIB3228-021-P1-K1-D1
cctcgacatcttctgacggaccgagctcgccgcctccatcgtttgtttatcttctaggtcccttagcttcacgtacatccatggcatcatcgccgtcgatacccatgttcttgcaccggttcctatcctacagattttgtgtgtgtgtgtgcgcgcgcgcgcgcgctggggtggggggtagggggatcattgattgttacagtacgttgcaataaaatggtacagtattacgca

SEQ ID NO: 3863 - DNA, 226 bp, Zea mays
  Clone ID: LIB3228-021-P1-K1-D10
cccacgcgtccgcggacgcgtgttcttaagtacgggtgcggccacgagtggtgggtctgcctcctcctcaccttcctcggctacattcccggtatcatctacgccttctacgccatcaccaaaaacaactagctagtcatccttgcctactacgatccatgtctctgtattttcgtcttgtcatatgccttatgccaacttgtgctgtttgtagttgcttgaattc

SEQ ID NO: 3864 - DNA, 100 bp, Zea mays
  Clone ID: LIB3228-021-P1-K1-D11
agccacacatacgggggcgcctgttcttaagttccaatgctaccaacaggtgcgggccaggctacagctcaactatctcggctacattaacccaaatcat

SEQ ID NO: 3865 - DNA, 365 bp, Zea mays
  unsure (1)..(365): unsure at all n locations; Clone ID: LIB3228-021-P1-K1-D3
acgaaatacagtcaggatttttttgtgattttttacttgatctgtgagcgaacactgggtctttcaccttgtcatccaatgggttctgctccttggtgaaatctcccaccagccagtaaagaactgggttgttttcataatatatgcttttgctncgcanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgctttaaaggatccaagtttacttccgcgtgcttgcgacgttatagttttttttttgggccccctaaattaaattcactggccggggt

SEQ ID NO: 3866 - DNA, 198 bp, Zea mays
  Clone ID: LIB3228-021-P1-K1-D8
tcggttcgttcctcaagtgatcataatcgtcgagaagttaccagctagcggagatcagcggcgttggcgaacatggggcaatccttccaggccgtcttggctcaggctccatggcgagtgccaagcggagtacgcagcgcatttcattagggacggcgccgtctccaccgtctgcgccgtgaccgacaccgcctgagc

SEQ ID NO: 3867 - DNA, 350 bp, Zea mays
  Clone ID: LIB3228-021-P1-K1-D9
tgtgacttgactaggcccatctaagcacactacatctccgggcgaggcggttaagggcggttcaccgtccactggcgactgggccgtccgacgttgccgccctgcctctccaccgtctccggcaacaagcaccaccaggtgtttattgtgtctctgatgcttagtgttgtggctcatgtccatgttcaataggatcttcgggaagcccaagtagcagtgccaactccaatgctttgtccactctggtcaagctaaatgttacacttgttctgctgttgtagaaagatatggtgctggtgaaaaaatcttactcctgatctttagagaaccttggagttcttgtttagcaa

SEQ ID NO: 3868 - DNA, 86 bp, Zea mays
  Clone ID: LIB3228-021-P1-K1-E1
aaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3869 - DNA, 377 bp, Zea mays
  Clone ID: LIB3228-021-P1-K1-E10
cccacgcgtccgatccagtttgtggactggtgcccaactggctttaagtgcggcattaactaccagcctccaagtgtggtgcctggtggtgacctggccaaggtgcagcgcgctgtgtgcatgatctccaactccaccagtgttgtggaggtgttctcccgcatcgaccacaagttcgacctcatgtacgccaagcgtgccttcgtgcactggtatgtcggtgagggtatggaggagggcgagttctctgaggcccgtgaggatctggcagcgctcgagaaggactacgaggaggttggtgctgagtttgatgagggtgaggaaggtgatgatggtgatgagtactagaagtattctgatgcggtcatcgtcaggct

SEQ ID NO: 3870 - DNA, 355 bp, Zea mays
  Clone ID: LIB3228-021-P1-K1-E11
cccacgcgtccgcggacgcgtgggctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcaataatcatagtaataacaagttcagagattgattcaaataaaaaaaaataatagaaaaatagaaaattttataaaa

SEQ ID NO: 3871 - DNA, 408 bp, Zea mays
  Clone ID: LIB3228-021-P1-K1-E2
gcagctcccaactgcaaggttctggtggttgccaacccagcaaacaccaatgctcttatcttgaaagaatttgctccatctattccagagaagaacgttacttgcctgacccgtctggaccacaacagggctcttggccagatttctgagagacttaatgtccaagttagtgatgtgaagaatgttatcatctggggtaaccaccctctcagtaccctgatgttaaccatgccacagtgaagacttccactggggagaagcctgttcgtgagcttgtctctgatgacgagtggcttaatggtgaattcatcacaactgtccaacagcgtggtgctgcaatcattaaagcgagaaagttctccagtgctctctcggctgctagctctgcttgtgaccacattcgtgatt

SEQ ID NO: 3872 - DNA, 130 bp, Zea mays
  Clone ID: LIB3228-021-P1-K1-E3
atgtaaaattttgttttttgaaaaaaaaaaaagaaggaggaaaaattgttttagaaaaatattgttaaaaataaaagaggggggagttttattttaaaaaaaaaaaaaaaaaattaatgtttaaatgaaa

SEQ ID NO: 3873 - DNA, 281 bp, Zea mays
  Clone ID: LIB3228-021-P1-K1-E4
gagccgtggaaacatgtggagagagttttcaccgatttgataagtacctaaatttctcaaacccaaatattgcccagaattttgatcctatgcatgtggttgggctaatggattgaccttgttggacctggaagattggaagaggaaggcctttcctggatttattaccaatgggcggacctggaccaggaccggctggtcttgaaaccggggacattggcaacagggcttcttactttttaccagctgacacaccctctggacaaatcatggcatgtgct

SEQ ID NO: 3874 - DNA, 425 bp, Zea mays
  Clone ID: LIB3228-021-P1-K1-E5
ctccgcgtgacttggggcgtcgtcgccgagctttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccgggacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttgg

SEQ ID NO: 3875 - DNA, 418 bp, Zea mays
  Clone ID: LIB3228-021-P1-K1-E7
cctctcagaaggtaaatcaaaagtacaagagcgccagcggtccaagctatcagaagaggctgtggaggaagctgaagacgccgtctctgcaaagcgcctctcggagcttgaggagaaggtcattgcactcctgacaaaacccgcatcaatgcctgctgataaggaggaggttctgcaggctgctgtctcccgcgttagtgcactggaagaggagcttgcagctacaaagaagaccttgcaggagactcttgagcgtcagttggagatcgttgcatacattgagaagaagaagaaaagcaagcgtttctttcgttggtagaagcaaacagcagtgaattgttcacgcccacgagaaaaaaggttttgcgtgtgatggaagcgagctggtgcttgcgtatgccagcaagctgcgattctg

SEQ ID NO: 3876 - DNA, 143 bp, Zea mays
  Clone ID: LIB3228-021-P1-K1-F10
ctttttcgtgaggtccaaattttattttcacacgtctcaattatacgagtggggggatccattattcatacacattactaccacacacatttctactgcctttagtaacattatattctctccccttaccaaacattctcttc

SEQ ID NO: 3877 - DNA, 138 bp, Zea mays
  Clone ID: LIB3228-021-P1-K1-F11
tcgctgtcgcgtgggcaggttgtacttctttctcacgcacgatctaccacttgggggggtcatggacggtaatcatgctgacattcgacatctcgggcatgtggagcgtacattccaacatttggtagcagtacttcc

SEQ ID NO: 3878 - DNA, 89 bp, Zea mays
  Clone ID: LIB3228-021-P1-K1-F3
cggacgcgtggggtgaattgcatgcatggacatgcaacgctccaatggcctttggaatgaggaattatataagaaccagttcatttttt

SEQ ID NO: 3879 - DNA, 98 bp, Zea mays
  Clone ID: LIB3228-021-P1-K1-F4
tcgaggactgttttagctatgccagttatgaagatatgttcttggatgcctctggtgggggttattgtgaccttgttaagagggtccttcggtgcttt

SEQ ID NO: 3880 - DNA, 369 bp, Zea mays
  Clone ID: LIB3228-021-P1-K1-F5
cgaacgccaagggcagcaccaagggttgcctcaaggagcttgcatgcttctagaccctccatcgactgacccatctctctaattataatttttctcttacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatattaaaaaaattataaaaaaaaataaaaaaatattaaaaaaaaaaaaaaaaaaaaggggcccaccttaaaaagaaaaaaattacataccgggtgaaaaaaatatataaaattttttaataggccccctaaaaaaaattcatttggccgggtttataaaaaagggggggtgaaaaa

SEQ ID NO: 3881 - DNA, 130 bp, Zea mays
  Clone ID: LIB3228-021-P1-K1-F6
taaacgcataggttctaacaagttgttttgtttatgttttcttaaaagggcggccggtctagatgatccaagctttcgcacgcgtgcttgcgacgttataactgtattatattggcccgcaaatttattt

SEQ ID NO: 3882 - DNA, 221 bp, Zea mays
  Clone ID: LIB3228-021-P1-K1-F7
tgctcactggagaatttactatgcattcaaagtgaaggttgtactcccaacagcgggaggtgtttcacctgccccagcagcaaatgctttatcgaaagccggcgctagttttttctttctgtgttacatgttatcacatttggtgaaaagtaattcattattcgtcatagatttagcttcctattctattttatgtaacggaaaaaatttttgcatccttt

SEQ ID NO: 3883 - DNA, 315 bp, Zea mays
  Clone ID: LIB3228-021-P1-K1-F9
ctcgtctcaccctccctccctcacacaaataataaggaaaggtcccgcccttttcctccgacatccacaaggggggaggggaaaacacgtacattcacccggcggcaataatggcctcggttccggctccggcgacgacgaccgccgccgtcatcctatgcctatgcgtcgtcctctcctgtgccgcggctgacgacccgaacctccccgactacgtcatccagggccgcgtgtactgcgacacctgccgcgccgggttcgtgaccaacgtcaccgagtaaatcgcgggcgccaaggtgaggctggagtgcaagc

SEQ ID NO: 3884 - DNA, 353 bp, Zea mays
  Clone ID: LIB3228-021-P1-K1-G1
cccacgcgtccgcggacgcgtgggtgatacccggtcatggcgatggatctaatgtgccagtcatggatgacacaggttgcgacatgccaggcaagaacagtgcccgaccaaggagtcccagtgatcacagaaaacgcaatgctggattttatgtacaacaaagatcaagccgttaatatcgacgccacacatcctagtgatgctacatacattgctagtcttcaagatgatgatgacatgaaagagcaagcatgaatggtacatacaaatgtgctattccatgcattaaggaatgatgctcaaaaattttgcatatctctcctgaaagggaaatattattggggcccgatact

SEQ ID NO: 3885 - DNA, 200 bp, Zea mays
  Clone ID: LIB3228-021-P1-K1-G10
cttatgtttatgataagaagctagcaccatttcttgagatggaaaccttggttggtttcaatagggaaccacctttagaagtctcaaaaacctaaacaatttaaaaaaagttctcctttgatcttttaaaagtaaaggtttgttaaattctaataccttcccgttgtgaaccgattctatttgtgcactgaaatttttcc

SEQ ID NO: 3886 - DNA, 448 bp, Zea mays
  Clone ID: LIB3228-021-P1-K1-G11
ttttgagtactataaatttaaaccccattttttctctcaatccatttcgatgtggtgagaacctaacattgtcctaaaaaagatatttaagctattaaaaagctcaatgtttttaaaaataaaaatttttttttaaattttacctacttttttcaccattttttttattaaatttttcttcttttttttccaaaatttctttaaattttttctaaaatttattttcgtatttttttctccatatttcttatttttatttctccccacaaatattttattcacctttttttttcaataaatttttttttcggttttgctctccaactaattttcatataatatttttctctataatatttctttttaaatatattttttttaaaatattttttacataaattatttttacacccatatttttttacacatatatttctccataaaattt

SEQ ID NO: 3887 - DNA, 242 bp, Zea mays
  Clone ID: LIB3228-021-P1-K1-G12
gctagtgctaggcacgcgcgccgccggggattagtttttttgtcattgtaattagaaatcggcctgattaattgatttcgttgctatgacatttaaattgatgtcgtggcaatcaacaggcaaaactatatagtatatgagaaatatgctcgagttctcgtgtgattcgtatcgtcctcgtatatatcttatatgaggaaaacatgacggcagaattgattctacgtacattatctgggtca

SEQ ID NO: 3888 - DNA, 409 bp, Zea mays
  Clone ID: LIB3228-021-P1-K1-G2
cccacgcgtccgcccacgcgtccgcggacgcgtggggagaggtgaaccagcaggctccaataaaagccagcacatccaaataaaaccgagagacctcagccctcaggcaagccgaccgccgacgtaccaccgcgccaacccgagagaaagatggagatgatcaagaggatcctcatcgccgcgctcctcgtagtcgccgtctcggccaccgcagtgctggccttcaccgaggccggcgccgccggcgccccattcgcctacgagtggtcagcgtgcgacgaagcccccactggcgcccgcggcgccgtatgcagcgcgcgggccgttgtggttaccctcagcagggaccgttaaacttgccattggccttaagtgcccacgaatttttgctttttttgcttttcttttt

SEQ ID NO: 3889 - DNA, 364 bp, Zea mays
  unsure (1)..(364): unsure at all n locations; Clone ID: LIB3228-021-P1-K1-G4
gaaccagcagcctccaataagagccagccagagaaactaataaaactctcgccgccgccatccgagcgaacaagccaaccgaccccgtccccaaggcaatccgccgccgacgtaccaccaccaccgcaggagcgagatggagatgaagaggatcctcttcgccgtcctcgtcgtcatcgccgcctcggccaccgcagtgctggcctccaccgaggccgccgccgcgggcgccccaactggctccgagtcgtccgccgaggcttccgcttgcgcttgcgcttgcgctgtcgctggcgccgncgactatggggccttcggcaggagcggtgcgcccgccctttgcggcgggcccggcggggttctt

SEQ ID NO: 3890 - DNA, 162 bp, Zea mays
  Clone ID: LIB3228-021-P1-K1-G5
attttgagtactagggaattgaaaccccatcaattcctctcaatccatttcgattgtggtagaaccgaacatgacctaaagaggatatttaggctataaagaggtcaaatgtgttaaaaaaaaaaaaaaaaaaaaaaaaaaaaaaaaaaataaaatttttat

SEQ ID NO: 3891 - DNA, 344 bp, Zea mays
  Clone ID: LIB3228-021-P1-K1-G6
tccacgcgtacgcccacgcgtccggaaattctcagcttcaaccctgcgcaagacaaaacaaacagttgatgaggttcgcgccacagtcactgaacttcagaatgccattagagttctcagtctgttatctgttgcatcaacgtaccactcccatggttttgatgagaggaaaatagaaactcatgttgagtactgtaaacatttacttgatgctgctaaggttcatcgcgatgcagctgagcaagctgaacagcagaataagcaaaaaatggaagttgctcgtcagatcgctctgtcagaggaagctcgccgaacggcagaagagcagagaaaatttcagttga

SEQ ID NO: 3892 - DNA, 325 bp, Zea mays
  Clone ID: LIB3228-021-P1-K1-G7
ggacaaggagggcatccccccggaccagcagcgtctgatcttcgccggcaaacagctggaggatggccgcaccttagcagactacaacatccaaaaggagagcaccctccaccttgtgctccgtctccgtggtggtcagtaagtcatgggtcgtttaagctgccgatgtgcctgcgtcgtctggtgccctctccatatggaggttgtcaaagtatctgctgttcgtgtcatgagtcgtgtcagtgttggtttaataatggaccggttgtgttgtgtgtgcgtactacccagaactatgacaaatcatgaataagtttgttgtttg

SEQ ID NO: 3893 - DNA, 111 bp, Zea mays
  Clone ID: LIB3228-021-P1-K1-G8
cccggtcgacccagcgtccgcccttttttcgtttgacactcatgctacggaaaccttgagccactatacaacagatgggcataaatattttttccttacaacctaacccat

SEQ ID NO: 3894 - DNA, 412 bp, Zea mays
  Clone ID: LIB3228-021-P1-K1-G9
agagagatttgtgtgcacagccgctgccatcgatccttctctgggatgaccacctggccgaggtgccatttagaagctccgttgaatcaccagaaacgggatcgtgggagtcttgagctgggaaacctagctggttgcccggaatttgtcgccggcgctgtcgggtcgccgtgatgccgcgcctcaatgtgaccccgtgttcccacacgaccatcctagcgcgaggacacgtgtcatctgaaaagcaagttggtacctggaatctcaagtgccaggtcaagaacaggtaccacaggatgaggcacatggaggatgctgcgatgtgttcatgagaggtctaggccgtcgtctcccagtcaactttgggttgctggaccagtgtctccttataatggaattatttatttatttt

SEQ ID NO: 3895 - DNA, 308 bp, Zea mays
  Clone ID: LIB3228-021-P1-K1-H11
gagcactgctatgtgggacagccgatctctagggccgaggcaatgcccgagaggaggtccaggtttttgcagatggatgctccccctccgtcccgggcggaggtcatctaaccctcacctcgccgtgccaccctgtttccccttgccgcttcggaaaccctgaacaaagccagccccaatatgaactgtgcatttgcgtcgtacaaatctgactccacttgcgatatacttgatcctattctcaaaaagaatgactcggattgagattccatcaaccatgtggtccttcttattctgctcgccttcta

SEQ ID NO: 3896 - DNA, 98 bp, Zea mays
  Clone ID: LIB3228-021-P1-K1-H12
catcatttcaattactctctacctacctaaaaagtaatattatcacccgagtgggggtccactttttataatattttttctccctctttcctctaaat

SEQ ID NO: 3897 - DNA, 426 bp, Zea mays
  Clone ID: LIB3228-021-P1-K1-H6
cggacgcgtggggacctgttggcttcatgggccgacccactaaggcttgcctgctcggacctgttggcttcatgggctgatgggttttttttatttcggtaaaattccgagaaaaaaatcggtaaccgaacaaaacggtcggtaaaatgacataccgattttgataccgtttccgataaaaaattccgataccgattctgtttccgaataataccgttaccggtgaattcgatcgaaaaaatcgataaaaattatttatcttcggttctagtgttaaaagcaccgaagagcaggttgtcttccaggttatatattgtagctgaaaataaagttattgaaactgttctgactcaggagatgaaagaaaaggagcatgttgtgacatatttgagtcgaaggttggtgaataccgaaaaaagatacacc

SEQ ID NO: 3898 - DNA, 259 bp, Zea mays
  Clone ID: LIB3228-023-P1-K1-A10
gcaagccctcgcctgtcctcactcctaaccctcgcccgactcagatctatctgccccgcgccgccgtcgccatgccgttcactccgggtccctactctggcgtcagcaccctcgcccttgtagcgagggcatcggtcttcggcttcggtgtcgtctacgggagcatcaagctctcaatcctcaaggcaacaaagcctaaaaaggaagaagcgcatgctcatcactaaagacgacagggctgctacatgttaatttctat

SEQ ID NO: 3899 - DNA, 255 bp, Zea mays
  Clone ID: LIB3228-023-P1-K1-A11
cccacgcgtccgcccacgcgtccgctgacgcgtgggctggagtatgtactcgggtaaatcgaggcatgctatgttctttttcttgtggaatgtactttaaattccgttccaaatagaaataagacaaacgcttgtaatgtgtctcatatgcagtataaggttggaggcaaacattaagcgtaaaggcaacaaagcctaaaaaggaagaagcgcatgctcataaactagggccgacagtctagagactccatgatt

SEQ ID NO: 3900 - DNA, 318 bp, Zea mays
  Clone ID: LIB3228-023-P1-K1-A12
cggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaataaaaaataaaataaggggggggtgttttaaatagtaaaaattttaaattcccgttttatcgaatattttctttttttatagggtctcccaaataataaaaattcgcgatggttaaaaaaaatgttaaatttaaaaaaatcttgatttacaaaaataatttta

SEQ ID NO: 3901 - DNA, 87 bp, Zea mays
  Clone ID: LIB3228-023-P1-K1-A3
catggcactgttcaagtgcatgtgcatcttcttagtctcgcttctactcgccctcaccttcaccaatgcccaggaagaatcttcaca

SEQ ID NO: 3902 - DNA, 406 bp, Zea mays
  Clone ID: LIB3228-023-P1-K1-A4
acaaaaagcccttaactgaaacaactaatgaccctcgcccggcttatatgtatatagcacggtccgacaaggcaatgcctgtgactgatgagccctactttggcctaagcaccctggagccagatattggatcgtatgagtcaacatatgttagcgattacgagggcgacaaggaataaaagctgaatgaaacaaatgctggcgaggggatggacgatgacaatacatttgcatgtcataatagggattcgcataacaccaggactggatgtgtacatgcgttgacaataattacaaccgttcaccaggatgacaacatgagaatttgacatgaggctggtgatacacgttctgcgtgtcacgtagcacatgaacaaatagaacatattgccgcatcctcagaagc

SEQ ID NO: 3903 - DNA, 410 bp, Zea mays
  Clone ID: LIB3228-023-P1-K1-A5
gtgcaaagacaacttcaagctggattgattagtttatttcatcatattctgcaaaaggtgtgttgagccatgacatgtggaagctcataccaattcctagcttcatgcaccatgatgagtgtaaatttctttccagatgagtcaaggataaaattgcaattgttttttgaagtgtataatgggagaaaaagagctggtgagtttaacaagcaggagcggtaacttgggtaattggaatctaattgtgcttcccattctgtccaagatccatcataatgtaggcagtcatgccagatccgcaagtgacagcaatgggtttgtctagggaaattcctgaagaaacatcaaacacaccatattgttattgcttggcaaacttttcagaatttatgtacatgtataatatatct

SEQ ID NO: 3904 - DNA, 392 bp, Zea mays
  unsure (1)..(392): unsure at all n locations; Clone ID: LIB3228-023-P1-K1-A6
tcggagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctaccttttntataactataaatttttcctattatg

SEQ ID NO: 3905 - DNA, 375 bp, Zea mays
  Clone ID: LIB3228-023-P1-K1-A9
atcgtcaaccgtcacataaaccaactcgatcgatcgcgtgcgactgcgagccgtccgtccgtcatggcggacgtgctggtgggctccgagcgccgtgtcctcatcagcggctacgggtacggccttcccccgcagcccccgcccccgccgccgccggcagagagccagctgctcggccgcctcgatcagatcgatctacggctgcggcagctggaggagcagcagcagcgccgcccgtcgcacgccgacccggtcccggccccggcccgccgcgcgccggcggcgcagtaccagcacaccaagtccctgacggcggcgctgcaacacgtgcaggtgcggagcgacctcatggaccgacttatcctgctggggtcc

SEQ ID NO: 3906 - DNA, 194 bp, Zea mays
  Clone ID: LIB3228-023-P1-K1-B2
acggactctttgtttctatatcatgagcggatcttctagttgatcctagcttacgggcgggtgcttgctacctcataactctcatatagtgtcacctacattcaatccactgtccgtcgatttacaacattcttactggtaaaaccctggctatacccaacttattctactcgcagtactttccctttttgcca

SEQ ID NO: 3907 - DNA, 365 bp, Zea mays
  Clone ID: LIB3228-023-P1-K1-B3
tcttttcttacccatagtttctcgcacaaccaatgttgttaactgaatagttaaactgagtaaaaggtatgatgtttcacatttttaatcttaaaaattatttcttttattataggcaagatgttacctctattgaaggagatgacaggtgtctattattatagcatgaaatcatttttgttgctcctactacacccgttttgagctagaaatttcgtacttaatcaccattacaatatgacagatgtgtatgatatgcacaaaagcacttattgagttgagtggtaatatatactgccaactccaagggaatctgattttattactcaacgtttatgcctttcatttactaccttcattttttt

SEQ ID NO: 3908 - DNA, 404 bp, Zea mays
  Clone ID: LIB3228-023-P1-K1-C1
cccacgcgtccgcccacgcgtccgcgacaccaccgtgtggtcgacaaaataaaaaggagagagagatggccctgttgtctcgccctatggccgccgcaccattcttcgtcgtcgtccttctcgtactcgtggcggcagagaggacgatgggcagggtggtggtggaagagacgctctgcctgtcgcagagccatgccttcaaaggcgtgtgcctcagcaacaccaactgcgacaacgtatgcaagacggagaagttcacaggcggcgagtgcaagatggacggcgtcatgcgcaagtgctactgcaagaaggtctgctagggcatgaccggcagcaagccccaaccgtacggctggttgatccggttgcacactgcacagctcgtttgggcacgcggtcatgtt

SEQ ID NO: 3909 - DNA, 414 bp, Zea mays
  Clone ID: LIB3228-023-P1-K1-C10
gacaaaacatggctgtgaatgtgagaaccatgtggtcgtcgatgcgggcacaggttgcgatggttgtggcgttggtgttcttggtgagcggcgcatggtgcggtcctcccaaagtccccccaggcaagaacatcacggccacctatggcaaggactggctggacgctaaagcgacatggtatggcaagccgacgggtgccggtcccgacgataacggtggcggctgcgggtacaaggacgtgaacaagccccccttcaatagcatgggcgcatgcggcaacatccccatcttcaaggatggtctgggttgtgggtcctgcttcgagatcaagtgcgataagcctgtggagtgctccggcaagcccgtggtggtgcacatcacggacatgaactatgagcctatcgcggcgtact

SEQ ID NO: 3910 - DNA, 299 bp, Zea mays
  Clone ID: LIB3228-023-P1-K1-C2
cccacgcgtccggcctttctttcctggcggcggcgacgccgactactgggcgagcagcgccgccatacccagttcgtcgggcccttcgaccttcgtcggcaacgagcttccaccaggtcaagaccaggtaccacaagataaggagcatgaaggatgccgcgatgagttcgtgaggtctaggctgtcgtctcccagtcaactatggttgcggggatcattatcttcgtatgatgtaattatttagctattttgtatagaacttctattaaatagtaaatatgtgatattcgtttcaaaaa

SEQ ID NO: 3911 - DNA, 419 bp, Zea mays
  Clone ID: LIB3228-023-P1-K1-C3
gtgaaatgtcccagattcatcaggaaatatatcaactgcggaagttggtggaaagttgcattgcatcccaagtaaagatgcagcactccattaaagaagaggtgtgcagtgcacttcgtgaggcaggcttgatgcgaagccaacccgacacagcagcagcaaaaaggggtaactgctgcatctgccatcgaatgcaagttgactctctactttacaggtgtgggcatgtgtgcgcctgttttgactgcgccgatcagctgaaatcgagcggcatgagctgcccaatctgtcaatctcctattgatgatgttgttctggcgcggttgaatttttgagcttagaatttaggaaaggccaagagaaaaagagccggcactcccagatttagacgtggagtttgcgaagccctggttttgagg

SEQ ID NO: 3912 - DNA, 410 bp, Zea mays
  Clone ID: LIB3228-023-P1-K1-C4
agcagggacgttggggatgggttccgctgcattaggatggtcaacaacatctacctgaactttgatgctttacatggagacaaggaccatggtggtgtgcgcgacgggacggcccttgtgctgtgggagtggtgcgagggagacaaccagcgctggaagattgttccctggtgaacaaggaaatgtgtgaccgagcccgcaccaaggaggagctcctgccgtaataagtgaagtgattggtactgaagtttctggaaataagaggctcttctgagatgcctgtttgtgtgagtatttgcgtttccattccgttttcatgataataaaacgcattgattattaatatatgtaatgtgatgctacactgagtggcagcgttggtatatatttgtaagaattaagaacccatt

SEQ ID NO: 3913 - DNA, 324 bp, Zea mays
  Clone ID: LIB3228-023-P1-K1-C6
tacgttcttgcacacataatatttttgctgtccgttttgatgttaatgctaatcaccagagggctattttaacacttggttgaataaaaaaaaaaataaatacactcacatatttccacaatttcaacatcctagctactcctactaattcgttccaccaataatacacatttcaacggaatgcacacaagtacattgagctatcttttatcgcatgcatgatcacattcaactacaccaaattcttgccattttacaaactttttaacctacaagacaacacctttctatacgctatatattcactattcattgctaaacaat

SEQ ID NO: 3914 - DNA, 414 bp, Zea mays
  Clone ID: LIB3228-023-P1-K1-C7
cggacgcgtgggaggtactgttgtccaagcatagttaactgagcctttgaaaacagtacctacataccctagcggagttattgggttcatgctttgctccaccgaagggcctgctgttgatttccagcaccctgttttcaacatcgaggaggatgaacattctacgaaatcaaaaggaccccttaagttctacaactcggagatccacacggcatcattctgtttgccctcttttgcaaagagggtaattgagtcaaaggcaagctagacgtgaggatacttcaccaagtccagtcgattgggttaagtaccttaggcgcaacacaaaatttgttgtcgtgtgaaaatgggatgcctccctcccccaccccccacttgatgaataagcacatgagatgagatgcaacggttatc

SEQ ID NO: 3915 - DNA, 201 bp, Zea mays
  Clone ID: LIB3228-023-P1-K1-C8
actacacgcattacttactgtccaccacacatagataactgagcctttgaagagaggaaccacatacgggaggggaagaattatgttcatgctataataaaccgtaagtcctgctgttaatttacatcatcctattttgaacatctctaatgaataacattctactaaatacaaaagaacctttaagttgtacaactcaaa

SEQ ID NO: 3916 - DNA, 406 bp, Zea mays
  Clone ID: LIB3228-023-P1-K1-C9
gtaacaagagcaaaaacaccatcatctcatccgcccgtctcaacgccaccccaatggcccagagcacgaggatggtggcgctggccctggtggtcctcctggtggcggcgacggcgtcggtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggcttcatcggcgcgcgggctcagctcgatatcagcatcatatacaatcgctgctccgtcgctcacgtcagcccatgcatgatctctcgacccggcccattgaatcttctccttctactatagtatatcttt

SEQ ID NO: 3917 - DNA, 419 bp, Zea mays
  Clone ID: LIB3228-023-P1-K1-E1
ccctcgttcctgtcgcgcagccacgacctccacttccacatcttccccggcggcggcgcggtcagttgaaccatggcggactccaaggccacctcggcggtcaccctccgcacccgcaagttcatgaccaaccgcctcctggcccgcaagcaattcgtgcttgaggtgatccaccccggccgcgccaacgtctccaaggcggagttgaaggagaggcttgccaaggcgtacgaggtgaaggaccccaacaccatctttgtcttcaagttccgcacccacttcggaggaggaaagtccactggtttcggcctcatctacgacaacctcgaggctgccaagaagttcgagccgaaataccgcctcatcaggaatggtcttgctactaaggttgagaagtcccgcaagcaaatgaaggagcg

SEQ ID NO: 3918 - DNA, 180 bp, Zea mays; identical to SEQ ID NO: 3775
  Clone ID: LIB3228-023-P1-K1-E11

SEQ ID NO: 3919 - DNA, 132 bp, Zea mays
  Clone ID: LIB3228-023-P1-K1-E12
gccagacaaccagttatgcatgttatggatccggatacttatttggttttgttagattttttgttttctttgttcgcttgtgaataagtcaaatgcccaacctactacgaacctccgtgccttgtttttagc

SEQ ID NO: 3920 - DNA, 166 bp, Zea mays
  Clone ID: LIB3228-023-P1-K1-E2
cgttaaacaccacccatccttcgttcggcattttttcccccttgtttatataattttattgtatcgttttggcaaataattttgtgattcgaccccaaagcaagtttggttgtcttacgatttgtaaacctggaacaatatataatgtgattgaactgctttgtct

SEQ ID NO: 3921 - DNA, 401 bp, Zea mays
  Clone ID: LIB3228-023-P1-K1-E3
agccagtagacctatgtgtctgcaaattttggctggggcagcggaaggtatggctgggtacattgtggagctgggggcggcacggcaagacgttcgcgggcgaccagctaatgcttaaggactctcgcggtgaaatccagtgcccctttgaggaccaccttgaactaaccccgggcttcgaccttgctgtgtgtgcacttgccgacacccgcgaggcggcgcacttcatcacccatatgatagtccaggccacacgcgcaccctccggatccttcgtttgtgaagcccgcgaagtgtcatgctggtactacactggaagttccttccgaggagaatcattgaaagttgaattacgtcacttagcattgcttaagcaagttaccatctttatgctagtaaaa

SEQ ID NO: 3922 - DNA, 58 bp, Zea mays
  Clone ID: LIB3228-023-P1-K1-E4
cggacgcgtgggcgcaactggcaccatttgtgagagttaaactatggttgttggttgc

SEQ ID NO: 3923 - DNA, 415 bp, Zea mays
  Clone ID: LIB3228-023-P1-K1-E5
aaaaaaagatgtgacatcctagaggaggcctttgccatgatgggtgcgctcgcatggcaggccaggtattaataaaaagatgattattgtgtgccgggggaggagatcgcacgggggttgatgtttttggccccggggtctcctccctcatcttgttccgtgttcctgtatccgttgtttccgcgcctgttggtccgctgcgcacgccggatttttgcatcgagcacggagatctacaacaaaaacatggagctacgacgcgactcccaagcatgtttgaaccatagcaattggtggacgtgtgtagagaagattgcaaaactgcagtatgatggattccactattcatcaaccgagatcatggcgcgcttcaatcgtggctacgctgatggggaattgatccgttatggctcgt

SEQ ID NO: 3924 - DNA, 369 bp, Zea mays
  Clone ID: LIB3228-023-P1-K1-E6
gccagacaaccagttatgcatgttatggatccggatacttatttggttttgttagattttttggtttctttggtcgcttgtgaataagtagaatgctgaatctactatgaatatttgtattttgtttttagcaaaaaaaaaaaaaaaaaaaaaaaaaaaaaaaaaaaaaaaaaaaaaaaaaaaaaaaaaaaaaaaaaaaagggcggacgatttaaaaggacacaaattttcattcgcgggcatgcaacggatatacatttttattagggacaccataaattcaattaaggggccgctctttttaaaacttaataaatggaaaaacccgggagttaccaaacttatttttttgggagcacttcccctttt

SEQ ID NO: 3925 - DNA, 411 bp, Zea mays
  Clone ID: LIB3228-023-P1-K1-E7
cccacgcgtccgcccacgcgtccgcgccgagacagggtgggacaccccgatccacgtggacgcggcgagcggcggcttcatcgcgcccttcctgtacccggagctggagtgggacttccggctgccgctggtcaagagcatcaacgtcagcggccacaagtacggcctcgtctacgccggcgtcggctgggtcatctggaggagcaaggaggacctccccgacgagctcatcttccacatcaactacctcggcgccgaccagcccaccttcacgctcaacttctccaaaggttccagccagattatcgcgcagtattaccagctcatccgcctcggattcgagggctacaaggacgtgatgcagaactgccgcgacaacgcggcggtgctccgcgagggcatcaacaagat

SEQ ID NO: 3926 - DNA, 411 bp, Zea mays
  Clone ID: LIB3228-023-P1-K1-E8
ccaagacaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcaggtgcagcaccttccgccgccgctgcatctgcactaagccgtgctaaattaacctactcccggcagttcgatggtggacgtttattctatttattggcttacttgattttttttcccctaacaataagaaaacgcacgtgctggcatgtacgttgtgttgtatatgcttttcttgctggcttcatttgctgattactgatgagttgtaaggtccctgca

SEQ ID NO: 3927 - DNA, 412 bp, Zea mays
  Clone ID: LIB3228-023-P1-K1-E9
cccacgcgtccgcggacgcgtgggagcgcatgactctgagccacccatgcagccatgcttagtcgccgtgacacaagacagagaagagagaaactcgacgccgccaccgtcacttctcgccacgacgttgttcgatgcccaggtggggtaccagggagcttcatcggggcgtatggatcgcgtataaagggcttctgtggacgaagatcgaccggggtgaccgaaatttgacactgtcgtttcccaccggcgtggaatccatgcttcaccatggccgacgggtgtccatgctgcaaactccgcaagatcgagcggagcctccagccatggcgccaccgtggtacaaggcagcgccgtcgtgttcaaccaccaatggagagagatgaacgagtaggggtcggatcacgatcgg

SEQ ID NO: 3928 - DNA, 229 bp, Zea mays
  unsure (1)..(229): unsure at all n locations; Clone ID: LIB3228-023-P1-K1-F1
agaaagcccccaaancaacnccacccggcgcgcacaccccacgcgcanccggaggcgggcgcancagaacgagagagggganccggacaccgagcccgccagagagggcgaggagggcacggacgagaccgagcaggaggacaaccgcgagaacaaccgacagagcaaccaggagccgagggaggacccggaggacaacaacgccgacggagacgccaaccagaacgag

SEQ ID NO: 3929 - DNA, 389 bp, Zea mays
  Clone ID: LIB3228-023-P1-K1-F4
cggacgcgtggggcaaaccgagaggtgaaccagcggcctccaataaaagccaggacatccaaataaaaccgagagacctcagccctcaagcaagccgaccgccgacgtaccaccgtgccaaccggagagaaagatggagatgatcaagaggatcctcatcgccgggctcctcggaggcgccgcgtcggccaccgtactgctggcctagctacgaggccgtgctcgtgcggtgccccagcctcatacgaggcggcggcgcccgaggaagcgtccgatgaagcggcagggctgggggacgtgcttgtggagggagtaaagcatcaaggggaggctcacatcttggatattgttcagcgtgcaaggttgtatagaggtggatgaccgctcac

SEQ ID NO: 3930 - DNA, 336 bp, Zea mays
  Clone ID: LIB3228-023-P1-K1-F9
cgcgcatcctattgccctcgcgccaccgtcgccgccgccgccgctgcagcgggggatcttcccgccttcgcttgaggtagacaccaatccacctccatggggcgtatgcacagtcgcgggaagggtatctcttcatctgcgctgtcgtacaagaggactccttcgatctggctcaagacagctaccaccgaggtggaggagatgattaccaaggctgcgtagaagggccagatgccgttgcagattggcgcactgctccgtgaccagcacggcatcccacttgtcaagagcgtgactggtagcatgatcctactgatccttgaggcccatgttttt

SEQ ID NO: 3931 - DNA, 416 bp, Zea mays
  Clone ID: LIB3228-023-P1-K1-G1
gtgaaatgtcccagattcatcaggaaatatatcaactgcggaagttggtggaaaggtgcattgcatcccaagtaaagatgcagcactccattaaagaagaggtgtgcagtgcacttcgtgaggcaggcttgatgcgaagccaacccgacacagcagcagcaaaaaggggtaactgctgcatctgccatcgaatgcaagttgactctctactttacaggtgtgggcatgtgtgcgcctgttttgactgcgccgatcagctgaaatctgagcgtcatgagctgcccaatctgtcaatctcctatagatgatgttgttctggcgcgggcgaatttttgagcttagaatttaggaaaggccaagagaaaaagagccggcactcccagatttagacgtggagtttgcgaagccctggtttt

SEQ ID NO: 3932 - DNA, 418 bp, Zea mays
  Clone ID: LIB3228-023-P1-K1-G11
cgcgcatcctattgccctcgcgccaccgtcgccgccgccgccgctgcagcgagccaccgccccgccgtcgcttgaggtagacaccaatccaccgccatggggcgtatgcacagccgcgggaagggtatctcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtagcaagatcctccgcatcctcaaggcccatgggttggcgccggagatcccggaggatctctacttcctcattaagaaggcggtggcgattaggaagcatttggagaggaacaggaagg

SEQ ID NO: 3933 - DNA, 416 bp, Zea mays
  Clone ID: LIB3228-023-P1-K1-G3
cccacgcgtccgctgtcgccggcggcggagggcgtggagagctcggccgtcacctggttgggggcctcgaacgccagggtcgccggggcgtgtccggcgccgtggagcgcggcgttgatcctggcgatgagctcctggccgcaggtctcgtcgcgcaccttccagacgcactgcagccgcgcgggacgctgctcgtcgccgtcgccgtcggagaggacgagcctccacccgacgaccttgaagaggagcctgcgcgcgtcgtcgagggagagcggctccgcgtcgggctgcagcgggaggctcgcgagggagagcgcggagagggtggggatgaggatctggtggagcgtgtccacgttgcccagcaccttctccccaaactggctctcgatctcctccgggaaggggtcgcgcgc

SEQ ID NO: 3934 - DNA, 154 bp, Zea mays
  Clone ID: LIB3228-023-P1-K1-G4
ccgaggttgtcttgaactaaaactcttgttagatcatgtttggttggtaggatatttgagtctgggcaggtgtcttactcttgcgccatgtctttgtaatctctctatataagttttttgagaggctcagtataatatgcgtattatacgttat

SEQ ID NO: 3935 - DNA, 394 bp, Zea mays
  Clone ID: LIB3228-023-P1-K1-G5
aaaaaaaaaaaaaaaaaaaaaaaaaaaaaaaaaaaaaaaaaaaaaaaaaaaaaaaaaaggggaaaaaaaaaaagagttaaaaaacaattaaaaaataaaaaaaaaatgttaagtattaaataaaaattaattaaatttgggggggggccgttttgggggttccaggttttcttccccgtgtttgcgacttattattttttttttgggggcccctaatttcttttcctgggccgggtttttcccccgtggggcttgggaaacccctggggttccccacttttttggctttggagaaattccccttttccccggttgggtttttagcaaaggggcccgccccgttcccctttcccaacatttgcccaccctttttgtgcattgggccccccccttt

SEQ ID NO: 3936 - DNA, 413 bp, Zea mays
  Clone ID: LIB3228-023-P1-K1-G7
cccacgcgtccgcccacgcgtccgcttcagaaaatttgaactctggaagctcgcatagttttgcagattcaccagttggttcagcaacaatgtgctctagcccttcgaattcaaactctctgttttcttgggctgctggctcaggtgcaagaagtgctccaccatcttcccctgctacaagctcatcttttgcttttagttccagtccagcattttcagcacaaccagtattcgccagcaaattgactacacctgcttcactttcatatggctcaccaaatactggccctgctacatcaccattcagctcaatgccaagcgctgtattttcattcacgtcagctactccttcaataccaaatccatcacccacaacaccaatatttggtgaccctactgtacagatgaatgga

SEQ ID NO: 3937 - DNA, 407 bp, Zea mays
  Clone ID: LIB3228-023-P1-K1-G8
cccacgcgtccgcccactcgtgcgcttcagaaaatttgaactctggaagctcgcatagttttgcagattgaccagttggttcaccaacaatgtgctctagcccttctaatccaaactctctgggttcttgggctgctggctcaggtgcacgaagtgcttcaccatcttcccctgctacaagctcatcttttgcttttagtgacagtccaacattttcagcacaacgcagtgttcgccagcaaattgactacacctgcttcactcttatatggctcaccaaatactgggcctgctacatcaccattcagctcaatgccaagcgctgtattttcattcacggcagctactccttcagtaccaaattcatgacccacaacaccagtatttggtgaccctactgtacagag

SEQ ID NO: 3938 - DNA, 198 bp, Zea mays
  Clone ID: LIB3228-023-P1-K1-G9
gacattattgttttaacatgtttcattcacccgtctctgattgggattgtgatcacgaccgcctgcaataaaaaaggccatctttactaaaaaaaaaaaaaaaaaaaaaaaaaaaaaaaaaaaaaaaaaaaaaaaaaaaagaataaaaaaaaaatacaaaaattatagaaaaaacctttttatggggggcggcttttc

SEQ ID NO: 3939 - DNA, 199 bp, Zea mays
  Clone ID: LIB3228-023-P1-K1-H3
ccccccccccccccccccaccccccccccccccccccaccccccccccccccccccccccccccccccccccccccccccccccccccccccccccccccccccccccccccccccccccccccccccccccccccccccccccccccccccccccccccccccccaccccccccccccccccccaccccccccccccc

SEQ ID NO: 3940 - DNA, 398 bp, Zea mays
  Clone ID: LIB3228-024-P1-K1-A1
agcaaattaaagagggatcggattggaactcgatcggaaggaaggtcctgcaggcgcggctggccggtcgtcgatcgaggaaccaagctgctgctgctgctaccggacgacaccaaccatgatacggaggacgacggtgtgcctaggcctgctgcttctactactggcggcgtcgactgcgacggcacatttctcgatcggcgacgtggacgagtacttgaacaggcgcacgcaggagtcccgccacaggaaccacggcggcgcgcagatcaatgacctcatctccagtgctgcgcgcttccacgccaacgtggttgcacgcgcgtatggtcgccgctccaacctgcagctgcaggaggaggaagcagcagctaccgcggggcgtgtaaccaaagcag

SEQ ID NO: 3941 - DNA, 386 bp, Zea mays
  Clone ID: LIB3228-024-P1-K1-A10
gcgcgagtgcgtgcgttcgtgcagccacagacaggcgtacgggcaccatgtctttcaccggcacgcacgtcaagtgcacggcgtgcgacaagaccgtccactttatcgacctcctcacggccgacggggccatctaccatacgacatgcttgaagtgcagccactgtaaaggggtcctctcgatgtgcagctacttcttcatggacggagtgctgtactgcaagacccacttggagcagctcttgaaggagaccgggagcttatccaagaactttacgcccggtggcctgtcattagacaagggtgacactgcatgggccccaagcacgctgtcgttgataacatggacccaatatagtgcgcacagccagaaacagcgtcccggt

SEQ ID NO: 3942 - DNA, 284 bp, Zea mays
  Clone ID: LIB3228-024-P1-K1-A11
cggacgcgtgggcggacgcgtgggaggaaaggagcattagtggtagttacgctgaggaaaagaaagaagtagtcgtctcctgcattgccgcatgcatgatgcgtgcatgcaaaaggaaaagatgtatggctacttggctagattcactctttaaaatctgcatgcgatttttatctttttcgtttttaattcatttattgaaaatcgcgtagaaagcaatattttcctcataagtttctaattaagaaactttggtactattttaattgtacacatgctccatg

SEQ ID NO: 3943 - DNA, 374 bp, Zea mays
  Clone ID: LIB3228-024-P1-K1-A12
aaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgaagagttcgtgcgcaagcacaccgccccggtgtgctctcatggtcaagccggcccaacaccaacg

SEQ ID NO: 3944 - DNA, 400 bp, Zea mays
  Clone ID: LIB3228-024-P1-K1-A2
gctctatgatctttgggacctcatggatgcccccaaggaagaaaggcgtatgttggatcatgtgacctgcaacagatcatcatctgtggatgatgtcacagcacctggatctcttgctctagatttaattgaacaagctgaggctgaggttcaaaggttagaccagctgaagtacagcaagatgaaagaaatagctttcaagacgcaaaatgagctggaagatatctacgctggtgctcatattgtaatagacacagctgctgctcatgagaaaatattggcactgattgaggcaggtaacatagaaccatcagaactaattgcagatatggatgcccagatagcaaaagcaaaggaagaagcattgagtagaaaagatatccttgttacagtagaaaga

SEQ ID NO: 3945 - DNA, 154 bp, Zea mays
  Clone ID: LIB3228-024-P1-K1-A6
gaagaaccacaacgctgacagggatcgcatcgctgtatgacgttttggagcatacagctcctcccgtctttttcagagatttgtgtcacctttttgatttgcttctggtgctacgcttgttgccgcatcaaaaccagctaacgctgttttgtcg

SEQ ID NO: 3946 - DNA, 344 bp, Zea mays
  Clone ID: LIB3228-024-P1-K1-A7
tccgaaaaaaaaaaaaaaaaaaaaaaaaaaaaaaaaaaaaaaaaaaaaaaaaaaagggaatttaattttttttacaaacccaaacacacacccttcaactttctattaccatcttttccccttactcctcccccctctcctctttataccctataataccctctcccccccctctttcctacttttcccccttccaccctctcctcttttaccttcttactcaatattccattaccatcccaccttttccaactttcaaaccatttctcattgtctaaattccattcgcccccttccacactaatcctttaaattcctcactcccctctttttttcccctccct

SEQ ID NO: 3947 - DNA, 373 bp, Zea mays
  Clone ID: LIB3228-024-P1-K1-A8
atcttgggggagctttgggtgccaaagcttcagaagatttgaggctgaggattatcgaacataatatcttggttgtatccaagtactatgcaagggttaccctcaagaggcttgccgatcttctttgcctgactttgcaggaggcagagaagcatctctcagacatggttaactcgaaatctctagtggcaaagatcgacaggccgatgggagttgtcagcttccggacgacccaaaacagcaatggcacactgaactcatgggccacgagccttgagaagcttctggacctcgttgagaagagctgccacgagatacataaagagaccatgatccacaagaggcgtaaaagttaactcttttggttaggttt

SEQ ID NO: 3948 - DNA, 397 bp, Zea mays
  Clone ID: LIB3228-024-P1-K1-C1
cgaagcgatggcgttcacgatgcgggcagtgaaggtgcctccgaactcggcctggctggaggaggcccggcaccgcgtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaaccccaaggtggttgatatgcttctgttcaacgcgacggaggagctgaacaacatagtcgaacatgcaaagcagcgccatcatgtgattgggcagtatgtgaacggccaagagggcctggtgcatgagctggggtcgaaggatctagggaactctgacttcctgaagaaattctacacaagcaat

SEQ ID NO: 3949 - DNA, 185 bp, Zea mays
  Clone ID: LIB3228-024-P1-K1-C10
gacaaaacatggctgagaatgtgagaaccatgtgggcgccgatgctgtcacaggtagcgatggttgtggcgttggtgttttgttgagcgtttcatggagaggttcttccaatgtccacccagtcaagaacattaatgtcacctatggcaagaactgtctggacgcttaagcaacatggtatggca

SEQ ID NO: 3950 - DNA, 395 bp, Zea mays
  Clone ID: LIB3228-024-P1-K1-C11
gtgcaagtatggatctaaggtcaccttccacttggagaaggggtgcaaccccaactacctggcattgttggtcaagtacgtcgatggcgatggcgacattgtggcggtggacatcaaggagaagggctccgacacgtacgagcctctaaagcactcctggggcgccatctggaggaaggacagcgacaagccgatcaagggacccatcaccgtccaactcaccaccgagggaggcactaagaccgtctatgacgatgtcatccccgccggctggaagcccaacactgcctacaccgccaaataaactaacccaataataataagtatcaaatggcacacttgatagacctttattttttattttttatttaataaaaggatataaggagtgtgac

SEQ ID NO: 3951 - DNA, 296 bp, Zea mays
  Clone ID: LIB3228-024-P1-K1-C2
accggcacctcctccaccccggaggccgttagcctgctctgcactgccaaggtcccatgcaccggcgtcaccatggatgacgtcaacgtcgagtatagcggcaccaacaacaagaccatggctatatgcacgaacgccaagggcagcaccaagggttgcctcaaggagcttgcatgcttctagaccctccatcgactgacccatctctctagttataatttttctctcgtccttgcattgcccattagatgctatccattggtaacgcacaacagtaaaacgacagacatccgaca

SEQ ID NO: 3952 - DNA, 226 bp, Zea mays
  Clone ID: LIB3228-024-P1-K1-C3
cccacgcgtccgcggacgcgtccgcccacgcgtccggcctttcgactatggtttggagattgttcccatcttaatgaagtccaatcatctgaacatgttactgtttaaaaaaaaaaaaaaaaaaaaaaaaaaaaaaaaaaaaaaaaaaaaaaaaaaaaaaaaaaaagaaaaaaaatgaaaaaattaaaaatatttttaatggtataattaatactttaattgatta

SEQ ID NO: 3953 - DNA, 74 bp, Zea mays
  Clone ID: LIB3228-024-P1-K1-C4
gtttggggggtccaagcttaccttcccgtgctttccacctaataactttttttttggggcacctaaattcaatt

SEQ ID NO: 3954 - DNA, 358 bp, Zea mays
  Clone ID: LIB3228-024-P1-K1-C6
aaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgccccgggtgctctcatggcaacgcg

SEQ ID NO: 3955 - DNA, 338 bp, Zea mays
  Clone ID: LIB3228-024-P1-K1-C7
tggcggatcgacggccctatttttatgcgagtttgtatacatatttatgccaacgtcaataggtttttatgatacattgtgagtttatggttctccttccatcttttgtatgtttatgatatttctattcacattttatgtaaaagtttgttgattttaaaaaaaaaaaaaaaaaaaaaaaaaaaaaaaaaaaaaataaaaaaaaaaaaataaaaaaaaaaaaaaaaaattataaaaaaaaaaaacaaacaaaaaaaaaaagggggggccccttttgggggtccaagtttttcttcccgttgcttccaagttattattttttttttggggcccccaaa

SEQ ID NO: 3956 - DNA, 394 bp, Zea mays
  Clone ID: LIB3228-024-P1-K1-C8
ccacgcgtccgtgccgaagcgcaagccgatggacgagacgcaagaaaccctccggacctctgcctttcccagttcacatgtcaaggagaaatgggcgaagaatctctacatagcttcgatctgctacggacgaaccgtgtgctgatagtcgaagagaggggcggccccactgactgagtacggtggcttgcgtcaagagattagagatgtgagatgaacattaaatcaaaatcagctctaatgatgataggatcagtagatctgaagatacggtatggtatcctaccgtagctgtaaagaaatgttgtacccagtgccggccgcgagaccgttactgccatgaagtgaagctaatgcattttggagtctcttccaaaaaaaaaaaaaagggcgg

SEQ ID NO: 3957 - DNA, 394 bp, Zea mays
  unsure (1)..(394): unsure at all n locations; Clone ID: LIB3228-024-P1-K1-C9
gtaacaagagcaaaaacaccatcatctcatccgcccgtctcaacgccaccccaatggcccagagcacgaggatggtggcgctggccctggtggtcctcctggtggcggcgacggcgtctgtgcccacggccaccgcgtacggctgctacgacgactgctacgagcggtgcgccaacggcaagaaggacgaccccgcctgcaccaagatgtgcaaccaggcgtgcggcagcaccgacaagggcgccgccgccggcgcgccggcttgatcgacccgggcttcatcggcgcgcgggctcagctcgatatcaanatcatatacaatcgctgctccgtcgctcacgtcagcccatgcatgatctctcgacccggcccattgaatcttctccttctacta

SEQ ID NO: 3958 - DNA, 393 bp, Zea mays
  Clone ID: LIB3228-024-P1-K1-D4
gagccgtggaaacatgtggagagagttttcaccgatttgataagtacctaaatttctcaaacccaaatattgcccagaattttgatcctaatgcatgtggttgggcttatggaatgaacatgtttgatctggaagaatggaagaagaaagacattactggaatttatcacaaatggcagaacatgaacgagaacaggctgctctggaaactggggacattgccaccagggcttctaactttttacaagctgacacaccctctggacaaatcatggcatgtgcttggcttagggtacaatccaaccattgagcgcctagagatagacaatgctgctgtcatccactacaatggtaacatgaagccctggctggaaattgcaatgataaagtatc

SEQ ID NO: 3959 - DNA, 235 bp, Zea mays
  Clone ID: LIB3228-024-P1-K1-D7
cctcgacatcttctgacggaccgagctcgccgcctccatcgtttgtttatcttctaggtcccttagcttcacgtacatccatggcatcatcgccgtcgatacccatgttcttgcaccggttcctatcctacagattttgtgtgtgtgtgtgcgcgcgcgcgcgcgctggggtggggggtagggggatcattgattgttacagtacgttgcaataaaatggtacagtattacgcat

SEQ ID NO: 3960 - DNA, 329 bp, Zea mays
  Clone ID: LIB3228-024-P1-K1-E1
tcaaacaaaaaaaaactagtcaccacaatcaaggttacctgtggtgatacagaatacttcactttaatgaacgcaaacacggtacctaaactacccaactcttgtttatttttgacgctacaattgctatgttctatcaaagcgagggccccatccaaaaacccaccaccatttgcttgcttgtttttccccagtggatgatgactcatgaagccaggatacccttggatcgcagacatgatgaccccgcagagggaaactgaatgaccactgcagctctgatggcaatctcctcgcaataagaaccacaagcaccacaaaacacatga

SEQ ID NO: 3961 - DNA, 301 bp, Zea mays
  Clone ID: LIB3228-024-P1-K1-E10
aagaattttgtctactggtgatctttttttgggtctaatgagcctattaccgtgaaaaaaaaaaaaaaaaaaaaaaaaaaaaaaaaaaaaaaaaaaaaaaaaaaaaaaaaaaaaaaaaaaaaaaaaaaaggggggacgatttagagtatcacaagattacttaagcatgtattctaaaaaaataaattatatataaattaaacttgggttcaatttaatggaggtttttttaaaaagtccttactgggaaaaaaatggttttatcctaatttaaacgtattttaaaaaaaattccgcttta

SEQ ID NO: 3962 - DNA, 226 bp, Zea mays
  Clone ID: LIB3228-024-P1-K1-E11
cccacgcgtccgcggacgtcgagcgagcagtctcccaattccacccaataactaataacatctgctcgaacgccaggttccttggaccactatatccaggagcgacgaagtgatccacccgccagccatggagatgaagaaggtcctctgcgccgccctcgtcgccggcgactaggccaccgccgtgctggcctcggtcgccttcgaggcgccctccgaggcgccc

SEQ ID NO: 3963 - DNA, 202 bp, Zea mays
  Clone ID: LIB3228-024-P1-K1-E2
cgttaaacaccacccatccttcgttcggcattttttcccccttgtttatataattttattgcatcgctttggcaaataattttgtgattcgaccccaaagcaagtttggttgtcttacgatttgtaaacctggaacaatatataatgtgattgaactgctttgtctaaaaaaaaaaaataaaagaaaggtccacattcataa

SEQ ID NO: 3964 - DNA, 398 bp, Zea mays
  Clone ID: LIB3228-024-P1-K1-E3
cggacgcgtgggcggacgcgtgggaggacatcactcccatgggtggcttcccccattatggtatcgtgaagggtgactacctgatgatcaagggctgctgtgtgggaccaaagaagagggtggtgaccctccgccagtccctcctgaagcagacttcccggctggcgctggaggagatcaagctcaagttcatcgacacatcgtccaaatttgggcacggtcgcttccagactaccgatgagaagcagaggttctttggcaagctcaaggcgtaaggtgctgcggtgcagcgaagtcccatttctcaaaatcatcaaactgtgatacttttgtttgtaaccttgctgtaccaagttttgtagccggatggtttaggagcatggtccggtcttctatgg

SEQ ID NO: 3965 - DNA, 396 bp, Zea mays
  unsure (1)..(396): unsure at all n locations; Clone ID: LIB3228-024-P1-K1-E4
ccaaaccgacgatggcgtcgaataagacggtcctcatcgtcgcggcgatgcttctcatcacgctcgtgctggaggccgcccctccggcgaccgccatggactgcaaggccgggtgtgacgaggtcacgggcccactccacatgagcatggaggactgcatgaagaggtgcaaggagatcgctgctaagcaggggcctagggacccttacaaggataacaaacttgacatcccatgaactaattaatgctcctatatcatctgcctatccatgcatgcattgcattgcgtatgcacactgtgcgtgcctgcccacaaagttcgacaacacaccgatctcgacggatttgaatcgtgccactcgatcgagagatcgatcgatgctngntattatattt

SEQ ID NO: 3966 - DNA, 253 bp, Zea mays
  Clone ID: LIB3228-024-P1-K1-E5
cggacgcgtgggcggacgcgtgggttaaaaatcaatggcttgggcggtttcattgagggcaagttctgagtaggattgtgcataagttggatgtacgagatgactcattcctcgtactcagcatatgctataagctatataaccccgtaagatttgtaattgtttagttatagatgaaatcaaaatggaacggtactatcaataccccattgtatatgtacactggattgaaaattgctgagtatttaagcaa

SEQ ID NO: 3967 - DNA, 376 bp, Zea mays
  unsure (1)..(376): unsure at all n locations; Clone ID: LIB3228-024-P1-K1-E7
gtccagcctggtgaggtcacatctgaagatgacatctatgagcaatacaagaaacggatgatgcttggataccgctataggccaaaccctctgaacaatccaaggaaatcatactactgatgcgggggagttcgtctgaggggagataaatgtcaagaagttcgttattcagcatatttcttggaatgccacagatgcaaggcttccgggggttctacaaagctttgttctttgtgtagtgtgtttatctttgtggatttaaatgtctgttcaaacgtgtatcatgtttcagacaatgatgtattgctttcttggatcatccttttttctgatctcatttcaannaaaaaaataaaaaaaaaataaaacccacaat

SEQ ID NO: 3968 - DNA, 383 bp, Zea mays
  Clone ID: LIB3228-024-P1-K1-E8
cccacgcgtccgggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctaaatgcatcaaacaatgagcttgtgaggacacaaacccttgtgaagagtgccattgtgcaagttgatgc

SEQ ID NO: 3969 - DNA, 390 bp, Zea mays
  Clone ID: LIB3228-024-P1-K1-E9
ccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgctaagcccaccgggaaggagatcaaggttccaaaggctctgtttggcggcacaggcaactatgccagtgcactgttcctcacagcagctaaatctaatgcattggacaaagttgaatctgagattaaaagctattgagaggcttccaagaagagcccgttgttttctcaattcataaaggacttgtcagttccaaaagcgaccagggtg

SEQ ID NO: 3970 - DNA, 240 bp, Zea mays
  unsure (1)..(240): unsure at all n locations; Clone ID: LIB3228-024-P1-K1-G1
ccacgcgtccggtctattcgtttggaattgtcatgtgggagttgcttactagggaagagccatactctgnntttcntgctgttgaaattattgggggcatatgtaaacgattccctacgtcctcaaattccttcatggtgtgatcctgagtggaaggggttgatggaaagctggtggtccagtgatccagctgagagaccgtccttcacggatatatctcaaaggttgaggaaaatggcc

SEQ ID NO: 3971 - DNA, 457 bp, Zea mays
  unsure (1)..(457): unsure at all n locations; Clone ID: LIB3228-024-P1-K1-G10
tccgtccgtgctatacccggtgtaagacctctgaagggaatnnctgagcccatcctgtcactccgatgctgcgcgatcttgaagggaccgcgtgatggaagggccccgatnatcgggtgaatttcgtcccttcccggcaccgtcccgtccctgacatcgtattccctgtcccgtccggaaacaatgctcgtgcatgtctgtttntgctgtgcctgtggncgcgacgcggtggtncgctggtcggtggaantcccaactccactatcactagtccgccatctggcaaagtgcgatgncgacggaacccaaggattgtgattctcctnccggcgttgcggcgaatgatnnggccgatgctgttgattgtaaccaccggaacgtggggggcattggctgcttttttaccaggtgggacattgacacggcctgacggtggtgcggagtaggggtgggaacg

SEQ ID NO: 3972 - DNA, 371 bp, Zea mays
  unsure (1)..(371): unsure at all n locations; Clone ID: LIB3228-024-P1-K1-G11
gctccgacacgtacgagcctctaaagcactcctggggcgccatctggaggaaggacagcgacaagccgatcaagggacccatcaccgtccaactcaccaccgagggaggcactaagaccgtctatgacgatgtcatccccgccggctggaagcccaacactgcctacaccgccaaataaactaaccaaataataataagtatcaaatggcacacttgatagacctttattttttattttttatttaataaaaggatataaggagtgtgacaaacaacaacacaaatattgtattgtctatgtatctcctatatatgnaatcccaattttatcatggccacattttaaaatggaatatatgatatatatgaa

SEQ ID NO: 3973 - DNA, 373 bp, Zea mays
  Clone ID: LIB3228-024-P1-K1-G12
acaacatctgcgtcaagtccggcgcctccaaggtggccgtcaacgacgtcgtcttcaagaacatccacggcacctccaacacgccggaggccatcacgctcaactgcgccaacaacctgccatgccagggcgtgcagctcgtcaacgtcgacatcaagtacaatggatccggcaacaagaccatggccgtctgcaagaacgccatcggcaagtccatcggcttggcaaaggagctcgcctgcatctgaaccaattgactaacatgcatatattatatactaggtatatgcccgtgcattgcaacggaaaacacttgtttatacacaggtcattttttagtaatgctatcaagaatcaactcataaatcataac

SEQ ID NO: 3974 - DNA, 394 bp, Zea mays
  Clone ID: LIB3228-024-P1-K1-G2
caaaaggcgacgcggctgggatctagcacgctagcgagcgagagagacgcacatctatctgtcaagcgacgccgcggcctcgatcagagtcggaggcgaacacccccatggcggcggctggcggcggcgcacgagggaaggtatccttcaagatcatcctcacctccgaccccaagctccctttcaaagtgttcagcgtgcccgaggcggcgccctttaccgcggtgctcaagtacgccgcggaggagttcaaggtcccgccccagaccagcgccatcatcaccaacgatggaattggcatcaacccccagcaaagcgcacgcaacgtgtttctgaaacatggagcggagctgcgtctcatccctcgcgatagggttggagctgtagtcatgtc

SEQ ID NO: 3975 - DNA, 215 bp, Zea mays
  Clone ID: LIB3228-024-P1-K1-G3
caccggccgtcgagcgagcagtctcccaattccacccaataactaataacatcttctcggacgccaggttccttggaccactatatccaggagcgacgaagtgatccacccgccagccatggagatgaagaaggtcctctgcgccgtcctagacgacgtcgtctagaccaccggcgtgctggccgtaggtcgactcctgaggcgccctccgagga

SEQ ID NO: 3976 - DNA, 393 bp, Zea mays
  Clone ID: LIB3228-024-P1-K1-G6
cggacgcgtggggacctgttggcttcatgggccgacccactaaggcttgcctgctcggacctgttggcttcatgggctgatgggttttttttatttcggtaaaattccgagaaaaaaatcggtaaccgaacaaaacggtcggtaaaatgacataccgattttgataccgtttccgataaaaaattccgataccgattctgtttccgaataataccgttaccggtgaattcgatcgaaaaaatcgataaaaattatttatcttcggttctagtgttaaaagcaccgaagagcaggttgtcttccaggttatatattgtaactgaaaataaagttattgaaactgttctgactaggagatgaaagaaaagagcatgttgtgacatatttgagtcg

SEQ ID NO: 3977 - DNA, 389 bp, Zea mays
  Clone ID: LIB3228-024-P1-K1-G7
gtctattcgtttggaattgtcatgtgggagttgcttactagggaagagccatactctggtatgcgtgctgctgaaattattgggggcattgtaaacgattccctacgtcctcaaattccttcatggtgtgatcctgagtggaaggggttgatggaaagctgttggtccagtgatccagctgagagaccgtccttcacggatatatctcaaaggttgaggaaaatggccgccgcaatgaatgtgaagtaaaggtctggaagccatatttgtcttcatcgcagttgatgaccctactccaagtgataatttatcaagtgctgacttcaatcatgactaaacccaatgtggtatgcccttgggaatgtcaccacaaactctccaggatactg

SEQ ID NO: 3978 - DNA, 396 bp, Zea mays
  unsure (1)..(396): unsure at all n locations; Clone ID: LIB3228-024-P1-K1-G9
cgtcgtcgatgggacacgagagtagcggtggcggcgccgacgaggaggaccccgccggcctccagcgggtcatttggttgcggcagatgctccaccgctggcagtcctccagctccaggattgccgccgagaggaggtccagcgccagcgacgacggcgacagagccaacccagacgacgccaacgccacgacagaccaaagcagcaacggcgaccccacgcctgccgctgcagacaatgccagcagcagcagcagcagcaggaaccagatgctgccggcggcgccgcatggtgcggcggacgaggaggacgaggacgaggaccggcggctcctgtcgcgggtgctgctggtggaggagcgcangcggtggtgcccccccgacgcggcggcgtgcg

SEQ ID NO: 3979 - DNA, 381 bp, Zea mays
  Clone ID: LIB3228-024-P1-K1-H1
cgtcgtcgatgggacacgagagtagcggtggcggcgccgactaggaggaccccgccgtccttcagcgggtcatttggttgcggctgatgctccaccgctggctgttctccatctccaggattgccgccgagaggaggtccagcgccagcgacgacggcgacagagccaacccagacgacgccaacgccacgacagaccaaagcagctacggtgaccccacgcctgccgctgcagacaatgccagcagcagcagcagcagcaggaaccagatgctgccggcggcgccgcatggtgcggcggacgaggaggacgaggacgaggaccggcggctcctgtcgcggtgctgctggggaggagcgcagcgggggtgccccccgcgcg

SEQ ID NO: 3980 - DNA, 378 bp, Zea mays
  Clone ID: LIB3228-024-P1-K1-H4
acaacatctgcgtcaagtccggcgcctccaaggtggccgtcaacgacggggggttgaataacatattcagtaccttcaacacgccataggccattatgcttaaatgggccaacaacctggcatgccagggcgtgcagctcgtcaacgtcgacattaagtacaatggatccggcaacaagaccattgccgtgtgcaagaacaccatatgcaagtgcattggcttttgaaaaaagatctcgcctgcatttgaaccaattgactaacatgcatattttatatactaggtttattcccgtgctttgacacaaaaaacaacttttgtatacacaggacatttttttagaacgctttcaaaaaacaacttatatattataacac

SEQ ID NO: 3981 - DNA, 146 bp, Zea mays
  Clone ID: LIB3279-003-P1-K1-A1
gaaacaccaagcgcaggtcgataggttactttgaccggggcgattactgaaccatctcggggacgactggaacactaactacgcccacatcctaagtgccctgcgaacgacatcggcctcttccctggcgacgaacacccaccagc

SEQ ID NO: 3982 - DNA, 271 bp, Zea mays
  Clone ID: LIB3279-003-P1-K1-A10
acgctgaaggaggacattgctgacatgcaatacatttatcacacactctgaaagggggggtggtgatgaaaataaggcattaaaaaatattgataaaaagatgcgagaatacacatttgtcaatgaaaataacaatttgcttttgacacatcattctataagaaagatgctacataagcatacaattactctctgtatagaatagacactttgatgaaataatgtaattctatgtcatcatatatatcctactctttctaaattaatatct

SEQ ID NO: 3983 - DNA, 361 bp, Zea mays
  Clone ID: LIB3279-003-P1-K1-A11
gcgcggagtactattatctatctgcaggtcgcgtcggggcttgaccggactgcgctgcacccatagctagcaacgtccagcgcagcgcagggtgggtggggatcccggcgttcgtggtactgtcacgggcgggattcgcatggatccgaggtgccagggcgggagctgctcggacggacgtcctgaacaaatggagccggatccgatccaagttgcagccgaggaccgcgtgaatcgatcggtgtcgacactggcagcccacgggtttccatttcggcatttccacgtcctgataaaatgcggtgcacctacacacggctctcctcgcacggtcgcaccgtgcgtgcatagacgcggcgct

SEQ ID NO: 3984 - DNA, 285 bp, Zea mays
  Clone ID: LIB3279-003-P1-K1-A12
ctgactcgtccggatacgcgtggactgacgcgtgggcaatgactccacgcaggcgcggggtagctgcggcggatcatcagagactatggtccgactgaacaccttgctcttcagctgggcatcagcgaacgaggaacacactgactggctgtgctaccagctttcatatgctgctctgaacgcttgaatgagtgacaaccttgccagctatgttgcttgctagaccatgctgaagaccaacctggccatggtgttgggcgtgaccacaaggaaggtcgatagacc

SEQ ID NO: 3985 - DNA, 372 bp, Zea mays
  Clone ID: LIB3279-003-P1-K1-A2
caaagtccaaaacagctccgggactatgcgataccactgggatggcaatcttcctgcaatgtcgtggtgcgtccacttctaccatgatttgcagcacgttttggtgatttgccctgccacagcacgggctgctcgcattttgtacattggtcgttaaataggataagcgtgttggcctacattagatataatgatgattgatgatatgaggaataggagaggcattcaagtacttgtatgtgtcttctatgccaatgctttatctatatagctgtatcagtgttccagtcaattgatatgagatgatgcttggagtcgttttgctatatgaagtgacggatacaatgggaatttgcagcatccgtttgtatc

SEQ ID NO: 3986 - DNA, 444 bp, Zea mays
  Clone ID: LIB3279-003-P1-K1-A3
aggactagtagtatgctcgccgccgcctggaggctgtcgcagcgagccgtcacgtctcctctgctaggcatcgggcgaccccaaatccgaaaccctttctccaccatggcgtctctctcgccggcagccgcctcgccgaagaggctgagggtctactcgtctgccgccgctgacggcgacggcgcggggagcggcaagcgcgtggggacccacaacggaagcttccactgcgacgaggcgctcggctgcttcctcatccgcctcacctcccagttcgccggcgccgacgtcgtccgcacccgcgattcccagatccttgatacattggatgctgttcttgatgttgggggtgtatatgatcccagccggcatcgctatgatcatcaccagaagggcttcagtgaggtttttggacatggattcaacacaaaacttagcagtgct

SEQ ID NO: 3987 - DNA, 430 bp, Zea mays
  Clone ID: LIB3279-003-P1-K1-A4
cccacgcgtccgggaattattggagcttgtttttctgaagcaaaaacttgccaacaatcagttgaaataagaagaaagcttgcatcattgattttaaagtcaagagaggatagaattgggttgctaaaaatggaggaggaaattttacaagacattgaatgtttaggtaaaaaattacagatgcaagaactactcttcagtcacaacaactatattttcataaggttgttacttggtgttgctatatttttcatcctttcaaaattcatatgaacctttgttgtgcaggaataatttttaattcgtctttacaatacttttcacgctaataacaacattatccttttccatcacacaagaaggaatatcaatggtcttctaggaaggtagagtttaccacctttttgtacacaaaaattgacttaaaatg

SEQ ID NO: 3988 - DNA, 308 bp, Zea mays
  Clone ID: LIB3279-003-P1-K1-A5
cgacgccagagagagtggcgactggcgacgcggtccggtccccccaattcccaacgggcggcggcgcgacaccccgatccggatcccatcgcctgaccggagcctcgattcgggcggcggtgacgacgattcgaccgcgtcggtaaccaggcagagaggcaaggaggggatgagcttccaggacctggaggcgggccacgtacgaggggcgccgaccggaggtggtcggaggagcggccggagcgacctcgcctgcgcctgagtgggtgccggcccgtgcaaggccgcggtgctcggcatggtccaga

SEQ ID NO: 3989 - DNA, 421 bp, Zea mays
  Clone ID: LIB3279-003-P1-K1-A6
atttgcagcagcaaaatcattcgaacacttgctgctgcatgaactcatccttttcaagtaaagttctcacaagactactgggaaatggttgggatgacgcaggcatccatgaatttgggttgagcaaagttgaagaaaccacagattggtgtggtctgttctgcatcgagaaaatggaaattataactgtctctcctgggtgaagtgctctcctgagactgggtaaagtacgcaacacctgagttgatattgcttgcacgttgaacaaagaggatgtatttgcactccaacgtacaaagtgtaacgcattcggccccttttcaaagtaagccatgataggaattaatctaagctgtttggtatatacatcaaaagggtactgcagtaacatgtttggtaccttctcttgcgagttttatct

SEQ ID NO: 3990 - DNA, 434 bp, Zea mays
  Clone ID: LIB3279-003-P1-K1-A7
cccacgcgtccgccaaaatcctaccccgcgggggggattctcagttctctcggcgacgactgggagactgccgccgccgccatcccaggtgccctgagaactcgatcgggctcttcgctggcgacgaacacccaccagctatcaggtgtacaaccatgtacttcaccgtgtccgcccctgcaatgtctctatgatcctccagctacggtagacgccccgttcgctagctgaggacctcctggttcctgtgagcaggcggcgtggttagctgctgccttcaagcatgcagagacccaatgcgccgtcggcttgcgctaccatcaccttcgcggaggctctaaggagggagatggagtaccgcaagtgggtggagaggacccacccacatctgctcgttggaatctgcggagcccctgaaatgcagagagatttca

SEQ ID NO: 3991 - DNA, 431 bp, Zea mays
  Clone ID: LIB3279-003-P1-K1-A8
cagaagagcggcggcgcgggcggacaaggagcaggcggaggaggagttgtgccaagccacaatgggtatctcgcgtgactcgatgcacaagcgccgagccaccggtggaaagcagaaggcctggaggaagaagcgaaagtatgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagatgatgctgacccattcaagcagtggtacctcactcactatggagtcgacattggta

SEQ ID NO: 3992 - DNA, 376 bp, Zea mays
  Clone ID: LIB3279-003-P1-K1-A9
ctgcaatcggaagaaccaggcagtgaagtggtaaagccacagagcaagtgttcttcacttcatgaagctaccgtctaacagtaaactgatagctggttggctcaataacagcccctcagtcatcctctagatcactgaaggatacatcttcctcctccccaactgcagtattgttgccagttttgctgggcacagagtcgacatcctgtagccaatcatctacttctttttcatcatcatcatccgcagggtccgggttagattcctcaatggtacttgagataggatgcttgtcagcctcaacattcggcacagggtcagaagttagttcttggaatgacggcgcttcagatactccgtgcttgttttggatgct

SEQ ID NO: 3993 - DNA, 389 bp, Zea mays
  Clone ID: LIB3279-003-P1-K1-B1
ctgcaatcggaagaaccaggcagtgaagtggtaaagccacagagcaagtgttcttcgggtgatgaagctaccgtgtaacagtaaactgatagctggttggctcaataacagcccctcagtcatcctgtagatcactgaaggatacatgttcctcctccccaactgcagcatgggtgccagttttgctgggcacagagtcgacatcctgtagacaatcatgtacttctttttcatcatcatcatccgcagggtccgggttcgattcctcactggcacttgagataggatgctcgtcagcctcaacattcggaacagggtcagaagttagttcttgaaatgacggcgcttcagatactccgtgcttgttttggatgcttgacgtacttctc

SEQ ID NO: 3994 - DNA, 327 bp, Zea mays
  Clone ID: LIB3279-003-P1-K1-B10
aaaaaaaaacaaggcttttttttttccattctaaatagcaaaggacaacttgcagcaggacacatacccatacaagccctttcgtcccatttgcagcctacccataaccgtatactggaaacagggttctgttaaacataaaatcactccggacagtcagtttatgcctttttaggggacttggcggcctttttgggcgactttgcctccttgctccccccactggaccccttttccgccgtttttttgggcaacaaaacagggtttttattggggaccacaccgccgggggcgatggtcaccccccccaacagttttccaagcttc

SEQ ID NO: 3995 - DNA, 317 bp, Zea mays
  Clone ID: LIB3279-003-P1-K1-B11
caactacgctgtgcttgcaataaaaaaaaactacgctgtgcttatcgcctctggcggcggcgagttcgctcacgtcccggcgacccctcgccggtggccacgggccgtgacactccggcatgccgcgcgccccacgccggcagtccgacgaggcgcgccgtggcgcctacaagccgcgcgtcgacttcagccgctcgcgccgccgccgcgaggacggcctcctcgccctccgccggcttaaccgcgacacgggactcttcaagcgccgtcgcgacgagcccgttcccgtcgtccctgcctacgatctgacttctaca

SEQ ID NO: 3996 - DNA, 419 bp, Zea mays
  Clone ID: LIB3279-003-P1-K1-B12
cctgcaccatcctctccatggatgtcacgcggcgtctctcgcctgcccgatgccgatctagatgcgcctatcgagttgatgcttcactgcgacatccgatttcgggtgcccttgtagccccggtgtcctctgtctctagcgtagatggaactctgaccttgcttactgccgttgtagctcctgtagtccctgtgtttagcgcgaaagggttgtgggtgttagtcacagctctgattaggtgaacggaaagcttcgccggacacacatcttcggcgtggcagcaggttgctcgtgttgtgttaggtagtacctgacccattctcgtggtgggttagaagcattgcgtattcgcgtgtaatgaacaaagaatatctgttctctcttctcaaggtatgaagcattgcgtattgcgtgggaca

SEQ ID NO: 3997 - DNA, 270 bp, Zea mays
  Clone ID: LIB3279-003-P1-K1-B2
cgtttcctggtggggaaggcaaggagaaggataaggctgcttgcgtactgctccgataacccgatggaaaacaaagacaccggggtataggcactcgctctatactatccagcttttaacgcagttataatagcgagggcataccatgagtggacggcatcaaattcttctgctagcggaccgtctagaggaaacgacattacgaacgcctgcctactaccttatagatgctttataaggggacctaaactcaaccaactgcgcgaggcc

SEQ ID NO: 3998 - DNA, 439 bp, Zea mays
  Clone ID: LIB3279-003-P1-K1-B3
ctctccactcccagccgctgcacctggcttcttcgccactctctcctctcctcgttcactctgccaggtggccggccgcccctgctcccatctcccacagccgccgccgccctcagctcctcagccacctcccatggcctcgtctccctgctgcagcgaagccgaccaccgtttcctgcagcctcgatagctccccccccccccccccccccatgccgtccctgctcacctcaccttcgtcggccgtccttggacgccgtgctcggcgcccgagctccctacgccggccaccatccttcccatggcaggagctccgatcggcccctgctgaccttggcactcggcgtggctccaagcagcgccttctcccccaggaccggctcaccgtcagccgcgagctcctctccctcacgtcccctacagacaagcagtgtcgccg

SEQ ID NO: 3999 - DNA, 431 bp, Zea mays
  Clone ID: LIB3279-003-P1-K1-B4
cccacgcgtccggcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctgcgggctgatctacgaggagacccgcggcgtgctcaagatctttctcgagaatgtcatccgcgacgctgtgacctacacggagcacgcccgtcgcaaaaccgtcaccgttatggacgtcgtgtacgccctcaaacgccagggccgcactctctatggcttcggcggctaggttaggtgtgggtaattgcctgtccaggtgtctcggatctgtggtacta

SEQ ID NO: 4000 - DNA, 427 bp, Zea mays
  Clone ID: LIB3279-003-P1-K1-B5
cgtagcactgaaatccttcaagagtggcgccactcctatcttggtcgccaccgatgtagcttgaaggggtctcgatgtcccgaacgtggcccatgtcatcaattacgacctacccaagagcatcgacgattacgtccacaggatcggaagaactgggagagccggaaaggccgggaacgccaccgctttattcacagattcgaaccaccacctggcaaaggacctgctggagctgatgactggagcgaaacaggatgtgcctgagtggctcgtggactatgcaagcaggccgtgctccggagggtccagttatgccggtagaggccgaaagggtggcggaagttttggcggaagagactatcgcctcagcagtgattatggatacgggggcaacggtggtgtctattccagcagcggtagcagctac

SEQ ID NO: 4001 - DNA, 433 bp, Zea mays
  Clone ID: LIB3279-003-P1-K1-B6
ctcaagaaagaggtcttgtccgaggtttaattcctcatattatccaaaatggatgttgttgtcttcagtatgctgatgatactattttcttaattcaagattgtttggaaagtgctagaaaccttaaatttattctttgtctttttgagcacatgtctggtttgaaaattaaatttcacaaaagtgaaattttctgtttggggaaggctaaggatattgaagatttgtgtgctgatatttttacttgtcatattagtaatcttccgataaaatatcttggtgtgccaattgacaacaagaaaattaataaatctctctggtgccccatgttggaaaaaatgaagaaaaggcttgctggttggcaaggtagatttttgagcttggacggtagattgactttattaaatagttgtctttccaatggtcctcttta

SEQ ID NO: 4002 - DNA, 158 bp, Zea mays
  Clone ID: LIB3279-003-P1-K1-B7
gctgcaaggcggacaggcggtggtgttgtatagctcggagtattcttttgctaccttttgtaaaaaaaaagagttagggtaaaagggatttgtgcttaagtatttggctattagccaagttataagagtgaggctatacaatagtggtatcttattta

SEQ ID NO: 4003 - DNA, 436 bp, Zea mays
  Clone ID: LIB3279-003-P1-K1-B8
aacgaggctatctatgacatatgcaggaggtcccttgacatcgaaaggccaacctataccaacttgaacaggctgatctcacagatcatatcatcacttaccacctccctgaggtttgatggggctatcaatgtggatgttactgagttccagaccaaccttgttccatacccacgtattcatttcatgctttcctcatatgcccctgtaatatctgctgagaaggcctaccatgagcagctctctgtgcctgaaatcaccaatgctgtatttgagccctcaagcatgatggccaagtgtgacccaaggcacggaaagtacatggcttgctgcttgatgtaccgcggtgatgttgttcctaaggatgtcaacgctgcagttgcaaccatcaagaccaagagaactgtccagtttgtggactggtgccccactggat

SEQ ID NO: 4004 - DNA, 381 bp, Zea mays
  Clone ID: LIB3279-003-P1-K1-B9
caggatttcaagaccgacctccgcttccagtcctccgctgtcgccgcgctgcaggaggccgccgaggcctacctcgtggggctcttcgaggacaccaacctctgcgccatccacgccaagcgcgtcaccatcatgcccaaggacatccagctcgcgcgccgcatcaggggcgagagggcttgatctcccgttgttgtcgtccacgttgttgggcctttcctctgtgtctctgcttgtagaatccttgcttctgttcggttccttctgttcgcatgatggtgttcgtagtgttaggagttgcattttctaatctgcttgttcttgcaccggtgcctctgaagtggcgtttccccctatcttaatggaaatggaatgtgcttt

SEQ ID NO: 4005 - DNA, 334 bp, Zea mays
  Clone ID: LIB3279-003-P1-K1-C1
gctgcttcctattggcttgggcaaacatgtccattttccaaggatttttcttctgcccggaagtggcgtctttgctgctacacaacttatgcgtctaccacatcaatccccaggggcacagatgggagcagctccaatgtcgtcagatgtgtcggtgccatctgttgctgatctaacgtaaaaattttattactagatatttgaaagcaatgatgtaaaggcttggacatcaatgtaaaggaagaacacctgttctgttttcttctcattttctattgatgtaggaactcactaccattgacaaattccatttatgcattgacaacttttgtac

SEQ ID NO: 4006 - DNA, 431 bp, Zea mays
  Clone ID: LIB3279-003-P1-K1-C10
gcggaaggcgaaagagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttc

SEQ ID NO: 4007 - DNA, 430 bp, Zea mays
  Clone ID: LIB3279-003-P1-K1-C11
ctagccttcacttctcagcacggcagccttcgatcccccgactgcagccgccagccgcgccatggagcaagcagccatgccgcaggttccccgcgtcaagctcggcatccaggggcttgaggtgtcgaagctggggttcgggtgcatggggctcacgggcacctacaacgcgccgctcggcgacgaggccgtggccgccgtcgtcgcgcacgccttccgccgcgggatcaccttcttcgacacctccgatgcctacgggccccgcaccaacgagaccctcctggggaaggcgctcaagcagctgccgagggagcaagtgcaggtggccaccaagttcgggataggtcagggcgccgctggcatgaccgtgtgcggcacgcccgagtacgtacgcgcctgctgcgaggccagcctgcgccgactcgacgcc

SEQ ID NO: 4008 - DNA, 353 bp, Zea mays
  Clone ID: LIB3279-003-P1-K1-C12
cacgcacctccggcatcgaactatgacattggcggcgacattggatatggcggccaatactagaggacgtgcgcgactttggatctcgatgcaccgaattcgctgctgcacgctgaagtgcagatgcaagcccgacaggcacctcatgctcattggcccacctggctcttgaaagggttctcagactacccttatgaaggatgaatattgactgtgcctttgacgcactggtgatatgttgagggctgctgcggcagccaagacatctctgggtatcaaagctagacacgctatgagtacgggagagatcgtgtcagataactgggctgtgcggattattgatgaagctatga

SEQ ID NO: 4009 - DNA, 441 bp, Zea mays
  Clone ID: LIB3279-003-P1-K1-C2
caacaagcaggaccagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatc

SEQ ID NO: 4010 - DNA, 413 bp, Zea mays
  Clone ID: LIB3279-003-P1-K1-C3
cccacgcgtccgcccacgcgtccgcggcgacatccgggagagggaggtggaggatctgttctacaagtatggtaaaattgttgacattgacctgaaggtccccccaagaccacctggttatgcttttgttgagtttgaagatcctcgtgatgctgaggaggcaattgctggacgggatggatacaactttgatggacaccgtctaagagtggaggctgctcatggtggtagaggtaatgcttcctcgcatgatcgttcaagtggctttggtggcggtggtggagcacgtcgtggtgtgtcgagacactcagagtatcgtgttcttgtcactggactgccttcttctgcatcatggcaggatttaaaggatcatatgcggaaagctggtgatgtttgtttctcttgagtgtatc

SEQ ID NO: 4011 - DNA, 433 bp, Zea mays
  Clone ID: LIB3279-003-P1-K1-C4
cccacgcgtccgggatttcgagatgggtgtcttcaacaggacccctgagtgacttaagatgaacctagttgggaaggatcctgctctagacactcctgatggccctactatagagagtaatgctatcagcacgctatgttgctcgctcgaaggaacacacaccttgtcttcgggtctacccatattgaacaagcgcacgtcgagcaatggatggattttgccacaacacaagttgatcctgcagtcgcatggtacttgtatccaaggctcgtgtcccgctcttatgtgagcacaactgaggaaacagctatgtcttcattgaagaggtggctggatgctctgaacacacacctcgcctaaaacacatacgtggtggggcatgctgatactatacgtgacattggattgacatgcagcctctaccatggaattg

SEQ ID NO: 4012 - DNA, 424 bp, Zea mays
  Clone ID: LIB3279-003-P1-K1-C5
cggacgcgtgggtgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggttctctcctcctggagcgcctgtctgttgactatggcaagaagtccaagctcggtttcaccgtgtacccatccccccaggtgtccaca

SEQ ID NO: 4013 - DNA, 434 bp, Zea mays
  Clone ID: LIB3279-003-P1-K1-C6
ttcagtttgttgccgtctctctctcctcttgacgcaactcctctcctatcttctctctctccatcgctccctcctccgcgccgcgttggcaccgaaccctcctgtcatggcaaggccgccgaaggaggcgattgataccttcatcagcatcacgggggcggacgaggccgtcgccgtacgcaaactcgagcggatggagttggggttttggtgtgatgcgacgagatgtcatcgggatcaggtgcaccagatttgcatgccagccttattaacccacatggctttttgaatcgtggagtcattagcaattgctggaattggtgtgcagttacggaatggattttggaacatggtggtgatcttaatcaagcaataaattcacatttcaatgatggagacagcatattgaacggaatcagtcaaaacgccatgcc

SEQ ID NO: 4014 - DNA, 434 bp, Zea mays
  Clone ID: LIB3279-003-P1-K1-C7
ctttcattcgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactggaatgaggggtgcctttggcaagcctcaaggcacctgtgctagggtggacatt

SEQ ID NO: 4015 - DNA, 420 bp, Zea mays
  Clone ID: LIB3279-003-P1-K1-C8
gtggactggtgcccaactggctttaagtgcggcattaactaccagcctacaagtgtggtgcctggtggtgacctggccaacgtgcagcgcgctgtgtgcatgatctccaactccaccagtgttgtggaggtgttctcccgcatcgaccacaagttcgacctcatgtacgccaagcgtgccttcgtgcactggtatgtcggtgagggtatggaggagggcgagttctctgaggcccgtgaggatctggcagcgctcgagaaggactacaaggaggttggtgctgagtttgatgagggtgaggaaagtgatgatggtgatgagtactagaagtatcctgatgcggtcatagacaggcttgagtgctgctcttgaccccggtgcggtttgcaacacctgatgttgttagactttctggttatg

SEQ ID NO: 4016 - DNA, 306 bp, Zea mays
  Clone ID: LIB3279-003-P1-K1-C9
caaggatgatgatgaactggatggacaagaaggggatgggagtggcaagtcgaagcaaagcaggagtgagaagaagagccgcaaggccatgctgaagcttggcatgaagcccatcactggtgtcagccgggtcactgtgaagaaaagcaagaatatgctttttgtcatctcgaagccagatgtgttcaagagcccaaactcggacacctatgtcatattcggcgaggcgaagatcgaggacctcagctcccagctgcagacccaagctgcaaagcagttcaaggctcctgacctgagccaaatgat

SEQ ID NO: 4017 - DNA, 428 bp, Zea mays
  Clone ID: LIB3279-003-P1-K1-D1
cggacgcgtgggcggacgcgtggggccaaaaccccaatcgcacaggagagaccgagagagaggttttccatccatggctcccggcgtcgcttccgtgctggtcccgcaggagcccgtcctcctcaaggacatcctcgcctcaccgtccccctgcgggaacaccgctgtctccgcccgccacctcttcggcaacggagtcgcgccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaagaggatggcgacgcggtgc

SEQ ID NO: 4018 - DNA, 436 bp, Zea mays
  Clone ID: LIB3279-003-P1-K1-D10
aaattctagggtttgcctcttccctctcgctcccaccaccaccaccaggcagacgcagatcggcggcgggatatgctagcaatgatccccaattccgacttcctctagactgcctggcggtcgaattccgattcgattggagtagggaacgagaagggaacaaatacaccggcaccaccaccagaccagacagcacgtgcctccatactatggtttacgccccgtgccgctcatcgacgccgccgtcttcctcgccgatgctccacaagaacctccgcgccctcggacccggcttgaatcccttggctcccttcggcatgggcaactactcccgctagccgtttcctcctatccctctttctccgattccgatctctgagtgcttccgcctccgcccccggccgcttcctccatcggaaccgatccccgctatttt

SEQ ID NO: 4019 - DNA, 410 bp, Zea mays
  unsure (1)..(410): unsure at all n locations; Clone ID: LIB3279-003-P1-K1-D11
aaaaaaaagactcaccgtcgacacgccctcccgtcccgagagttctgaatcgaaaccgtcggccacgagagcagtgcgaggcgcccaccgcgatggctcgaaccaagcaccaggccgtgaggaagacggcggagaagcccaagaagaagctccagttcgagcgctcaggtggtgcgagtacctcggcgacgccggaaagggctgctgggaccgggggaagagcggcgtctggaggtgactcanttaagaagacgaaaccacgccaccgctggcggccagggactgtagcgctgcgggagatcaggaagtaccagaagtccactgaaccgctcatcccctttgcgcctttcgtccgtgtggtgagggagttaaccaatttcgtaacaaacgggaaagtagagcgctatacc

SEQ ID NO: 4020 - DNA, 362 bp, Zea mays
  Clone ID: LIB3279-003-P1-K1-D12
ctttattgctcgggtcagctgatctaggagtgtcgttgcatacatcttcgtcagggctggacctaccaatgaaggtggttgatatgtttggatgcggattgcctgtttgtgctgcttcattctcctgcattgaggagcttgtaaaagtaaacaaaaatggtcttcttttctcaacatcttcggagcttgctgatgaacttatgatgctctttaaggggtttccagaagaatgcaatgccttgaaatccctcaaagaaggtgccatgaagtcagcatcatcttcgaaatggtcaacagaatgggaaaccaatgcactacctttggtggaccaggtcattggatgagatgtgtgcttacataca

SEQ ID NO: 4021 - DNA, 432 bp, Zea mays
  unsure (1)..(432): unsure at all n locations; Clone ID: LIB3279-003-P1-K1-D2
gcggcgccggcgtgcttgtgatctcaacccaagtcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttgattcatatcactgatttgtctgggagggaaactctggttcggatcaccggtggcatgaaggtgaaggctgaccgtgatgagtcgtcaccttacgctgctatgcttgctgctcaagacgtcgcacagcgctgcaaggagcttggcattactgcactgcacattaagcttcgtgccaccggaggcaacaagaccaagaccccatgacctggtgcccagtctgccctcanggcgcttgctcgt

SEQ ID NO: 4022 - DNA, 437 bp, Zea mays
  unsure (1)..(437): unsure at all n locations; Clone ID: LIB3279-003-P1-K1-D4
ttccgaaggtcctcaaaaacatgatttgacaatgttttccaagtgaaatttgtgaataggtatcttcggatttggatcatgagcatacagagcatggttaagacgaagcttgagccagacgaaagatgattatgacgaaggacaaggtgatcacgaagctgtgcgcagggaagcttcggcatgacagcagaaaaggggaaccgacttaaagatgaaaaggcaaattagacctcgaaagattactatagagttattagcaaatgtaaagggcatgaatgtaattttacatgggctgcgtcccttgcttataaatagatgaacggtacccccgtactgttcacgttgacttggcattcgctctcgcgtcacgctngtacccttgtttcccttcaagccgaaggtacatttgtaatttgttattgcttatacaagtaacg

SEQ ID NO: 4023 - DNA, 430 bp, Zea mays
  Clone ID: LIB3279-003-P1-K1-D5
cggacgcgtgggcggacgcgtggggcctgcatcatgtccaagcacttcaagtctgataagccaaggtgatccaatatttctttcccttcgcctctcttcagactccaactagaccttcaattcatggattccgtcacagtggcaggaggcatagcggtctggatggcgagcgtgaggcatctgccgaggtgtaaaagcatgtctgtagcaaggatatatctgttctgcaagacctcctgattttagtaagtaccgaggtagtatgttgcaggatataacatggtcctgtgctgttgtagcccgagtttaggtgctgtctatgcagtatgatgtgcaggagcatatcctccagcacatggctaacccgatcacatctaagtcacatgtagcgtaactgtaatcctattcatactatatgaagaatgtcagt

SEQ ID NO: 4024 - DNA, 422 bp, Zea mays
  Clone ID: LIB3279-003-P1-K1-D7
cccacgcgtccgcaaaaccctagctagagttggcgagtgggggtggaggcgcggctgctcgtcacgacatcgagtttcagcgccgcccgcgagatccccggatttcgttctctacccctgagagctgcggcaatggctgggaaaggcgggtcgaccaacttagaaaaggagcagatgtttgggatggcggagaaggagatggagtacagggttgatcttttcaacaggcttacacagacctgttttaacaagtgcattgaaaaaaggtataaagaagctgagctcaatatgggcgagaacagttgcattgatcgatgtgtttcaaagtattggcaggtgactaatttagttggtcagatgcttggaaaccggcctcaaatgtgaactgagaagcactcgttccattttgtagcaagattcta

SEQ ID NO: 4025 - DNA, 434 bp, Zea mays
  Clone ID: LIB3279-003-P1-K1-D8
gtccagactcatttcgaactaccccgccgctccgcctcgaccctcccctcctccccaatcccgcgcccttccaccctcccgccgaaagcccagccccgatggcgtctctagaaggcgaccggtggtcggagatcgtggccagcggccgtgcccggccgccccgcgtcggcgtcgtgtacggtcgtcgcctggtcgaggaatcgtccggcagggctaacatggagacgagagccagcttcagtggcctgcggcgcccgagcttcgtgccgcgcaagcgaaccagctggaaccggtcgctttccatcaaaaggagagagagtattttcgtcgcacctggtgcaaatcttcaacagaaaccatgtgaagcaatgaaacgaccaccgaaaccgtgcaaccgagtgctgactctactatttctacatgcatattgttct

SEQ ID NO: 4026 - DNA, 338 bp, Zea mays
  Clone ID: LIB3279-003-P1-K1-D9
ggcgatcatcatatacctggaagctccttttcatgtctagtgaagatctatgacatgcctgatagtcaagtgaaattaaatgatgttattgagtttattggcgtatatacatttgacccagaacttgctgctcctagtgacaacccagatgatataatgttagacctcatcgaagatgtaacagttcagttgcctccgagcaaggtgccacgtcttcactgtttggtatggagaaaattatcattccatgattttatttcaaggcctgttgttgagccttcacccagcctgttaagaagcattcggcaatctttgctctcacacctcacccttgtatt

SEQ ID NO: 4027 - DNA, 437 bp, Zea mays
  Clone ID: LIB3279-003-P1-K1-E1
ctcaaaagcattgatgtttgtgcaaattagcccatccgataatgatgtttcggaaacattgagttcactaaacttcgctagccgtgttcggcgtattgaattgggaccagcaaagaaacatgttgatactgctgaacttcaaaagaccaaacagacgcttgaaagagctaagcaagaactcaggcttaaggatgattctttgagaaagctagaagaaaacttacaaaatttggagagcaaagccaaagggaaagagcaactttgcaaaaacttgcaagagaaggtgaaagagctcgagggtcagttagattccaaggcacagtgtcaaataacatcagagaaacagcaacggcagctttctggaaaactaaaagagaaggaagaaatgtgtaatgtacttcagcagaagattgcggacttagaatgcaagcttagac

SEQ ID NO: 4028 - DNA, 435 bp, Zea mays
  Clone ID: LIB3279-003-P1-K1-E10
cggacgcgtgggcggacgcgtgggcggacgcgtgggcggacgcgtgggcttccatccatgggttcacgacgggcctgaagcttgaacagtttatattcgacgccttcacatactccccgtccacggcacttttcgaggtcatgcgggaggaggaattcgcgccggtaaagaacgccagcggcgcaacgtatgacacccctgatagcgcgaagctcatgctgctccgcctccacagcagatgggtagtcgccgctggcggcttcttgacgcactctgtgcccttgtatatgacaggcgttgaagtttctccgctctcctcctacgccggagagaacctggaagcgatctgccgtgggcgaacgttccatgcgccgagcgagatctcgttttaggaggagcacttgtgtctggagtagcacttgtgtcatctgtaaa

SEQ ID NO: 4029 - DNA, 433 bp, Zea mays
  unsure (1)..(433): unsure at all n locations; Clone ID: LIB3279-003-P1-K1-E11
atgggcattggcggaggatggcagttggcgtggaaatggaccgagagagagggcgaagatgggcaaaaggaaggtggcttccagcgtatttacttgcatgaggagggcgtacaaggcaacaggggttctatattgtcattaccaggcggggatgttcctcctggtggtgagttcatccaggctgcagctcttgtgagccaaccagctctttactctaaggaactgctggagcaacgtgctgctggtcctgcgatgatgcatccatctgaagcagttactaaaggtccaagatgggccgacctatttgagcctggggtgaagcatgcactgtttgttggcataggaatacagatcctgcaacagtttgctggcatcaacggcgttctctactacactcctcaaattcttgagcaagcangcgtcggtgttcttc

SEQ ID NO: 4030 - DNA, 434 bp, Zea mays
  Clone ID: LIB3279-003-P1-K1-E12
gaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgactcccacctagtgccttcttctactgctgctgaatcaaaggtcttctacct

SEQ ID NO: 4031 - DNA, 431 bp, Zea mays
  Clone ID: LIB3279-003-P1-K1-E2
ctctgccaccaatccggggaggaatcaacctagcggtaagcggacatggcggcggcgaagatagcgccgtcgatgctctcgtcggactttgccaacctcgcttcggaggctgagcgcatggtccgcctaggcgccgactggctacatatggacatcatggatgggcacttcgttcctaacctgactattggggctccggtgatccagagcttgaggaaacataccaaagcatatttggactgccatcttatggtcacaaagccttcagattacgtagaaccatttggaaaggctggcgcttctggattcacattccatatagaagttgctagagacaactggcaagatctcatccaaagcattaaatcaaagggtatgcggcctggtgtatcattgaagccaggtactccagtggaggaagtttttcccct

SEQ ID NO: 4032 - DNA, 220 bp, Zea mays
  Clone ID: LIB3279-003-P1-K1-E3
ggaggagtagagatggagtcggaccagggcaagcttttcatcggcggcatctcctgggaaacgacggaagagaagctgagcgagcacttctccgcctacggcgaggtaacgcaagccgccgtcatgcgcgacaagatcaccggccgcccccgcggctttgggttcgccgcttcgcggatcccgccgccgtcgacagagcgctgcaggacccccaacaccc

SEQ ID NO: 4033 - DNA, 433 bp, Zea mays
  Clone ID: LIB3279-003-P1-K1-E4
cccacgcgtccgctggtgcactccggtcagggaaaaatcctgcagtctacaaatttcttggtgagacgatccatgtagatggtcataacctgtatgaatcagcaaagaggctcagactacgagagcttccagcttttgctctggaacacttgccaaatcggaattccttgatatatggtgacctttatggtatctccaaagaagcatccaccatatatagggctactcttcgttacgaaggttttagtgagataatggtaaccctttccaaaactgggttctttgatgctgcaaatcatccactgctgcaagatactagtcgtacaacatataagggtttccttgatgaactactgaataatatctacacaattaacacggacttagatattgaagcctctggtggatacgatgatgacctgattgccaggct

SEQ ID NO: 4034 - DNA, 438 bp, Zea mays
  Clone ID: LIB3279-003-P1-K1-E5
ggatcagaagagattattgaggctgatctcgtcctcctagctatgggattcttgggtcctgaagcgacaatagctgagaaattgggtttggagaaggacaacagatcaaacttcaaagcgcagtttggagacttcgctaccagtgtcgatggtgtgtttgccgccggggactgcagacgtggacaatcactggtggtttgggccatcacggagggacggcaggctgctgcagcggtagacaagtacttgtcaaggtatgatcagaatgctgctgctacaggcgacagcactccctccgggacagggctcgttcagccggttgcggcatagtagcataaactggagcaagttttacgtttgtcagtgtatcctgtggttccacacagcaaacaccgttcttgtaggtgtctaaaagaaacagagaaatccgggctcatt

SEQ ID NO: 4035 - DNA, 436 bp, Zea mays
  Clone ID: LIB3279-003-P1-K1-E6
cccacgcgtccgcactagcagccgctcactccagccattacccgcagctagcaaacaaatggccaccgtcctgagcagcccccgcgcgccggccttctccttctccctccgcgccgcgccagcgcccactaccgtggccatgacccgtggcggtggcgccagcagcaggctgcgcgcgcaggccacctacaacgtgaagctcatcacgccggagggggaggtggagatgcaggtgcccgacgacgtctacatcctggactacgccgaggaggaaggcatcgacctgccttactcctgccgcgcggggtcctgctcctcctgcgccggcaaggtcgtctccggctccctcgaccagtccgaccagagcttcctcgacgacagccaggtcgccgacggctgggtgctcacctgcgttgcgtaccccacctccgacgtc

SEQ ID NO: 4036 - DNA, 431 bp, Zea mays
  Clone ID: LIB3279-003-P1-K1-E7
cggacgcgtgggcgacacgtcgcccccggacgcagacgtcgccgaaccggttacacctgcgcatgccatattgaaattacgtttctagctcgacgacgccggcgaggagcgtgacccaaccgacgccaaggaggaggagctgctcgacaaggcacgggacaggcggaggcggatggccaggatacatcagtgggtgggggagaggggactggagcgagagcagcagcaatggtggcgagaagcggaggaagagggggcatgcgagcaggctggccaaggccagttcctcctcttcggcgtcatgaacgttctcctccgcgtcatgggcgagtggctccactgtaatagactggggcagcgcacgaggaggcccagctgcagagcggcgacggcttgtccctcctagtctacgcctggaagaactagtgtga

SEQ ID NO: 4037 - DNA, 424 bp, Zea mays
  Clone ID: LIB3279-003-P1-K1-E8
cgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggacccc

SEQ ID NO: 4038 - DNA, 429 bp, Zea mays
  Clone ID: LIB3279-003-P1-K1-E9
gcaccggccagtcgtggacgccgaccaacgtcaccgcgcccctggacgccgccatcgtggggttccgcgacctctgcctgcaggcggactacgcgggggcggtatccgtcgctgcctgccgcgacggcttgcagtggtcgctctaccccgacggctccgtacgcccgcccgcgtggctcctccttcaatggcagtgcctggctgctgatgccagcgggggtgtgacggtgaaactctgcgacggggctggatcgtcttgcgagcgctgggtgttccgcaacgacggcaccatcttcaacaccggcaccgggatggtcttggacgccaggccatctgcgggggctaatgctactgctagccaagtcatcgtgtcgcccgccactgggagtcccacccagcagtggacgctcatgctgtgatctcatctac

SEQ ID NO: 4039 - DNA, 346 bp, Zea mays
  Clone ID: LIB3279-003-P1-K1-F1
gggtcgaccgacgcatgcggaatgacggacagtggcgcttacatggagcaccgtctggccggcgtggacagggtgcagagcacgggcctgaacgcggacacgctggacgctgacgaaaaatggatgccgccacatcgacggcctagtctgcgtgaagtagcagttctacaccggcaagggcatgggcggtgttaactggaatttgttactaaacgccagggcggaccaaaaggaaacggcactgtttgtactactgatagacagtttggtccgacgcatttacgtaggagtcaggcggcccattcttttggaggggtagggaagcggtaagaggctacattggact

SEQ ID NO: 4040 - DNA, 431 bp, Zea mays
  Clone ID: LIB3279-003-P1-K1-F10
cgccggcgtaggcataggcaccggagggatctgccgtgtcccttgctccacgcgatgaacaccgacatgaccgcctcgactaagccggagtaccaggtggtggatcggaacccggtcttcaccaaggcggtcggcaacttctgtgacgctcgactacatgcgcgtgtccaccatctccgccgtgttcgacaacgtgggctacctctccgggatcaagccgtcgatccggggcccgtcgatggtcacgggcggcctcatatgcgtcatgggagggttcatgtacgcctaccagaactccgccgggcgcctaatgtgattgtttaccaacgactccgaggttgcgcgctacaagcacaagcttaattgaggatccagctccatttcgaatctctttttgcaacgcggtcgcctgttcctttcctgattccgtg

SEQ ID NO: 4041 - DNA, 427 bp, Zea mays
  Clone ID: LIB3279-003-P1-K1-F11
ccacgcgtgcgacctggctggaatggatcttgtaataattcctgctggtgtccgtcggaaacctgggatgacaagggatgatttgttcaacataaatgctggaatagtccgtaccctgtgtgaaggaattgcataatgctgccctaatgcaattgtgaatgtgatcagtaattctgtcaactctaccggcccaattgctgatgaagttttcaagaaagctggaacttatgaccctaagcggcttttaggtgtgaccacacttgacgtattgagagcaaatacgtttgtgggagaggttcttggacttgaccccagagaggtaaatgttccagtcattggtgggcatgcaggtattacgatactaccactcctttcacaggtgaatacttactgctcatgcacctcggaagaggttaaataccttact

SEQ ID NO: 4042 - DNA, 436 bp, Zea mays
  Clone ID: LIB3279-003-P1-K1-F12
cccacgcgtccgcccacgcgtccggttgctgttaaggcacgaggcatcacgaggcgttgtgatcatcatcgtcggttatgcagtgaccaaacaataccttagcattgctgggtctccgtggttatctacgtatccgtattccatttgttacctttccagtctcactgctatgtacccaagggcgcctgtcaattcggtggactttgtgcagtttcatcagtagcgtcataccttgtgaatacaattggccaaaataagaggaagtgtaaactaaagttcatgctttatggttttgtgttgtattaactcgtccgccttttcctcgctttctgcttcagtgcaaacatgttaatgccatcccttaggctattcattaagaatagttttatcacattgtttctaaggctattatctaaacatttgtcttgtctagaaa

SEQ ID NO: 4043 - DNA, 434 bp, Zea mays
  Clone ID: LIB3279-003-P1-K1-F2
cttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaaaaagggaattgaggc

SEQ ID NO: 4044 - DNA, 141 bp, Zea mays
  Clone ID: LIB3279-003-P1-K1-F3
ctttactcaaccacgggggagcggtgaaatcatataaacaatggtaaaggctttttcttttcttggtaacaccaatggtgtcaagggccccatttttttcacccaaggggggaggggccctaccccttgccccgggagtgt

SEQ ID NO: 4045 - DNA, 438 bp, Zea mays
  Clone ID: LIB3279-003-P1-K1-F4
cccacgcgtccggccaagaactcgctggagaactactcctacaacatgcgcaacacgatcaaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggcgctggcggcatggacgaggacgcccccgctggcagcggcggccctggccccaagatcgaggaggtggactaagcggtttgttgtcagtcttgagcgtgctgcagttgctggctggcccagtcgctgccgcgagttatcgtcgtcggtcggtgcggtgtgtccgcttaaactttattt

SEQ ID NO: 4046 - DNA, 404 bp, Zea mays
  Clone ID: LIB3279-003-P1-K1-F5
gcatccaaaatggacgatgcgggtttccatatgatacttcacttgaatacaaatatcaatcctatcagaaaacacgagaagaaaaacatggggaaaacgtggggaggctatgccgagctatactctgccgtgtgtggcacaatagtcaggagccacatcatgttctctaccatgacaaccggaaactgcactagcaccaatcctataacacagtaaaaaccgtgttctgttacagtcgttacaacttttagatatcaatcttattcagcaaccccatgggaataagtcgaggattggggccattttaacttccgattcctttttatgatgatctctaagggtttagaggctcatcttccgcagtcatcattacagcctttgtcgatctgtgaagatcagagaca

SEQ ID NO: 4047 - DNA, 369 bp, Zea mays
  Clone ID: LIB3279-003-P1-K1-F7
tccgcttttttttttttttttttttttttttttttttttttttttttttttttttttttttaaacattgataatgatataatatagatgggtcatgacagatagatccggcagagccaaccatgaccatgactgccttacaactgattaaaacggaaagatactggggctgctcacttgcattttttactaccacgccacgacagaccaaaacgaaacgaccctgttagtactactgatagatagtttgctccgacgacttcacgcaagagtcagccgagcgatacctttggaggggtagggaagcggcgagaggcaacatgggactccgccggatccgacgcgacgggggcgccgcgcctaacgcctt

SEQ ID NO: 4048 - DNA, 417 bp, Zea mays
  Clone ID: LIB3279-003-P1-K1-F9
gttctggaaatcatacatcaaaaggcctatggtgttagtcgggcccagccttggtgctgctgttgccattgatttttcagtcaactaccccgaagcggtctcgaaattgatcttcattggtgcaagtgtatactctgagggcccaaaagatatgaccaggatgcctaaatttgtttcatatgctggggtgtttatattgaagagtcttccactgcgatttttagcaacaagattggcatttaaaaaaactccaaatgaattctttgattgggtgcaaattggccgtctgcattgcctacttccctggtgggaggatgctacagtagattttatgattagagggggttataatgtcataaaccaaataaaacaggtgaagcataaatgcctgatcctgtggggagaggatgatggaat

SEQ ID NO: 4049 - DNA, 434 bp, Zea mays
  Clone ID: LIB3279-003-P1-K1-G1
cccacgcgtccggccgcagacccctccccttcgcttccttccctagcgccgacgcccaccagacgagatggccccgaagaaggacaaggccccgccgccgtcgtcgaagccggccaagtccggtggtggcaagcaaaagaagaagaagtggagcaagggaaagctaaaggagaaggtaaacaacgcggtgctgttcgaccaggctacctacgacaagctgctctcggaggtgcccaagtacaagcaaatcaccccttccatcctctccgagcgtctgaggatcaacggctcccttgctcggagggccatcaaggacttgatggcgcgtggcctcattcggatggtctcggtccactcaagccagcagatctacaccagggcaaccaatacataaggatggggaagaggtctaaaatgcattgtctgccctctct

SEQ ID NO: 4050 - DNA, 440 bp, Zea mays
  Clone ID: LIB3279-003-P1-K1-G10
gctcccacctctagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatg

SEQ ID NO: 4051 - DNA, 438 bp, Zea mays
  Clone ID: LIB3279-003-P1-K1-G11
ccaggtccaggaaaggccggtggagcgaaggcctgagctgggcgcccagccattcccctcatgggcatggcaagcgcagggctcccctcacgtgccgttgcaccactctgcagcatcatcaggattctctaccgccgccggggccaacggcggcatgcccctgccgtctcacccgccggcgcagttcccgactactacaaacccgttcttcttcccctagaccgcttttgacatgacagcttgctgttccggctcagctctcggcgtctgggatggcagctggtcttgcgtgtggcgtctagcagctctggtgatggaagaaagtgattgtgttttgtgtgtgtgtgtgagagagagagagagagccataataagaagcgacatggctggtctccctctggtatgtgcctgttaggatatgggatatctccatgcatg

SEQ ID NO: 4052 - DNA, 439 bp, Zea mays
  Clone ID: LIB3279-003-P1-K1-G12
cccacgcgtccgtcctactcctatcatccagaaaatctgagcggtattgatggcgcccaaggcggagaagaagccggcggcgaagaaggtggcggaggaggagccctcggagaaggcggctccggcggagaaggcccccgcggggaagaagcccaaggcggagaagcggctacctgcgggcaagtccgccggcaaggagggcggcgacaagaagggtaggaagaaggcgaagaagagcgtggagacctacaagatctacatcttcaaggtcctgaagcaggtgcaccccgacatcggcatctcctccaaggccatgtccatcatgaactccttcatcaacgacatcttcgagaagctcgccgcggaggccgccaagctcgcccggtacaacaagaagcccaccatcacctgccgcgagatccagacctccgtccgcctc

SEQ ID NO: 4053 - DNA, 296 bp, Zea mays
  Clone ID: LIB3279-003-P1-K1-G2
cttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttgcatgttggccttattaggactacaactggcaaccgtgtctttggtgccctaaagggagctttggatggcggcctgaatattcctcacagcgagaagaggttggctggtttcaagaaggatga

SEQ ID NO: 4054 - DNA, 402 bp, Zea mays
  Clone ID: LIB3279-003-P1-K1-G3
cccacgcgtccggccatattctcttgccgtcatcttattatacattgtctgtgagtgagaggagatcatatgaatgttgccaagaaaatttcattagtgataagcttgtaaagagaattcttaaagctcatgaaccttataaccataatgacaatactaaatgttctgttgtttctgagagggtatcatatgaatttgctcctgaaaggaaagcttgctcctcattaaacaaatcagtggtacacaatgcaagtggttgtgataaaagcaataggaacaaatgtttggcatctgggaaagctgtgtccaagaaaaaagatcagagtaccaataatagcttggataaagaaaatatgtcatcttgtggttctggtggcacaaaggtgtcatctccaggctcct

SEQ ID NO: 4055 - DNA, 429 bp, Zea mays
  Clone ID: LIB3279-003-P1-K1-G4
gccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaggaggatggcgacgcggtgcagctgaaggtgccgatgccggggctggggaaggagcacgtgaagatgcgggtggagaaggacgccctggtgatcaagggggaggccggcaaggacctcgagggcgacgacgacaagggcccggcgcggtacagctaccgcatcggcctctcctcccaggctttcaagatggaccagatcaaggctgacatgaagaacggcgtgctcagggtcaccgtcccgaagatcaaggacgaggagcgc

SEQ ID NO: 4056 - DNA, 411 bp, Zea mays
  Clone ID: LIB3279-003-P1-K1-G5
ttcggcagaaccgtccagagctctactagcatccatccattgaatccaaagatttacatcagcagagttcaaaacaaaagggagtcaaataccccaagcgcaatgacgtttcacaggcgctgactgcttacattatgccgaagcctgcgtatgtcaggcaagtaaaaattgactgaggcacgtctcgctgatgactcactttgccttgggcctctcctcctccgcgctggctccggcagtctcctggctcgcttgcgcgttggcggcaggcacgggctggatgcgctcgtagcgcttcctggtcagggtctcccccctcagcgcggccacgtacctgtcgttcgtgtcctctttccgttgcagctcgccgagaaactccgccagcctctccctgttcacttgccccatcat

SEQ ID NO: 4057 - DNA, 441 bp, Zea mays
  Clone ID: LIB3279-003-P1-K1-G6
gaaagttgatcgagaagtcttggtagacatggagcagatccagtactccgagaagtactacgacgacacctatgaatacaggcacgtcgtcctcccgcccgaggtcgccaagctcctccccaggaacatccttctctccgagaagcagtggcggttggtgggtgtgcagcagagccgcgggtgggtgcactacgcgatccaccggccggagccgcacatcatgctgttccgccgcccgatcaactaccagcagcaggaggaggaagcggctgccgcgcatgtgctgcccaagtgaagcctctgctggcgaccaggaatgttaaaaacccctagccctcttttcatctctaaaaggggcgtcgctgttgtgttgattaatccctctggctgttgattggaaacttgggatctagttgggtcgacttggtgtgtgcgtggcgc

SEQ ID NO: 4058 - DNA, 430 bp, Zea mays
  Clone ID: LIB3279-003-P1-K1-G7
cccacgcgtccgaccgcccccagcttccctaccgccctcgttccggagcctagggtttgggaagtcgaaggcctcggcgcttcgcttgccagcgcaatgccggatacgggagcgagaggccgcggcgatgagccggagcctgtgacgccgcagcagcaggcgcaggagacccaggcggtggacgatcggcgcctgctgcgctcgcagtacctcgccgtaaagggccttatcagcgacgagaaggatgaaatggcgagcgcggactctgataagttctgctccattatcaacagagtggagagcctgcaccagcttgttcagaggcccagggagcaaatagctgacgcagaaaccctgctggaccttactgctagtttggtagcatcagtaaggtcccaatcagttctgggaatcacaccttctgatttta

SEQ ID NO: 4059 - DNA, 363 bp, Zea mays
  Clone ID: LIB3279-003-P1-K1-G8
cggacgcgtggggcgttgccggcgatgggttgggcggcgcggtacggcattgcggtgggcacggcgcgggggctggagtacctgcacaaggggtgccggaggcggatcatccaccgcgacatcaaggcctccaacgtcctgctcaccgacgacctgcagccgcagatctccgactttggcctcgccaagtggctgccgtcggaatggacgcaccgcgccatcgcgcccatcgaaggcaccttcgggtgcctggcgccggagtactacacgcacggcatcgtggacgagaagacggacgtgttcgcgttcggcgtcttcctgctggagctcgtcaccgggcggaagccggtggacggcagacac

SEQ ID NO: 4060 - DNA, 363 bp, Zea mays
  unsure (1)..(363): unsure at all n locations; Clone ID: LIB3279-003-P1-K1-G9
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccantcccgcggcggccgtggaggcggcggc

SEQ ID NO: 4061 - DNA, 403 bp, Zea mays
  Clone ID: LIB3279-003-P1-K1-H1
gtgggcacgtcgggtaacatcttgagaccggagactgttgaattactgatgtacctgtggtgcttgacggggaataaaacataccacgattgggggtgggacatattccacgcatttgagatgaacttccgcataaaatctgcatatgtgggactgtgagatgtgaacactggtgaaaaagacaacatgatgcagagtttcttcctggcagagacgctgaattacctgtacctacttttgtccgatacatcagtcatatccttcgacgagtgggtttgaaatactgaagctcacccattgagaattgctacagttagtgataacaaatgcattggaacaccggtccgacaattcgagagaaaacagggaaagcctgagtaaccttggatatagagcagtggat

SEQ ID NO: 4062 - DNA, 438 bp, Zea mays
  Clone ID: LIB3279-003-P1-K1-H12
ctttgcttgagaactcagtttttaattgaaataataaacatgcaattaaatcaactttcttttgtttcatgcataaggtaactaacagtcattatcatgcaaacatgtggcaagccatgaaccatttgaagcgctacttgcttaatgtctctcttgatcatttgtgttagtggcatttgtcgaccttgtttttctgtgcactttctgccttcattgcaaaatgtcagtttttttatctgcattgtcgtcgatgactggtaaacatggtagtgttgggggcacgctttagcacctaggcaacaaggtgtgactaagacctcttggcatcatgcggtgtcatacattttttgtacataatatggctcttacaacttattctttcaaacaaatgttattctttttggagacttatttagcaatgatatcattacatgtaag

SEQ ID NO: 4063 - DNA, 51 bp, Zea mays
  Clone ID: LIB3279-003-P1-K1-H2
cttacacttcctctcaccaactattcaacttccttttgctctctacttaca

SEQ ID NO: 4064 - DNA, 426 bp, Zea mays
  Clone ID: LIB3279-003-P1-K1-H3
tcgcgtcgcaggccgctaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggctgtcctggcggacaatggcaggctgaaatatattgaacgcattgcggagagatttgttgatttgactatggaacataagggggagatgaaggttgtggacaggacagttatttcactcaccaaggaggaggagaaagaac

SEQ ID NO: 4065 - DNA, 398 bp, Zea mays
  Clone ID: LIB3279-003-P1-K1-H4
tttggtacaggcgtcggactcccaggaggatgaccggtggcaagaggttcggcggcgggcgggtgccgacggggaccccgtccctcgcgtggtcgtccgtcgtcatcgtcgcctccctcctcgctggcgcctccatcgtccacaacatctacaagcctgacatgaccattccacctgtggagggtgccgccgccggctgacgcattcaacatagctgagctgcgaatggctggacactgcatgcaagagaggaggctgggcatgggagtagtgaggggccggccatctgcacctttttttttgttctagaacaaaaaacgacattatgttgttcttttgtgtttagctaccaaaagatgtgaggctgcatagtatttgcttgcttaggccctactggt

SEQ ID NO: 4066 - DNA, 442 bp, Zea mays
  Clone ID: LIB3279-003-P1-K1-H5
caaatcatagattcatagccacaaaagccacgcacgcggggcgcttgtcttgcgcgcacggaaacccacatccaccgcggcgccacaccgcgtgcgtcggctgcttgctgccccgtgttccttggctcccgccgacaccgagcgccgccactctcaccggccaccgccgccatggctgccccgccccgcgccaccgcggtcctcgcgtggggttccggggaggacgggcagcttggcatgggcgggaacgaggagaaggactgggcacactgcgtggaggcactcggttcctacgccgtcaccgccgtcgtagccggtagccgcaactccctcgccatctgcgaagacggccgcctcttcacttgggggtggaaccagcgcggcacgctcgggcacccgccgaagaccaagacggagagctcccctgcccccgtccacgccc

SEQ ID NO: 4067 - DNA, 439 bp, Zea mays
  Clone ID: LIB3279-003-P1-K1-H6
gccggctcacatgaaagtgttcgtcctcatggcgccgccgcaacctgaatcgggccttttcgtgggcatcaacaagggccatgtcgtcaccaagcgcgagctgcctctgcgcccgtcccaccggaaggggaaagcaacgaacagggtgtacatggtcaggggccttatcagagaggttgctggctttgctccttatgagaagcgtatcaccgagcttctgaaggttggcaaggacaagcgcgctctgaagcttgccaagagaaagcttggaactcacaagagggcaaagaagaagagagaggagatgatgggcgtcctcaggaagatgagatcggctggtacgcacactgacaagaagaaataaagcatttcaagttcatgaatgtggcagccagagattatcaactgtgttttttccctacctctagaaactagacat

SEQ ID NO: 4068 - DNA, 433 bp, Zea mays
  Clone ID: LIB3279-003-P1-K1-H7
cattattcttgttccactgaccactgcatcaggtccaagtccaactctccaagcggcaagcgccatgccttcttccgcgcaggttctgctctgcctcgccgccgtgctcgcggcggcggcggccaccaccgccgaggcgcactcgcagtgcctggacaacccgccggaccggtccatccacggccgccagctggccgaggccggcgaggtcgtccacgacctccccggtggcctcagggcctacgtcagcggcgccgcgagctcgagcagcgccgtcgtcctcgcctccgacgtcttcgggtacgaggcgccattgctcagacagatagcagacaaggttgcaaaggcagggtacttcgtcgtcgtgcccgatttcttgaagggagactacttagacgacaagaaaaactgtacagaatggctcgaggctcac

SEQ ID NO: 4069 - DNA, 428 bp, Zea mays
  Clone ID: LIB3279-003-P1-K1-H8
gcaagagcaagaagaaggctttcacaaagtatgctctcaaatatgaaaatgatgctggcaagaaggaaattcagctgcagcttgagaagatgaagaaatatgcttctgttatccgtgtcattgctcatacccagattaggaagatgaagggtttgaagcagaagaaggctcacctgatggagattcaggtcaatggtggtaccattgctgacaaggtggactacggctataaattttttgagaaagaggtccctgttgatgctgtcttccagaaggatgagatgattgacatcattggtgtgaccaaaggtaaaggttatgagggtgtggtcactcgttggggtgtcacccgccttccccgcaaaacccacaggggtctccgcaaggttgcttgtatcggtgcatggcatccggctagggtctcgtat

SEQ ID NO: 4070 - DNA, 429 bp, Zea mays
  unsure (1)..(429): unsure at all n locations; Clone ID: LIB3279-003-P1-K1-H9
gctgtcctctgtgctatccgctagggtttatctgctcgaggaatggcgtcggtgcaggtctccggcgcgggggtcggtaccgcggccttctctgtgaaggggaaggcctccaccggtgcgctccggcttcgctctacgttgaccttcggcgaggtctgcccggcgcggcgggcgttccgcggcctcgtcgtcagggccgctaccgtcgtcgcccccaagtatacaacacttaagcccttggctgatagagtgcttgtaaagattaactcttccgaggagaagacaactggtggaatcttgctccctacgactgctcagtccagacctcaaggtggcgaggtagttgctgttggagaaagaaggataattggggataagaaagttgatgtcagcattcaagttggagctcangttgtgtattctaagtac

SEQ ID NO: 4071 - DNA, 372 bp, Zea mays
  unsure (1)..(372): unsure at all n locations; Clone ID: LIB3279-004-P1-K1-A1
ggcgcccacgcgttcggaaagcatgtaccaagaaactacctccgagattccaaatgaaacgtattgggtttgagaaggttgatnatacaaatttccacatggacttaattgctggtcttgcaaatatgcgtgccaggaactatggcatccaagaggttgacaagctgaaggcaaaaatttttgcaggaaggatcatcccatttattgcaactttaactgccatggcaacaggactagtgttctttgagcataaaaaagttttggccagagggcacccaatcgaagactaccgaaatacatttgctaacctggccctaccgttgctcaccacatttgaaccttttccccccattgtgatcaaacatggatata

SEQ ID NO: 4072 - DNA, 386 bp, Zea mays
  Clone ID: LIB3279-004-P1-K1-A11
gctttgttttatttttgtggaggagagaaccccgtgttttgcgtggagaagaaggcaagccgctcgacgctcgtcgatgtgcggagcgatgcacaaaaccgaatcgccatcgtcctcacaaacaccgtttggttttgtttatggaccgagagatgctgatcgtgcaagtgatgtggtgccaaccaccagatgcagttggtggacgtactgaaggatggtggacttaaccagtggatgctcgccaagcgagtacctcccccagcaaacactacctaagtgttaaattaaaggtacctccttgctttagttgatggtgtgacttggtctccatccctgccaccgggatagatggtcgagtgggttactgcttccgcaggagaggacca

SEQ ID NO: 4073 - DNA, 393 bp, Zea mays
  Clone ID: LIB3279-004-P1-K1-A12
tgttaatgatgccacatctgttgtgctcttcaatgcaattgaaaaccttgatattgataattttgatgctattgttctgttgaatttcgtcggaaaatttctctacttgttcttcaccagcaccatacttggagtagctaccgggttgcttagtgcatacattatcaagaagctctgttttgccagacattcaactgatagagaagtttctatcatgatactcatggcatacctttcatacatgatatcaatgctgttggacctgagtggaattcttactgtcttcttctggggaatagtaatgtcacattacacttggcataatgtgacagaaagttctagggttaccaccaagcatacttttgcaactttatcattcattgcagaaatttt

SEQ ID NO: 4074 - DNA, 391 bp, Zea mays
  Clone ID: LIB3279-004-P1-K1-A2
gaatccaaagccaaaaccccaatcgcacaggagagaccgagagagaggttttccatccatggctcccggcgtcgcttccgtgctggtcccgcaggagcccgtcctcctcaaggacatcctcgcctcaccgtccccctgcgggaacaccgctgtctccgcccgccacctcttcggcaacggagtcgcgccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtacatggccggcttctccgcgcgcgggtggtgggtctcg

SEQ ID NO: 4075 - DNA, 387 bp, Zea mays
  Clone ID: LIB3279-004-P1-K1-A3
gagaatttgtacaagaagggcgcaaaagaaaaattctcccgcttgctggtgatgttgatgtcatttgtggaggcccaccatgtcaaggtataagtgggtttaatcggttcaggaaccgtgatgagccacttaaagatgagaaaaacaagcaaatggtgactttcatggatattgtggcatacttgaagcccaagtctgttcttatggaaaatgtaggggacatactgaaatttgctgatggctacctaggaaaatatgctttgagctgcctagttgctatgaagtaccaatcacgccttggaatgatggtggcaggctgctatggtctgccacagttcaggatgcgtgtgttcctctgaggtgctcttttttccatggtgctcccta

SEQ ID NO: 4076 - DNA, 208 bp, Zea mays
  Clone ID: LIB3279-004-P1-K1-A4
ttctcctctctgcttgctccaattccaagcaccaaccaattaaggggggggggaaccaaaggaatcccattttttccccccttggttgaattaaatctttgtcagcccgccttgaacttcccccgtaaaaaaccaagttaaccttgcaaccccttatcccgccccaagccgatcgggatccattggtggggaagcccccgaacccaag

SEQ ID NO: 4077 - DNA, 392 bp, Zea mays
  Clone ID: LIB3279-004-P1-K1-A5
ccctcttcgaaatcaaggtagcgtacaccgctgcagtttctagagccctctctgccactcgtgatcccactagtcacaatgcctgccctcgccaagcccgcctcccgcaccggcaagcccgccgcgggtccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcgga

SEQ ID NO: 4078 - DNA, 398 bp, Zea mays
  Clone ID: LIB3279-004-P1-K1-A7
cgtcggttcacttcttcaggtaaggaaagggttcgtactcatggcgccgccgcagccaaagtcgggcctcttcgttggcatcaacaagggtcatgtcgtcaccaagcgcgagctgccttcccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgttctcaggaagatgaggtcggcttggtcgcacactgacaagaagaaatagagggcatttcaagttcatggag

SEQ ID NO: 4079 - DNA, 189 bp, Zea mays
  Clone ID: LIB3279-004-P1-K1-A8
gctgccacagagacatcacagagcggtcctccttgtgagtctgagctgaagaggaggaggaggaggaggagaagcagcacctcacctcgtaggagggagagcgaacatgcgccgtgtacgcgctgttgctcgtccccgtcgtgtgcgcgctgacagcgccatgtggccttttaggtattgacgggcttc

SEQ ID NO: 4080 - DNA, 378 bp, Zea mays
  Clone ID: LIB3279-004-P1-K1-A9
cgagaagacaaagatcggcatcaacggctttgggcggattggcaggttggggctggggattgcaactagcatagacaatattgaagttgtggctgtgaatgacgctaggggtgatgctaagtacatggcctatgtgaggagggcgggcgatgtttaaacacccggtgagacgggggaggggctgggctggaccggaagcggatcaacgacacgctggataagcatctcgagaaggcggtcgcgtcgccgtccacgtatagggggtcggcgggcggcggtgaatatcaccacgaatcttttggggtctttacaacgactgataaagcataagcacactttaagggagggggtaagaaagtggtggtatctgcaccatta

SEQ ID NO: 4081 - DNA, 392 bp, Zea mays
  Clone ID: LIB3279-004-P1-K1-B1
cttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcgagagatgtataaacaggggggagcggggggaggggctgggctggaccggaagcggatcaacgacgcgctggataagcatctcgagaaggcggtcgcgtcgccgtccacgtcgagggggtcggcgggcggcgggcgcgaccaccaccgcctcgtcgtgccgtcctccgtgtcgtccatccccaagggccgctgctccgaaggggagtctgattctgatagtgaagcatcggatgttagcggctctgatggaga

SEQ ID NO: 4082 - DNA, 391 bp, Zea mays
  Clone ID: LIB3279-004-P1-K1-B10
cggacgcgtggggctgtctcgcctctccctagggtcctcgcggcgacgactgggcgagcgcctcctgcgatacctcactccctccaagagcacatctccagcggcgcgcgccgacgaccataggcacatctattacgatgacgtgggctcaccacatccaaagaaagctgccaactcgacgcaaggtgttcaagaaaaataaaccatgcactcttcatcggaggttcaaggcaatatatgaaaataatcttgaggaccttcactagaggggtgagagttctccttgatacaggggaataaagatccaaataagtctgtgacattgaacagaggcagaactccaacggctacgaagcttgtggatctctgcatcccctgggatgttgacact

SEQ ID NO: 4083 - DNA, 149 bp, Zea mays
  Clone ID: LIB3279-004-P1-K1-B11
cggacgcgtgggcgcgtcctccttccactcgtccccggcggcgtccccgccgcgggcgctgctccgggcgtcaagggactcctcctcgtcctccctcttctcctccgccaaggccgcctcctactccgtcgttgtccccggccccggcg

SEQ ID NO: 4084 - DNA, 396 bp, Zea mays
  Clone ID: LIB3279-004-P1-K1-B12
cggacgcgtgggggagctgttgatcagaagaacattaggagatactacatgggtactgtacccaatgcgaggccaacagttaattactcgtacttgagaaacaatgctcctgcaagagcagttggtgcacaaaggaaattggagttggattatcagctcccagagactaataaccataataaggtgacaaaggcagaagcgatgaaccagtcttggtccagaccagcagcagtaaggagcaatgcaggaaatcatcttgccaacgacctgaacccccgtgtacctgaccttgccgagaagctgtctcagttgtcaatgggccccaacagggtgtcgggtttgggttccgagaggtttgttagaacccatgagaacgctgccaagcgccccttgccc

SEQ ID NO: 4085 - DNA, 386 bp, Zea mays
  Clone ID: LIB3279-004-P1-K1-B2
ctcacgcgttcgtcggccaggtctgccgctcaccggatctccaccgtgcttttccagtccccgcgcgcgagagcgccgccccgtgtgggccctagatacagaggggctggcgccgacgcaccctgctcaagggcataatcctcgatgatagcgcggttgggaagacttgcttgttgaaccaatatccgaacacgaagttcagccatcagtacaaggctacgatcggcgcggatttcctcaccaaggacgtacagttagaggacaggctcttcactctgcaaatatgggacagtgcgggccaggaaaggttatagagtctcggcggggcattgtaccggtgagcagattgatgaggactaggctatgatgttaattctatgaaatca

SEQ ID NO: 4086 - DNA, 374 bp, Zea mays
  Clone ID: LIB3279-004-P1-K1-B3
cccgatccttcttccaccttgcacggtcgtgccagggccggcacgcggacggtgcttggactgcccttgtcatggatcgcgccgagctcaccacggagcaggttctcaagcgagatattccatgggagcattacatgtcaactaagcttatctccggaacgtgccttcagcttttacggcgatatgaccacaaaccggagagccagcgagtttttttacttgaggaggatggaccagcatatgtccgagttttcctgaatattctgtggagcatctccaaggaagagactgttgaatacgtgcttgccctcatttatgaaatgcttgcgacaaatcctaaacgtgcagcactgttttacgaccaatctctgtct

SEQ ID NO: 4087 - DNA, 389 bp, Zea mays
  Clone ID: LIB3279-004-P1-K1-B4
gtgggcgacaaggacaagctcgcggacaagctggaggcggaggagaaggagaaggtggaggaggccctcaaggaggcgctggagtggctggacgacaaccagtcggccgagaaggaggactacgaggagaagctcaaggaggtggaggccgtgtgcaaccccatcgtgtcggccgtgtaccagcggtcgggcggcgcccctggcggtgacgctgacggcggtgttgacgacgaccacgacgagctgtagatggttgtagatggacgatggtggtggtgacgtggagtgccgggagccgagccaaattttgtaacggtgtttagcggcggacaatacttattactaatcttggtgctggtctgccaatagccgtgctgagcgtagaaact

SEQ ID NO: 4088 - DNA, 275 bp, Zea mays
  Clone ID: LIB3279-004-P1-K1-B5
cccacgcgttcggggaaaaaggcacttccccgtgaccccgtttcgtgcaggtgtgctaccttcctctcgtcccagcagccgcaagccaaaaccctagcaagcaaaccaccggagcagcggcgctcgcgcgggcggagccatggcggacgacgattacaacgaaatcgacatgggctatgaggatgagcctccagaacctgagattgaggaaggggccggagaagagcttgagaacaacgaatatgcccctgttgatgtcataggtggagagggtg

SEQ ID NO: 4089 - DNA, 392 bp, Zea mays
  Clone ID: LIB3279-004-P1-K1-B6
gggaattgtatactcagcacgtgcttataagataccagaatgtactagaactgctactgggactccgttggtacagttgctacctttatctgatggagagcggataacctccatcattcctgtgagtgaatttggtgagaaccaatatctagtgatgctcaccgttaatggctatatcaagaaagtaccccttaatgccttttcatcaatcagatctactggtatcatatcaattcaactggttcctggtgatgagcttaagtgggtccgtcattgtggcaatgatgacctggttgcattggcttcacagaaaggaagggtaatagtcaactcatgtgataagcttcgtgcccttggaaggaataccaggggtgtctgtgccatgaagttaa

SEQ ID NO: 4090 - DNA, 393 bp, Zea mays
  Clone ID: LIB3279-004-P1-K1-B7
ggatgctactgcaaatgaggaggaagaaaaggaagaggacaaggagatgactctggaggaatttgagaaaataagagaggagaagaggaaagcactacttgcgttgaaggctgaggagaggaaagttgaagttgacaaggatctgcgttctctgcagccactttcaaacaagaaagaaaatgatgaagttttcattaagctgggttctgacaaggataagaagaaggaaaatgctgagcgtgatgagcgtgccaagaagtcggtgagcatcaacgagttcctgaaacctgctgaaggagaaaggtactacggcggccgtggccgtggaagggggggccgtggggatcgtggtggttttagaggcggatacggagggggatacagtcgtggccc

SEQ ID NO: 4091 - DNA, 385 bp, Zea mays
  Clone ID: LIB3279-004-P1-K1-B8
gttgatatttcgtttggttctcctttccgtcttgtccgtcgccgaggcctggttcccctcgctccccagctccagcaggcagatcagatccatccaaccacgaacaggaaggaaggtaggaggcctgaggggctgggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgcctggttccgcgaccactggtcccgcgagcacgcccacctggatgagatagccgagcagctcgagttggtcgccctccttgcctacgatgaggatgaggacctcttctacggcgagc

SEQ ID NO: 4092 - DNA, 276 bp, Zea mays
  Clone ID: LIB3279-004-P1-K1-B9
cgcgaattttcgggccttatttcaccttgcccggtggtgccaggcccttgggggtggcgggtgaacctctgctctcggcaataatccaaaaaacaaaaacttggtctttttcctatgcgagagattccatggtgagggagctcacttcttataacaatcttagcctcgagcattaattgtttctccccccgagaaagctaacccacacccccaatgatgctttctatacaaggacaggcagctcgctttttccagcaaaaacaccttaagtttttt

SEQ ID NO: 4093 - DNA, 366 bp, Zea mays
  unsure (1)..(366): unsure at all n locations; Clone ID: LIB3279-004-P1-K1-C1
cccacgcgtncggaccgatgtaacaagacatccataccactgccaattttacgtgcaatttgaagctcctgagtacgtcagaagaattaggaagatcctttgaactttgagctacaactcttcttcttggcgttcggttacagaacattttacttagaacatctgttgtaacttgtgagctgtagagcagaaacacatgcctgaaatgagttattctataacagatgctcatgtaggcgtttgatctgaaacatttgtttattattattgcggtgtgcatttcagatgctctctttaaagtcgcatcatctagcgtatagatcatgtcccagagaccgttttttttttaaattgaccttttttgtc

SEQ ID NO: 4094 - DNA, 310 bp, Zea mays
  Clone ID: LIB3279-004-P1-K1-C10
cccacgcgtccgctcaggagagtggggtaattcatgaagaagttcctaagcctactgtgtgaagctcccagagaaaatggtactcccatcgaactcgaaagcagggacacaaacattactggaatcaacaatgaggttaaaatgtggtattatcagactttacataactgctatgtttggatatgtccaaaaaaaaaataaggttctattgcttaagactcttctttctgctttaatagctatattttacctttagctatgcttaataatataaatttcaatttgttttggggggggcggttataaggat

SEQ ID NO: 4095 - DNA, 397 bp, Zea mays
  Clone ID: LIB3279-004-P1-K1-C11
cggacgcgtggggtgatagaccccatccagagtgtgaaggggaaggtggttattgatgcattccgcctcattaatcctcagaccatgatgcttggccaggagccacgtcagacaacatcaaatgttgggcacctaaataagccatctattcaggctcttatccatgggctgaatagacactactactcaattgcaatcaattaccggaaaaatgagcttgaggagaaaatgctgttgaacttgcacaaaaagaaatggaccgatgggctaattttgaagaggtttgacactcactcgaaaaccaacgagcagactgtccaggaaatgctaaacctagccatcaagtacaacaaggcagtgcaggaggaggacgaactgccacctgagaaacttgcga

SEQ ID NO: 4096 - DNA, 372 bp, Zea mays
  Clone ID: LIB3279-004-P1-K1-C12
agcatatgcacaagatcactttttcgatgtcatcacaaatgtaattggcctggttgctgcactacttgccaattacattgagggctggatcgatccgcttggtgcaatcgttctagcgatctacacgatcaggacatggtcgatgacggtgctggagaacgtgcactccctggtggggcagtcggcctcgccggagtacctccagaagctgacttacctgtgctggaaccaccacaaggccgtgcggcacatcgacacagtccgcgcctacacgttcggttcccactacttcggggaggtggacatcgtgctgccgtcgaacatgcccctgcgggaggctcacgacatcagcgaggccctgcaagagaagct

SEQ ID NO: 4097 - DNA, 395 bp, Zea mays
  Clone ID: LIB3279-004-P1-K1-C2
gatgctgttaattctgaggagactactgccttggtggaggatgaaaagaaacctttatattcaccacagtctgtggttgagaaggacaaagagggcgccgcgaatgtagaagaaaaagaacctgtcgataaggggatgacttttgaggaatattaaaaggtactgggggaaaaacgaaaagctttactctcccttaagggtgaggagagaaaagttgtatttgacaaggtgctacaggccatgcgacaactgtcatttaaaaaggatggtgatgaagtgtttatcaagctgggctctgacaaggacttgaaaaagaaagaaagtgctgaaagagaagaacggggcacgaagttcctgagcattaacgagttcttgaagccagctgaaggcgagag

SEQ ID NO: 4098 - DNA, 391 bp, Zea mays
  Clone ID: LIB3279-004-P1-K1-C4
attagcagcaataccatttggcacaatggttgtcatgtttgtactttgggcattcatatcttttccgttggtgcttttgggaactgttgttggtagaaactggagtggtgctccgaacaatccctgccgagtaaagactattccacggcctattcctgagaagaagtggtaccttacaccttctgtcatctcattgatgggtggcctgcttccctttggcagtatcttcattgagatgtacttcgtgttcacatcattctggaactataaggtgtattatgtctacggtttcatgttgctggtcttcgtcatccttctaatagtcaccatctgcgtcaccattgtgggtacttatttcttgctgaacgccgagaactatcactggcaatgg

SEQ ID NO: 4099 - DNA, 391 bp, Zea mays
  Clone ID: LIB3279-004-P1-K1-C6
acgaatggccttacacgtactggccacctgacaaccaagatcatcatggatagtagcaacagggacctggtaaatagtggcgatgatgtgaatgctgaaggaacactaaccgcaaccactttcactggaatggtttttgtctgcttgaatatgcagcgttgctttcttggagaatgtacacctacaatagtggggaaagaacagagaaaaaaaacatatctctgtaaatctccctcaataaagaaatgaggataaaactagttaacagtgtgagctctccaagacagaagagacaaaatggccaacgaaaagagaagggggaaagaccgatgggaggaaaggtactgtgtgtgctgacattgaagggatcatgtgtggacccgtagatgta

SEQ ID NO: 4100 - DNA, 398 bp, Zea mays
  Clone ID: LIB3279-004-P1-K1-C7
ctcaatatgtcaactctgacatggtcagttgttagcactgtggaaggacgggttcctcttgccagtgagggcatgactttaatgcatagcaattacaatgggtatgattatctcgtctcttttggaggatacaatggacgatacaacaacgaggtttacactcttaaactcagcctcaaatcagattcacagccaattgtagaagaagaaactgtctcagatactatatctagggtcagagaacctgagaccgaaatttctcaagatgggaggatacgcgagattgccatggacagtgccgattcagacctgaataacagaaatgatgaagcaagtgaacagcttgtagcagatcttaaagctcagaaagaggaactagaagcaacaattaacaggga

SEQ ID NO: 4101 - DNA, 403 bp, Zea mays
  Clone ID: LIB3279-004-P1-K1-C8
cgggctttcgtgcttaaccttgagagaacaaagttgcttgttggcgaagttcgcccaaccctattttttgcagaacgaggaggggagaacggtggcccctttcttcccagggagaggtttggcaccaacaggatcattactgtcaaggatcattcctctgtccagatcaacattggccacttggatgcgaatggcctgtacgatggtcacttcaccacgtttgctctctctgggtttgtccgtgctcagggtgatgctgacagctcgttggacaggctgtggcagaagaagaaggctgagatcaagcagtagatcttgcacgtagttccaccagtaatgcactctcgagggatactgctctagctatgctttagctagggggggatgattctgatgtttggct

SEQ ID NO: 4102 - DNA, 398 bp, Zea mays
  unsure (1)..(398): unsure at all n locations; Clone ID: LIB3279-004-P1-K1-C9
cccacgcgtncgctttcacctcttgagatctcaatcatcttgtcatcatttgtgcccaatggttctggatgtttcattgactgatgttttacttttttcaagagctggtgcctggaggtgttaactcgccagtccgtgcctttaaatctgttggtgggcagccagtagtgttcgactctgtaaagggttctcgtatgtgggatgttgatgggaatgagtacattgattacgttggttcctggggtcctgcaatcatcggccatgcagatgataaggttaatgctgcattgattgaaactctgaagaaaggaactagctttggtgctccatgtttgctggagaacgtattggctgagatggtcatctctgccgtgccaagtatcgaaatggtccgcttt

SEQ ID NO: 4103 - DNA, 377 bp, Zea mays
  Clone ID: LIB3279-004-P1-K1-D11
agcccaacaacctctacaatttacactcctacaagtactctggcttagcaaacaagagaactgtaacgatccagccagctgctggaaaggactcggctgtggtcctctctactaccaagaccaagaagcagaacacacccgcgaagctcagccacaagtctgtgatgcgcaaggagttccgcaagatggccaaggctgtgaaaaaccaggttggcgacaactattacaggcctgatctgaccaagtcggcccttggtaggctgagctctgtgtaccgcagcctccaggttgccaagtctggtgtcaagaagaagaacaggcagcctacgcactaagcctgtgttctggtcgtggtgcccatagtctcagcttatatt

SEQ ID NO: 4104 - DNA, 361 bp, Zea mays
  Clone ID: LIB3279-004-P1-K1-D12
cgaggcggaggctgctgctcctgctggtcccgaggagactcctgcggtcgagcaggaggcagccgccgaggaggaggctgctgctgctcctcctgctggtgccgaggagcccgccgcggccgagcctgtcgccgaggcagaggctgctgctcccgaggagctcgccgcggacgagccggaggctcctgctcctgctcctgctggtccccaggagccggccgacgaggcggaggctgctgctcctgaggagcccgagaaggccagcgagtgaggccgctctcacgcagcgggcgcggacagggcccaggccccaggggatcagggtgcgcgcgtggcgtagtagtatctcgcgcgcgtacat

SEQ ID NO: 4105 - DNA, 209 bp, Zea mays
  Clone ID: LIB3279-004-P1-K1-D2
attagtaggataatggcaattctcctagtaatgaacccaaagatagggctgagatcatcaaaaagaatgttctttcaccatttttctttcatgaggagggcgttcaatgctacaggggttctatattttttttatcagaccaggatgtttcttctgtgggtgagtttatccaagctgcaactcttgttatccaaccagctctttacttt

SEQ ID NO: 4106 - DNA, 366 bp, Zea mays
  Clone ID: LIB3279-004-P1-K1-D4
cggacgcgtggggggtttgccgtgtgtgcgctaacccccacgggttgatccgaaagtacgggctcatgtgctgcagacagtgctttcgcagcaacgccaaggacattggcttcatcaagtaccgctgaaacttggggagctccaaagcatggcaataatggaagcatggatggggacctaaaagatagcctgtactcttattcttatgataaaaccatgtaatgaattgtttggctttgtgtggacgaagttggtgtattctagatggtactcttgaatcttgatgcttccctgctatgctagctgagcatgtcgaaccgctatgaatcagacaatacagtatcaatgttaccactcagtcttgtt

SEQ ID NO: 4107 - DNA, 369 bp, Zea mays
  Clone ID: LIB3279-004-P1-K1-D6
cccacgcgttcgacaagcaggaccagctagctagctcctaccactgctatcacccgggccccggccagccatcttgctgaaagagaaaagcgcagccatgaacactactagctagggcattgcagtcgtcctcctggaggcgatgctggcagtccacaccgcggtggccgacatataaggctccgacgtgctcaacaacctgtcaccgtgcctgcccttgctgcagggcaaggctaccaaacccagcgagagcaccaaccagtgctgctacagcgtgaggaccctgtacgcggcgtgggacaccaggctccgacaggcaagccacgtgccggtgcctgaaggcagcctacgttcaggaccacactgtgc

SEQ ID NO: 4108 - DNA, 358 bp, Zea mays
  Clone ID: LIB3279-004-P1-K1-D7
tgtgcatcggatgggttctcccaagtgttctagttgcaggtcctaatcatagccgaggtggaggccaaattcctattgtaattgccattaactaatccaattagtaggttcaattactggagggcacgaatcgtttttgttgcagagcagtcgtagtactagtagctttctggtggtgctccgtctctgcctgatctgaggcagcgtttacctttctgttggtcttgcaaagttcagttccctggatggcgacgatcactgacgatcttgtgatgaacttcaaatggtaatggaatctgcagttaataatcgacatctatatgaccttcctgtgatcgtaaaaaaaataaaataaaaa

SEQ ID NO: 4109 - DNA, 362 bp, Zea mays
  Clone ID: LIB3279-004-P1-K1-D8
atgggcattggttgatgatggcagattggcgtggaaatggacccagagagagggctaagatcgacaaaaacatggtgagtatcatcgtatatactttcatgaggagggcgtacaacgacacaagggtcatatattgtaattaccagacgggcttttgcctccttgaagtgagttaatccaggctgagcatcttgtgagacaaccagctctttactataatgaactgctggagcaacgtcatgctggtacatgaataatgcatccatatgtagcaaggactaaaggtccaagaaggctcgacctatttgagtctggggtgaatcatgcactggttgtcggcataggaatacagatactgcaac

SEQ ID NO: 4110 - DNA, 307 bp, Zea mays
  Clone ID: LIB3279-004-P1-K1-D9
acgcccacgcgtacgtgcctttctccttactagtcgctcccccgcggctcgcgcaggcgggcgacacaacgaggctaaatccctatcgcgaggaggcgtgtgaggccagcggctttgccatgacagcaccagcggacaaggggaagaaggccaagactgatgccgacggcggcgaggagaacgaacagatcgacggcgttctcggcctctctatcgagaagctccaggagatacaagacgagctcgagaaggtaaatgaagaagccagtgacaaggttatggaggtggagcagaaatacagtgagat

SEQ ID NO: 4111 - DNA, 398 bp, Zea mays
  Clone ID: LIB3279-004-P1-K1-E1
acgcccacgcgtccgtgccttcctcctcactagtcgctcccccgcggctcgcgcaggcgggcgacacaacgaggctaaatccctatcgcgaggaggcgtgtgaggccagcggctttgcgatgacagcaccagcggacaaggggaagaaggccaagactgatgccgacggcggcgaggagaacgaacagatcgacggcgtcctcgtcctctccatcgagaagctccaggagatacaggacgagctcgagaaggtaaatgaggaagcaagtgacaaggttatggaggtggagcagaaatacagtgagatccgcagacctggctatctcaagaggggtgacattatcaagaccatgccggacttttggctcacagcgtttatgagccatcctctattaagt

SEQ ID NO: 4112 - DNA, 394 bp, Zea mays
  Clone ID: LIB3279-004-P1-K1-E10
gaaggctggaagtggaaagaagtgggttcttgcttgagctgagctctgcctcttgctgcccttggatctgtttgggagtggagaacgcagtatggggcgcggcaagatcaagatcaagaggatcgagaactctaccaaccggcaggtgaccttctccaagcgccgggccggactggtcaagaaggcacgggagatcggcgtgctctgcgaaaccgaggtcggcgtcgtcatcttctccagcggcggcaagctctacgactactgctcgcccaggacctcgctgttcaggatcttggagaagtaccagaccaactcggggaagatactgtggggtgagaagcacaagaacctgagtgcagagatcgacagagtcaagaaggagaacgacaacatg

SEQ ID NO: 4113 - DNA, 210 bp, Zea mays
  Clone ID: LIB3279-004-P1-K1-E11
tcgcggacgcgtgggcggacacgtgggcggacacgtgggcagtggcaccagctggaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggacc

SEQ ID NO: 4114 - DNA, 398 bp, Zea mays
  Clone ID: LIB3279-004-P1-K1-E12
cagcccccgtgaccgtgaaccaatcagttgtccagttccgctccggcactcccacccacccggccacccacgcccgcgagcgaccaactcccctctcgaacggttcgggccttggcagtcgacagatcgatcaatcagcaccgaccactcgcgatccgattcgaatcgagccagagtcccaggcagcggcggcggcggcggcgcccgcctccaagaccacctccacccggaccccagccccaaccccaagttaacagatgggggacgttgcgaaggacttgacggctgggaccgtgggaggggctgccaacctcatcgtcgggcacccgttcgacaccatcaaggtcaagctccagagccagcccacccctgctcccggacagctccccaagtacgcc

SEQ ID NO: 4115 - DNA, 387 bp, Zea mays
  Clone ID: LIB3279-004-P1-K1-E2
tcgcccacgcgtacgtccacgcgttcggacagacgggcttttctttcagcatgcgggtcatagggataagattgtagacttccactggaattcgtaagatccttgcacaattgtgagtgtctatgatgatggcgagagcactggtggaggtggaacactacatatttggcgcatgagtgatttgatctaccgcccagaggatgaagtttttgtagagatgcagaatttaatggctcacttggccagctgtgcaccgaagaattgagtcatgtggtttacctggggaatgcaatactgtggaaactgagtaggtgttgtaatttcctggccataagtatgatccccaggtgacattcaatttgtcctctgatgctcctagagctgtac

SEQ ID NO: 4116 - DNA, 222 bp, Zea mays
  Clone ID: LIB3279-004-P1-K1-E3
tcctattccacaagatgacgctcaagggcaagcttctagatactcagagcgtgaccatagtactgctcttcgtcacagtgaaaagtggaatggtagatcacgtttctgttaacaaacaaatgcagatggtctaaagatttgtcaaggttaggatgcgatctgatcgcataccacaaattggcgacaagtttagcagcaggcatggacaaaaaggaactggtg

SEQ ID NO: 4117 - DNA, 390 bp, Zea mays
  unsure (1)..(390): unsure at all n locations; Clone ID: LIB3279-004-P1-K1-E4
gccggcaggggcgacttccaggagctcgaccagatcgccgccactaagcccttcgccaagctcgccgtcaaggcaacaaccatcgccgacatcccgcgcctcgtcttccaggccctcgccgccgccgtgtccggccgtcccggagggtgctacctcgatatcccgtccgacgtcctccaccaaaccctccctgaatccgaggccgcggctctcattgcagcagccgccgccgattcggccgcatccgatccttccccgtcaatgcacaagtctcttgacgagggaatcgcgaaagctgcggacctgctccggtgtgcggaacggcctctggttgtgattgggaagggtgcggcgtatgcgcgcgcggaggaggcgattcngaagctggtg

SEQ ID NO: 4118 - DNA, 333 bp, Zea mays
  Clone ID: LIB3279-004-P1-K1-E5
tcctattgtacaaaattacactcactggcacacttctacatacctggagcgtgtccatagttctgctctgagtcacaaacaatgtgctacgtcccatccctttcttttaacaacatatccggattcttgtacattcgtcccggatagtatttcatctttatcccgtcctccgttcgacaacaagcctttcctctatcctaggccaaacgtatcattttagaagacttactctcaataggcttatccttgcctattctattgcatcacacctctttttatctgggattcacaaaactttccatcccgtttccttttttgggtaccgtctttatt

SEQ ID NO: 4119 - DNA, 393 bp, Zea mays
  Clone ID: LIB3279-004-P1-K1-E7
aaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttca

SEQ ID NO: 4120 - DNA, 382 bp, Zea mays
  Clone ID: LIB3279-004-P1-K1-E9
tgaggatctgcaaagatcttagcagcatcggagacacagtcgtcatctcggtgactaaggagggcgtgaaattctccacatctggagaaattgggagtgcaaacattgtctgcaggcagaaccaaactattgacaagccagaagaggctaccattatagagatgcaggagccggtttccctgacctttgccctgcggtacatgaactccttcaccaaggcgtcttcactgtctgagcaagtcactatcagcctgtcgtccgagcttccagtggtggtcgagtacaagatcgctgagatgggttacattagattttacctggcccccaagatcgacgatgaccaggagatgaagccctgatggcctgtgacgacataatggtc

SEQ ID NO: 4121 - DNA, 395 bp, Zea mays
  Clone ID: LIB3279-004-P1-K1-F1
caaagctccgaaacagagcccaaaagactacgagctcgcggggaagacggggacttccggagagagagagagagagagagagagagagcaggaagcaggggctagacgcggatcggcgagcatgaggggcggcggcggcggcgggatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgtttctagagatggacagagagcacgacaacgtcgtcaactgcaccacccccaacttcactggaattatctctctgatggaccccagtaggagctgggcagcccgttggttgagaa

SEQ ID NO: 4122 - DNA, 320 bp, Zea mays
  Clone ID: LIB3279-004-P1-K1-F10
gtcaagcaaagctagttctctaagagagaaggcggataattctcaagtccttcaaaaacttctccatgaggctaaggagtacaggggaatactgaagtgtggtatttgtcatgacaggcagaaagaggttgtgattgccaaatgctaccatctcttctgcaaccagtgcatacagaagtcgcttggtagccgtcagaagaggtgcccgtcttgtggactaagcttcggtgttaacgatgtgaaacctatctatatatgaaacagaaggttggcgcctgtgtcgcacacaccagaactgcctggtgctctactgattcccg

SEQ ID NO: 4123 - DNA, 131 bp, Zea mays
  Clone ID: LIB3279-004-P1-K1-F11
aacccatgtttcctaggaggagaacgtcacccttggacccactgtccgtgaaggagagtatgtctttggtgtccctcacatctttgcatccttcaatgacaccttcattcatatcactgatttgtctggga

SEQ ID NO: 4124 - DNA, 362 bp, Zea mays
  unsure (1)..(362): unsure at all n locations; Clone ID: LIB3279-004-P1-K1-F12
cgccgncccgctccctagtggtgctccctcccccaccactgcagctccgtcccggcggccccaagagttgcggcgaggatgaacgtgaagggcggcagccggattccggtacccccgccgggggccagcgcgctggtcaaggtggccgtgttcggcggcgccgccgtgtacgccgccatgaacagcctctacaacgtcgagggtgggcaccgcgccatcgtcttcaaccgcatccaggggatcaaggacaaggtataccctggagggactcactttatgattccatgggttgaacgaccaatcatttatgatgtccgcgctcgaccaaatcttggtgagagtacttcttggagtcgggatct

SEQ ID NO: 4125 - DNA, 257 bp, Zea mays
  Clone ID: LIB3279-004-P1-K1-F2
ggcttcaagtgcggcatcaactaccaacctcctagcgttgtgcctggtggcgacctgcccaaggtgcacggtgccgtgtgcatgatctccaactccaccagtgttgtggaggtgttcttcctgatcgaccacaagttcgaccttatgtacgccaagcgtgccttggtgcactggtacgtcagtcagggtatggaggaaggtgagttctgtgaggcccttcaggacctggtggtgctcgagaaggactactaagaggg

SEQ ID NO: 4126 - DNA, 361 bp, Zea mays
  Clone ID: LIB3279-004-P1-K1-F3
ttctcctccttcctccctccgtacctacctcgctctcccatccttggctgtgctcacaattttgggttctgaatttcctgccggtgtgtgccggcatcttctttctactgaggcgtagaccaaggaggagagtaattggcgagcggttggagaacgaatacgagacggctccggcggccggaggcccattttttgatgcgtggtgccgtcgaggtccacacgattcgcagagacgtcgcctcgccgagccccctgaggctcagagaccctacggcattggacatgatgaggtaccaaaggctgagcccggactgccttccgctcggcaacagcagtggcggaggcggaggctccttgcccc

SEQ ID NO: 4127 - DNA, 383 bp, Zea mays
  Clone ID: LIB3279-004-P1-K1-F4
gagacttccagccatcccttctacgctctccccgttcccgtgtcgtcctcccgacaaagagggagccgctagggtttagcggcttccgcttctgggcgagggcttacccgcgagggacggcgcgacgcggcggcacttgagctagggtttccctccgatcccgttcctttcccggcgaggcgatggacgaggcggcgattgacgacttgatccggcggctcctcgaggcccgcggcgggcgcaccccgcgcaacgcgcaggtgactgacgccgagatccggcgcctctgcgccaccgccaaggacgttttcctctcccagcccaacctcctggagctcgaggcccccattaagatatgcggggatgtccatggccagtattca

SEQ ID NO: 4128 - DNA, 396 bp, Zea mays
  Clone ID: LIB3279-004-P1-K1-F5
cccacgcgtccgtgatctcaacccaagtcgtgcctccgctccggtcacccggcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgatgagtcgtcaccttacgctgctatgcttgctgctcaagacgtcgcacagcgctgcaaggagcttggcattactgcactgcacattaagcttcgtgccaccggaggcaacaagaccaagaccccaggacctggg

SEQ ID NO: 4129 - DNA, 354 bp, Zea mays
  Clone ID: LIB3279-004-P1-K1-F6
gtgacgcatgggtagggctgtaagggagaacgcggttactttttaaggatcatggacacgtagctccccggtgatcccgtgcggccaaacatgtaagggcgcaatacattatgtcccgccaaaataggctaggaggtggaagagctcacgtccattctggaggctcggaatgagaaacgcgtttcatcacagaaagggcatgtcataccttaagaccacttggtcagcaaagaaaaggagctcatcaaggtgcataccaaggggttggtaggcttctcaatgccgcgcgccaggcacagaaatttctctaagaattgcacccatcatggactaaagatgccacagttattgcat

SEQ ID NO: 4130 - DNA, 393 bp, Zea mays
  Clone ID: LIB3279-004-P1-K1-F7
cggacgcgtgggctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggc

SEQ ID NO: 4131 - DNA, 396 bp, Zea mays
  Clone ID: LIB3279-004-P1-K1-F8
cccacgcgtccgcccacgcgtccggtgcaaaatatgacagagcttacaatattcttcacagtgaccatagtgttactcctggaagtcctgggttaagtcgcaggtctgcttcaagctctggtggctctggatcggcgtttatacaattggatccagaagtacaattgccatcaggaagtggaaggtgactgttgacttatagtaacagcagcatgtcacctatatactgaactatgactatgtgatattttggtactgaaagaacttgtccatctaaagttgttttcgtcatcacaacagaacctcttattgtatatgctcgtaactagtgagtgcagaaactaaagtgtgtaatcttcttgatgaagtggcaggcaaataaaaaaaatgtctagc

SEQ ID NO: 4132 - DNA, 383 bp, Zea mays
  Clone ID: LIB3279-004-P1-K1-F9
cccacgcgtccggagagagattgaattggatacactctagacttccaaatggagaggtggtctgctggaaaagaggccaacttacatgctttgttatcaactttacaatatatactttggccagaatgtggatggcaagctgtatgattgactgatttaattactggcgctgctggtaagaagctattcaggaaggcaacgttgtgcattgatcctgatcacggtgcaacagaaaggtgcaccacttcagcataaatatatagcctcaaaagtctttcacattcttaaggaggcatggaacaaattcaactctgaatagctcttctaaagcaacctccgggcctgtgaatatgcatatataatggacagcttaaccgcatacc

SEQ ID NO: 4133 - DNA, 359 bp, Zea mays
  Clone ID: LIB3279-004-P1-K1-G1
gtagacatgactaggatgcaattgtttggttccttagtctattatgtacactggctccattcatgcattccccctctcaccgccttcctgaacgtgtttcttataatataaagtgataaagttgaaggtggccacactaagtacgataaaaagaagaaaatgccagaggatggtaatcaacatgttggtgctggcaggtctgatagtgcaaggcacaagttagatttggatttgcatttatcagaaagtaaaacatgttccatcagagctgagctaaggagtaatttgtagtgtcttggcaagattcatggtttaaacaaccaactgaatatgcgcaagaggatcaagagagaataaga

SEQ ID NO: 4134 - DNA, 317 bp, Zea mays
  unsure (1)..(317): unsure at all n locations; Clone ID: LIB3279-004-P1-K1-G11
cccacgcgtncgcatggaagttaagcggcataaaaacaagatgaccaagacttcagcataatgttgtgactaaggtcaaggcgactatggtcatggatgtaccagacgtcgtggaaaaggagctcatggtggcacatcatggaagaatgtggcacatggctcagatggtggtagttgttgaaactattcatcttcaacacactatcgaaaggtcgagcttttgaatcacccaacaagaatacctaggcatagtgattatcgacagttgaaccaaattatttttttgtctttactagtatccaagtttacctttttat

SEQ ID NO: 4135 - DNA, 341 bp, Zea mays
  Clone ID: LIB3279-004-P1-K1-G12
tcccccacccgtttggtggaacatggttaacaagaaagtgataaacggattcaaggtgaggcgctgggcatgtataaacttctcaaggagtgttccagaagccacagctcggggattttgccaggaactggcacaaatgtgccaaattttgggcatggaatttaacagtgagcccgtgatgccaatatactcaactagaccacgatcaagttgtggagggacttaaaagtgggtataattattgcactgaacaaacttaagggttaagaactttgaccttctttggctatactcgccgacaacaaaggtccgttatatggtgccatcaaacgtattttgtg

SEQ ID NO: 4136 - DNA, 373 bp, Zea mays
  Clone ID: LIB3279-004-P1-K1-G2
acagaattgaggactatctatggtcagctatgtcaggatgacatgcctatgggcagaagagcagctgcatcaaatcttggaaagtttgcagctacagttgaacagaatcatttgaagacagaaataatgtcaatatttgatgatttaacccaagatgatcaagattcagtgcgtctgttggctgttgaaggctgtgctgcccttggtaaattgttggaaccacaagattgcgtagcacacattcttccagtcattgtcaatttctcccaggataaatcatggcgtgttcgttatatggtcgccaatcaattatatgagctctgtgaggctgttggccctgagcctacaagagctgatttggtgcctgcctatg

SEQ ID NO: 4137 - DNA, 337 bp, Zea mays
  Clone ID: LIB3279-004-P1-K1-G3
gcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggac

SEQ ID NO: 4138 - DNA, 392 bp, Zea mays
  unsure (1)..(392): unsure at all n locations; Clone ID: LIB3279-004-P1-K1-G4
gagagagtgagaggggagagagagggctagggttttgtgccccccacgcctgacgcatggaatccgagccgggtcggggttgctgcgaatcgccggcggtgcttgatgattcaagcctgtgtggtaggtgccgtgcttgctcgtcctaagcgattttagggtggtcgtccttgtcgctgtgagctggttgggggctgtgtggatttggttttctggacgcgggaattcaaaggctgtgattccattgcaatggcatctgaaactgatgagaaagctaagatggagagtttgacatctgctgcagcctttgtggagggtggcattcangatgcatgcaacatttgccttgaggccttctgtgagagtgacccttctgcagatcaaccaaaatg

SEQ ID NO: 4139 - DNA, 388 bp, Zea mays
  Clone ID: LIB3279-004-P1-K1-G5
attgcaaatctcttggtacaccatttgcttcacattttaaattgtcatcgagtcaatgtcctgttactgaagatgagacaagtacatgtctcacatgccgtattctattgttgttgggaatcttatgtatgctatgatctgaacaagacccgatttgctcatgatgttagtgtggttagcagatttatgcacaatcctggtaaagaatattggaatgcagtaaagtggattcttcgctacttgaaaggtacttctcatgcattttggactattgtttgacaagaattcaatgaaggcaattgatgttatgtgatttgttgagtgatttgttgattttgactttactagtgatcttgataagagatgctccatatcttgctatgttttt

SEQ ID NO: 4140 - DNA, 347 bp, Zea mays
  Clone ID: LIB3279-004-P1-K1-G6
agggcgcgtggggcgggatataatttgaaacagaactgaaattgctattacggtaatgtaagggcgctgaatatgtgacaagtcattttgtgcactactgggtaatattggtcgttggaatggtatctatgctttgatctgaacatgaccaggttttctcatgatgttagtgggcgtaggatatttatagctaatgaatggacaagaatattgggatgacaggaaatggatgcttctgtacgtgaagagcgcttcgtatggatagagggctattagtaagcgtgctatgagagggatgcaaagattgtgaatgcatgagtaagagatgtcgaacgctaggattatac

SEQ ID NO: 4141 - DNA, 164 bp, Zea mays
  unsure (1)..(164): unsure at all n locations; Clone ID: LIB3279-004-P1-K1-G7
cccacgcgtacgcctacgcgtgnggagagagttatctatctagccactatagactaaataatgaacaggtggtctgctgagaaagacgccaactcaaaagcttccggaacaactatacaatatatactagggccagaatgggacggggccacagtataaatgac

SEQ ID NO: 4142 - DNA, 304 bp, Zea mays
  Clone ID: LIB3279-004-P1-K1-G8
ctttttctttcttgttccggtgctgttcttggcgcggattcgtccttgggctggagaggtagctgggttcgggggatgctgccgcgctccatgcgtgctgcatggcggtttctttcgtttccgtttgactaaaaatatatataaaaaagagaattttctctgtgcgtgctcgttgctgcggaatggagtgagctaacggacagcgcgtcgtgtttgttgggcgttccggcagatgatcctggccgcgatcgaagacctaggcgacaagagcgggtagaacaagtcggccatctgcagtcacatc

SEQ ID NO: 4143 - DNA, 336 bp, Zea mays
  Clone ID: LIB3279-004-P1-K1-G9
gcatttgctcgtgagatgcttcatcaacgcacaagaacattggcgccaccgaccccctggcgctgtcaaccgtgtggcatattccaaaccagctgatcctatcacttgtgcaacatttgctcaagatgtcattgaaggtcgagcaagcgttttacaagctcacgagcacaaacaccagtccctgatatttggacctgcaagtattgccggtggtggtttaaccagtgaacgggaaagaatgacagcgcatgtttttcagcctagctacaggatgccaacaatgagcattggaggagctggtttgcgcgagatgaaaatgttggagaaatggcaaga

SEQ ID NO: 4144 - DNA, 305 bp, Zea mays
  Clone ID: LIB3279-004-P1-K1-H1
atcaatttctatagttgatgacaagggagcgctccatgatgtttactcactgagggacatcatggctgtggcgaacaatgatgtttatgctcgcatcgaccttgaacaagtgcctgggcaaaatgctttggatgtgcaatcccaggggcatggtcgacgacggtgttatacttgtttacagacaaataccttgctggaagtttaaaaggaatggcttattcaaggagtccgacggctcgttgttattgaacaaagcaccatatttgtggaaggaatgatctaattgggggacatattaacatttc

SEQ ID NO: 4145 - DNA, 403 bp, Zea mays
  Clone ID: LIB3279-004-P1-K1-H10
gcaaaaattgtctcatgatggttgcaagatagtttgctttgttggttgttactccttttgttctaaactataagatattttgttttttagatacaatagtttttctaaatatataggagagataatatatatttaaatgtatagcaaaattatatagttaaaatgaaaatatgttatctatactatacttaaagcaccagtttcaacggtcgtcatgcgtcatctttttacaaataaccctcacaactatttcaaattaatccgttgcacacctataaatggccaaacagtggctcggcacgggccagatgcacgcggaccacaactatggcttaggcacgttatgccggcctactgactgtgccgggccagcccatcggcccatttggttaaatcagcataa

SEQ ID NO: 4146 - DNA, 392 bp, Zea mays
  Clone ID: LIB3279-004-P1-K1-H2
attctgtcaatgctgaggatttcttctgccgcttcgagtataaatcagatactggcagctttgtaccagatcgtatagcagtgtttagcaagtgcgagatgccatacaatccacatgaccttatgatccaatgcgaagaatgttctgactggtttcaccctgcttgcattgtggtgacaatcaaagaagcaaagaaactggagcattttttctgccagacctggacagctgaaaatggtgagatggttgagaattcacatgaagctacagcgcaatcagaagaaaagctggtggagtcaaaaaggctgctaaggtgatggccgtgctgattaaatttatgaaatctatgctgcggtgtacaaagccttcccacgtttcacgtttgagaactg

SEQ ID NO: 4147 - DNA, 225 bp, Zea mays
  unsure (1)..(225): unsure at all n locations; Clone ID: LIB3279-004-P1-K1-H4
cccttgaaacctgnnatgtagatcgttggtggtcggcacactcccattcaatctatattcgatcacggttaagaaattcactaactgcgtcgcattggaggtttctcgctcagaatgtcgtgggattggaaaaaggagggagcctacactcggagaagatcagtgcaagaacacactggtggacatctggctgtcaaatgggttatttcttggacacttctgagc

SEQ ID NO: 4148 - DNA, 327 bp, Zea mays
  Clone ID: LIB3279-004-P1-K1-H5
acgtccacgcgtgcgcaaatccccaaagcctccgacccccttcctctctccctccgccgccgctgcgcacgcagggaacaagcgacatgggcgtctacacctttgtgtgccgcaacaacggcggcgagtggaccgccaagcagcactccggcgagatcgaggcttacgccgctaccccatacgagctgcagcgccgactcgtcgctgccgcctccgcggacgactctgcctacggcgttcaggcgtacttctacatggtcacccccagctccgccgtgttccaggtgatcgttggtgctgtcggtggtggtgcaatgatggtgagcg

SEQ ID NO: 4149 - DNA, 401 bp, Zea mays
  Clone ID: LIB3279-004-P1-K1-H6
tacgcccgcaggtaccccggtcccgcgaattcccggggtcggacccaacgcgtctcggtgacaggagcagcacacagctacgatcgtagcgagcggagttcgagcactattagtatataggttgcaggtgcgattcgagaggctattcgctatgtggttgcggagtgtgctgtgtgaaatttgaggactgcacgacgacgatggcacactgatgaatccggtgagacggcgaccagctttggcatgggctggattctgattattcgctacgtaaggcataacggtgcctctggtgtcgatcttggcctcagtatcagagctgtattctatgcatagaggacgtacacggacatagaaaagggggagacggggaaggagaccatggatttcttcccccagat

SEQ ID NO: 4150 - DNA, 359 bp, Zea mays
  Clone ID: LIB3279-004-P1-K1-H7
cgcgtccaaccttcggtcattttttattattcgatccaaggtaggcacccaagacctttactcactggggatcgatatggctcagggacaaaaagaaatttatggtgaatacgaccgtgaacgaggagctcgccgacaagattgcgctcgtcaataagaagccgaaggcggaaaagcgggtctatgctggtaagtacgctaccaacgaatgcggctagggcaagaggggctagattaagggcaagaagagcgtcgagacttattagatctacatcttcaaggtgctgaagcaagtataccctgacattggcatctccttcaaggtcatgttcatcatgaactccttcattaacgatatc

SEQ ID NO: 4151 - DNA, 363 bp, Zea mays
  unsure (1)..(363): unsure at all n locations; Clone ID: LIB3279-004-P1-K1-H8
cgacatctttgagaagctggccggcgaggccgccaagctggcgcggtacaacaagaagcccaccatcacgtcccgcgagatccagacctccgtgcgcctagtcctccccggagagctcgccaagcacgccgtcttcgagggaaccaaggccgtcaccaagttcaccagcaactgagcgcgctgcgggatccgcggatctgttagaagggttctttgctgtgtcctttccccagtcccccaccctacccgcctagtagctagcttgcctgctctataaatccggcgcgccggattgtaatggtcctcttagatttgatgtccctgttgtggaatatagttgtatctctccgcttgcttttnaag

SEQ ID NO: 4152 - DNA, 333 bp, Zea mays
  Clone ID: LIB3279-004-P1-K1-H9
caactgacaactggcttggctgtttccgtccaaaaactcgaacctccgtggctgggtgcgcccggcaatctcgaaatcaacgagatcggcgaccaacacggagatctcgaaccccgggaaagatccaacacaaccgaggtggagggggtctcgaggcagcggcgttgaattgacgatgtgtgacatttgggaggaattccggccggggctttgcatatccgggggaaaccgtcgtccgcccccaaccttccttcccccgaatctcgccggcgggggtgacaaaaatggcggtggtgtcaaaggtgccggtggccagaaggagggggccataat

SEQ ID NO: 4153 - DNA, 391 bp, Zea mays
  Clone ID: LIB3279-005-P1-K1-A1
aagggatgcttgaagtgtacaactctttgagcgaggaaggcaaaaaggagttcaacaaggcttatagcgcatcgttttacccatgcatggatatactctacgaatgctatgaagatgtggcctctggaagtgaaatccggagcgtggtgttggctgggcggaggttttatgagaaagagggcctcccagcttttccgatgggcaacatcgaccaaactcgcatgtggaaggttggtgaaaaggtgcgctcaacccgtccggaaggtgatcttggcccgctccatgccttcactgctggagtgtacattgccctgatgatggctcagattgagatcctgaggaagaaggggcactcctactctgagatcatcaacgagagcgtgattgagtc

SEQ ID NO: 4154 - DNA, 363 bp, Zea mays
  Clone ID: LIB3279-005-P1-K1-A10
gcggcgacgagcacccaccagcagttctgtagaaatggctgatggtgaggacatccagcctcttgtctgcgacaatggcaccggaatggtcaaggctggttttgctggggacgatgcaccaagggcggttttccctagcattgttggccgtcctcgccacactggtgtcatggtagggatgggacagaaggatgcatatgttggcgatgaggcacagtccaagagaggtattctcacgctcaagtacccgattgagcacggtattgtgagcaactgggatgacatggagaaaatctggcatcatactttctacaacgagcttcgtgttgcaccagaggagcaccctgggttgctcactgaggc

SEQ ID NO: 4155 - DNA, 370 bp, Zea mays
  Clone ID: LIB3279-005-P1-K1-A11
cccacgcgtccggccgcgccccgtctgcctcctgcttctctctccgcttccgcttcctgcgcctccaggctccacttctccgctcggcagtctgcactggaaggacagcatgtcggcctcggcgtcgtcaccggcggcggcggcgggcgatgagaagcaggaggcggcgcccgtcaggcgctgcaagggcgtcaacgacctcgacaaggtcgttctccgcgaggtccggggcagctccgcagaggtgtacttgtatggtgggcatgtgacatcatggaaagatgagcatggagatgaattactttttgttagcaataaggctattttcaagcctccaaaagctatacgtggaggaataccaatatgcttt

SEQ ID NO: 4156 - DNA, 335 bp, Zea mays
  Clone ID: LIB3279-005-P1-K1-A12
aatttttctcccagtggaaagcgcttactgttcattcgctgaaggttcaagaagtggttaaaggtgtgaaacccatgcctctttctgagatggctaatcttttcatgagccttcacttggcggtcgctcctggacttgataacaacccgaacaatctggttgcatgcacgacattcttttctgaagcaacacgtgccatgctttgtctgatacgagttgaaacagatccacaagacaggacccaactgcggctaacagttgcctcgggcgaccaatatttgacattcgagttgaaagagttcatcaaagaacatctggttgatattccaagggac

SEQ ID NO: 4157 - DNA, 391 bp, Zea mays
  Clone ID: LIB3279-005-P1-K1-A2
cgccctgctgtctatcacggaagaggagttttagtatcttccatgggtttctgataaaagggatttactacttacgtagctgatggagacggaatgatgtaaattaaagtggtatttgtaggttgtcagtagcttagctgtatttttttttgggtctctttacaagaggactgctcatttgtttgttggctaagacttgatgtttatgtgcccggtttcttttgaagtttggaatgatcagtttttgtttgttgcaactattgtattttcctgatttcaaacagggtggagccttttcattcttgcaaagtgtttgtcgctcggaacaatgctttctctaagaaagagtttctcaaaataaagaaaagtaaacaaaaaatatattttgaag

SEQ ID NO: 4158 - DNA, 385 bp, Zea mays
  Clone ID: LIB3279-005-P1-K1-A3
cggacgcgtgggcgggaagctgacggactgcatggactacgcgacggggcacgcggcgtcgccctcgtccacctgctgcggcgacgccggcgacacggagaaggcgcgccccgagtgcctctgctacatcatccagcagacgcacacggggcgcaaccaggtgcagtcgctcgggctgcgcttcgaccgactcatggcgctccccgacgtctgcaacctccccaactacaacgtctcgctctgcatcaccctgctgaacctgaagccaggctctgcggactacgccctcttcgccaacgccttcaagatcacgccgtcagccggcggcaaccctgcgagcgacagcgccgcgggcagcggcgtcaagttccgggctggggtcagc

SEQ ID NO: 4159 - DNA, 364 bp, Zea mays
  Clone ID: LIB3279-005-P1-K1-A4
ggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacatatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccacta

SEQ ID NO: 4160 - DNA, 394 bp, Zea mays
  Clone ID: LIB3279-005-P1-K1-A5
acgctatgtgcagtgcctgtgtgttggactctcggcagattccgctccagcgcccaccgtcgcccaccgtcgcctttcaaaaagctagagggttcctcgagagggagaagcgtacccggcagctccgctccgtcagtccgtccgcccccaagaatgtcagacgaggccaggcgcgggcccgcgggcgccgcgcaggtggtgcttcgggcctcctccgaggaccgcaagccggtgggctcggggtctccgccgccggcagcgaccgcgactgcggttgcgcacaagatccagctcaagagtgccgacatgaaggaggagatgcggcaggaggccttcgaaattgctcgcatcgcattcgagaagcacagtatggagaaggacatcgcggagtaca

SEQ ID NO: 4161 - DNA, 387 bp, Zea mays
  Clone ID: LIB3279-005-P1-K1-A6
gaattcactgaatacacaaatctggacgagtgcatttcatatctatgtgattacatggtgaaaaatgggccttttgatggcctgctcggattctcccagggcgcaacactttcggcccttttgataggctaccaagcacagggcaagttgctgagcaatcatccaccaattaagttcatggtctcaatatctgggagcaagttcagagacccaatcatctgtgatgtcgcttacaaagacccgatcaaggtgaaatcagtgcacttcattggagaaaaggactggctcaaggtaccttccgaggagctggcttctgcctttgatgagcctttcatcataaggcatcctcagggtcacactgtccctaggcttgacgacgtgtctgtg

SEQ ID NO: 4162 - DNA, 363 bp, Zea mays
  Clone ID: LIB3279-005-P1-K1-A7
cccacgcgtccggttgtcgtaaaaaataggatgttaatcaattgttcatatgtaagaaacgatgagatgtcgttcctattaccatcagccaatcaaggagtctgctctagggaacatcccgaccattgccttctgcgacactgactctccgatgcggtatgtcgatatcggcatccctgccaacaacaaggggaggaacaacattggatgcctgttctggcttttggccaggatggttctgcagatgaggggcactatcctctttgggcacaagggggaaggcatgggtgatctgttcttctacagagacccaaaggaagcaaaggagcatgaggaggaagctgttgccgcccctgagtttgc

SEQ ID NO: 4163 - DNA, 387 bp, Zea mays
  Clone ID: LIB3279-005-P1-K1-A8
taaagacactgatacttcacggactatatcaacatatgcatcaggtacagggatgatgcctcctgcaggaagatctgatcagccatcagctaggcatggattcaagtctgggcctggtaagttagaagcacatgacggctgtcagcagtggaaaggtgacagtaatgttgatatgcatctctggagggaccacgctccttaccaacaaatgaccaacagtcaagcatatgagcagtctcggagggacgatacttatcagcaagcatgcagcagaggaacagaaaagttcagcaggcatgcaggactgcaagctaggcagcagttccaaaccgagacacccgccagtcatgtatggcatcaaccgcaggggccagtggcagaagaatt

SEQ ID NO: 4164 - DNA, 361 bp, Zea mays
  Clone ID: LIB3279-005-P1-K1-A9
gtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggc

SEQ ID NO: 4165 - DNA, 364 bp, Zea mays
  Clone ID: LIB3279-005-P1-K1-B1
cggacgcgtgggcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggt

SEQ ID NO: 4166 - DNA, 342 bp, Zea mays
  Clone ID: LIB3279-005-P1-K1-B10
cacccacccactcgcttcagccgcctccgccgcgcgtaccaagcaggtggagacaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcat

SEQ ID NO: 4167 - DNA, 363 bp, Zea mays
  Clone ID: LIB3279-005-P1-K1-B11
tcgcccacgcgtacgcccacgcgttcgtgcaggtgacgcgttgcttgacgaatggctaggtaagcagcgagcgcaatctgtggtgtacgtggcgtacggcaaccgcagcgctgccaggctggaccagatccgggagatcgccgacgggctggaggacagtggctatcctttcctgtgggtgctcaagaccacgaaggtggaccgggaggacgacgccgagctggcggaggtgcttggaaacggataccttgagcgcgtgaaagggcgtggcatcgtgaccaaggggtgggtggagcatgaagagctgctgaaacacccggctgtgggcatgttcgtgagccacggcgggtggaactcggcgct

SEQ ID NO: 4168 - DNA, 236 bp, Zea mays
  Clone ID: LIB3279-005-P1-K1-B12
agtactccttccaacggttgttctctaaccaataatattatttcacctaatgaatattgagcttttattttatttaccccaaaacaaaattatgctagttctgagatggtagagtaaactaaaagtgagtggtgtgattagactatggtcattttgatgtgaataacaaaaaatatatgctcttacttaatgtcgaggatttgtttgtgataatgactatactgatggatgttttc

SEQ ID NO: 4169 - DNA, 381 bp, Zea mays
  Clone ID: LIB3279-005-P1-K1-B2
ctctaccaaaaaaaacagcgacctctaacgcttagctagctctttgtgtcagcgcctgagcatcgagctattggcatggcgcactccaccacctgggccctggtgattgtcgttgtgctggcgctcacctttggtgccacggtcagtgtctccgctaccgtgaacaagtcgtgcgtaagcggtagcgccggcgccagcgtgagcattggctacggcggggcaagagccagcgccggcgctggcgtgtcccttggcgccgacgcgtaccggagcacgtgcccacgtgccgaggagatcatccgtgcggccgttgagagggccgtcgctgccgacccacgcatggcagcgtctctcctgcgccttcatttccatgactgcttc

SEQ ID NO: 4170 - DNA, 393 bp, Zea mays
  Clone ID: LIB3279-005-P1-K1-B3
ttccccgagtccccgactgctctctgtctctctattggcgacgactgggctaccgccgccacaggcgccctacgccaggtgtccaggtctcgggcccttctccggcaccgagcacccaccagcggaatataccatggaggtcaggcccatggtagctctgcgtgccgccctagttggtggggtagcggcatttgcgaagatcggtggggcgatgaaagccgcaggcggtgtcaagattggtgcagccgctgcagccgtcacggctgcaacatcagctgccatatcgggaaaagacgcaaaagaagacacttcaaagccggaaacgaaatgatatgacccatggattggtcgacaagtatgaaatcgcctctccagaggtttagaagagagagg

SEQ ID NO: 4171 - DNA, 314 bp, Zea mays
  unsure (1)..(314): unsure at all n locations; Clone ID: LIB3279-005-P1-K1-B4
atctctcaccacctctcccctcagcttctccccacctttggtcacgcaggctcaggcaaaaggggcggtcaacaatggaccagcgatggcgaccaaggtcatctgcttccttgtgctcgcatccctgctcctcgccgtcgcctttcccgtgtctgctctgcggcagcaagtgaaaaagggcggcngcggangccgaggcggaggcagtgttagcggaagcggaggcggcaacctgaatccctgcgagtgctcgcccaagtgcgggtcgcggtgctccaagacgcagtacaggaaggcctgcctcaccttatgta

SEQ ID NO: 4172 - DNA, 346 bp, Zea mays
  Clone ID: LIB3279-005-P1-K1-B6
caggggtgaagcaagcaatggggttttgtcttcacaacaatgcagcagtagctgcgttagctgcaaaaagagcaggtgccaagaaagtcctcatagttgactgggatgtgcaccatggaaatggcacacaagagatattcgacggggacaaaacagtcttgtacatatcattacatcgtcatgaggatggaaacttttaccctggaactggagctgctcatgaggtgggagttcttgatggtcaaagattctcagttaatataccttggagccgtcgtggtgttggagatgatgactacatctttgctttttaaaatggggtgcttccaataactttaaaatttgc

SEQ ID NO: 4173 - DNA, 362 bp, Zea mays
  Clone ID: LIB3279-005-P1-K1-B7
cgcatgcgttccaacatctgagcaatctcttgtgcactcagacatgccaatagacgcggcaatacaaccatggactccaccatcacctgcacaggcactaaggcaaagaatgaggcgaacaagcgcacggtcggccgcacagggaagaagtcaaggtagaagtccgtgaaggcgggtgtgcaggtccctgtccagcgcatcgggcgctacatgaagaacgacctgtacacgcagcgttacgcgaacggtgtccgcacctacgtcgccgtttacctcgaatatgtcgtcgattacgttgtcgatctcgttgttgatgctgccagggacaacaagaaggacagcatgattactcgccttatgct

SEQ ID NO: 4174 - DNA, 385 bp, Zea mays
  Clone ID: LIB3279-005-P1-K1-B8
cggacgcgtgggcggacgcgtgggtgggcgtgcaactttcccttccttcgccgaagccgcgcgacggaaaccccaaacccaacctcatctcttttctcggcctctaccgccccctcgatcggtcggccggtcagctatgacgccgggaagctcggccgccggatccggcgtcgtcgttcctcggaacttcaggctcctagaagagcttgaacgtggagagaagggcattggagatgggacagtgagctatggaatggatgacgcagatgacatctacatgcgatcatggactggcactattattggccctcataataccgtccatgagggtcgcatctaccagctgaagttgttctgcgacaaggactaccctgagaagccacca

SEQ ID NO: 4175 - DNA, 388 bp, Zea mays
  Clone ID: LIB3279-005-P1-K1-B9
gcagccccagctgtttccacgatgcgttcccctcccccctcaactcacttacgtgtgggccctcccagctctgcttgtcttccagccccttgcccgcatgcacgaatcggatgacgacgacgacgccatgagaaagctgaagcgccgaccgccacttcgtgtctgctgctctgctcctcgactcccggctcctgcgccgtagagaagtcgaccgtccgtcaccctccccactcgcgcgtatttccctctcgtctttcccattgttgctcgccatcaatggcaggtgtcggccatcgcctgctcgtctccctcgcccgacgctataaaaccatcgtcgccacgaccgtcttctcccagccatcatcagctacgtaccgtcctgcaacag

SEQ ID NO: 4176 - DNA, 380 bp, Zea mays
  Clone ID: LIB3279-005-P1-K1-C1
gcaccgggagattctgaacttctgggagacaataagcaagtgaactcgtcaaagaatgacgtgggtgtaaaacaatcagaggtggacagtaaaatccaggcagctcgagagcggtaccttgcacgaaaaggcaagaaatgacaatcgacacgtttaactgatcgctcagcatccttctggtcagcctgaagcttctctgaagatcataccgaggaaccattcgtgttattgtgggtggtgtatgcttcaacgtgcacaaacaagagaatttcttatgtaatcttttgtttgaggactctaaccttttcttttatttggcattactgtgatgtgaccttttccttgggccgaaatattttacaggcttttctgcatgggct

SEQ ID NO: 4177 - DNA, 380 bp, Zea mays
  Clone ID: LIB3279-005-P1-K1-C10
agcgtgcgcgctcgcactgagtttctttcttctacgcacatcggctgaggcttggttgcatcgggccggtcgagccggagaggaaaagctagctagcagctaccagctctcggccggcggtggtagtctgcctgcagctggggttagctgcaagggttgggagctagccatggggaggggtcgggtggagctgaagcggatcgagaacaagatcaaccgccaggtcaccttcgccaagcgccgcaacggcctgctcaagaaggcgtacgagctctccgtgctctgcgacgccgaagtcgcgctcatcatcttctccaaccgcggcaagctctacgagttctgcagcggacagagcattaccaaaacacttgagaggtatg

SEQ ID NO: 4178 - DNA, 372 bp, Zea mays
  Clone ID: LIB3279-005-P1-K1-C11
ctggagtgatcaggttgttagattcaagaggggaaaggaaagaatatccccaactaaatggtcaccagcaaaccagagtttgaagctaggcttgatacacacgaatattcacatggtttagaatggactctcctgttctgaatcgcctgccttatggcaccctgccacggaatgcagatgctcctggtcagcgcttgacagctccacgtttgcacggcctcggttgagctgaggatgcgcctggacccttgcggggtttcctggaccgagctttctttggcgcatagcctataacttccaagtcctcgcatatctcttgcctccctagaaggaggccaggaatgatctccctctgaaaatttctcatacccc

SEQ ID NO: 4179 - DNA, 376 bp, Zea mays
  Clone ID: LIB3279-005-P1-K1-C12
cgaagcttttgcggagatgtatgagcgtgtggagagtgctaagcaaaagcatgtggtggagatggagcgccagcgaattgaattcctgaagcaactggaggtgaaacgcatggagaatttcgttgatgcccatgtgaagctggctagagcaaagcgcacgaagaagactacagggggtgctgccgacggtgctggtggtatggagttggttgccaccgttgctgcgctgcctttcgtctccacctccaccttcctctgatattgaggaagagtttagatcatcagtgtcgatctcagtgtgatggcatcctgtccagtgaaaggactgcttggcagtaaacactactgcccttggttactctaaagacggacatgt

SEQ ID NO: 4180 - DNA, 393 bp, Zea mays
  Clone ID: LIB3279-005-P1-K1-C2
cccacgcgtccgcccacgcgtccgcccacgcgtccgagacgagttaccatctcatcccaactccggaacgaacaagttaccatctcatcccaactccgcctcgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccg

SEQ ID NO: 4181 - DNA, 394 bp, Zea mays
  Clone ID: LIB3279-005-P1-K1-C3
cccacgcgtccgcccacgcgtccgcgtattcgtactcgcctacctccgcggctcaaacctttcccccttctaccaattcccgccgccgctccatcccgtaacgcgacaccatgagggagtgcatttcgatccacataggccaggccggtatacaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgatgaccttgaacccactgtcatcgatgaggtgagaactggcacctaccgacagctcttccaccctgagcagctcatgagtgg

SEQ ID NO: 4182 - DNA, 367 bp, Zea mays
  Clone ID: LIB3279-005-P1-K1-C5
gccggaaccgctgcggagttccaggcgtgcgcaacagcgtgcgcgctcgcacgacttttttccggctacccacaccgagcgagatctccgatccccgcccaaatcccacgacgccggcggcggccatgggcggcaaggacctgacggaggaccagatcgcctcgatgcgggaggccttctcgctgttcgacacggacggggacggccgcatcgcgccctcggagctgggcgtcctcatgcgctcccttggcgggaaccccacgcaggcgcagctacgggacatcggggcgcatgagaagctcaccgcacccttcgactttccgcgcttactcgatctcatgcgcgcccatctcaagcccgagccctt

SEQ ID NO: 4183 - DNA, 331 bp, Zea mays
  Clone ID: LIB3279-005-P1-K1-C6
gcattggtatttgtccgaagagctagcctacaaacatattgcgagggaaaggttatccacaaacagtctgggaaccacttgatcaggcgtctaggggactaaatggatatttgttatgagtacagaagaaactttacgctggcaagaaacagagaggcgtgttccagcactccacttttggcaggagggcactatagctgtgggagattactgcaaaagggatgatcaagtctctgggcgtcagcggcactacaaacctacgcaaaaacctccaacttatgaacttctcaagagaacggtgacctaaagaatcgagtcggtctctaccaaa

SEQ ID NO: 4184 - DNA, 386 bp, Zea mays
  Clone ID: LIB3279-005-P1-K1-C7
cccacgcgtccggccgcaccagccctaaacccttccacctccagccgccataactgtaatcccttccaccatcagctgcccctccgttcgagccgtcgacgccctaatcctatcaccttctggccgcccaaatccctttcggctcctgccgccctctgtttgaggcgcaggccatggagtcgtcggtcttcgagtgccaggccatggagttgtcggtcttcgagtgctaggccatggcggcacagaccatggagtcacaggctatgatggcgcaggtcttagtctttaggccatggagtcgcaatcaggcgttcaagatgctctgagacttgagtcaggtttttccaacatgcatgatggattcagtacaccaaaaaaatgaatat

SEQ ID NO: 4185 - DNA, 386 bp, Zea mays
  unsure (1)..(386): unsure at all n locations; Clone ID: LIB3279-005-P1-K1-C8
caaaggcccaaacccagccggtcagtcccccaccccccagcagccatggagttcggcttccgcgcaggaaaccgcacgcagcgccgcccttcccccgatcgacgcgtcacagcacagcaagccggacccttccacggcgaccacccgcagccctcgccgttgcagtgggaggatgcggcccggcgcgagcggatcaaacgcgaggtggagcgccggctcatcgaggaggaggtccgcctggagctcgcccttgagcgcgcccgcctgcacggtggttttggccccgccccgttcctcgggaccgacggattcgtcgagccggtgcagtcaccacctncacctccaggccggttcttcagggccgacggtccatcgatgacgccggc

SEQ ID NO: 4186 - DNA, 290 bp, Zea mays
  Clone ID: LIB3279-005-P1-K1-C9
cgacattctgacaattgcaatccagtttttttttttgaaattgcatcctctcctacctcttttttccttttgttatgttgtatctatatctacttccgcgtgatattttggcaccggaggctctagacggctgcagatttggtcgctgacaagtagcgaggagatggatgttgtgccgtcagtttctccttactttggcacagacccctcagcgggattttgttggacagtttgaccccctttcaccaggaaagatatccatatttgggggagtttccctattgctgttt

SEQ ID NO: 4187 - DNA, 379 bp, Zea mays
  Clone ID: LIB3279-005-P1-K1-D1
cccacgcgtccgtacactttgaggccttccagctgggcatgtcacccgtctacatcgccttcctgaggttcatgggagacgacgcggaagcgaagaactacagctacagcctggaggtagggggcacggggcgcaagatggtctggcagggggtgccccggagcatcagggacagccaccggaaggtccgggacagctacgacgggctcatcatccagaggaacatggccctgttcttctcgggcggcgacaggaaggagctcaagctgcgtgtcaccgggcggatctggaaggaacaatgagcttgatgggtcagctagtacgtctgtcccgctccgctgctgccctgaactcatgaatcgcatcgcaaagagctttt

SEQ ID NO: 4188 - DNA, 407 bp, Zea mays
  Clone ID: LIB3279-005-P1-K1-D10
gaaccgccgggtagtcccaggcgtgcggctggagacattcagtttcttgatgttagaaggtcagcagaaccctacctgactattgaggcacacaggggttcacttacagcattggcggttcaccggcatgccccagttgttgctagtggctcagccaagcagatgattaaagtgtttagtcttgaaggagagcagttgacaataattcgctaccagccatcttttatgggccaaagaataggcactgtgaactgcctttcttttcacccatacaaatcactcctatctgctggtgctggtgataatgctcttgtctctatctacgccgaggaaaattacaagtaaggtgaggcctacatctcatgacaatgcagccacaaggcaaccggcaggcctggtgttttttg

SEQ ID NO: 4189 - DNA, 387 bp, Zea mays
  Clone ID: LIB3279-005-P1-K1-D11
cacgtctccatctatggtttgaccgccgccgccgccgccctacgcggctacgccaggcgccgaggccttcgtcggcattttcgtcggcaagcactcaccaggtattcagccatggtttttcttgaggcagagatgtcatggaatgtgttgatctcacctagccagctggaccgcaagggcctcctgctccgcaaggctatcattgtgcgtcttctggaggatgtcacaaacaggagggcttcgaaagagcatggctactacattgctgttaatcagctgaaggcaatatctgaagggaaagtgcgtgagctaactggagatgttctgttcccagtttcatttacttgcattacacagaagcctatgaagggagaggtcatggttggg

SEQ ID NO: 4190 - DNA, 386 bp, Zea mays
  Clone ID: LIB3279-005-P1-K1-D12
cggacgcgtgggtcacccctctaacaccacgccgccgccgtttgctgctcggcgcctctgctcacaacccgtacgccaacgtctccaatctcgtatactttcgtgctcagcatcatggacggcttccccaagagcgtcggcggtggcggacctaacattacggcgggatcccaccccggaagccggagccacgcggcggcaggaggaggcaatgagatcttttggcaggttctgcggtggtctagattataattacggctatggccccagcagcggaagcagcatatcaaggtcggattggcgataccgaccttactgaacgtgttttagtttttacctctagggaaggaaactgaggagatggagaaaagaattacctgtctaag

SEQ ID NO: 4191 - DNA, 374 bp, Zea mays
  Clone ID: LIB3279-005-P1-K1-D2
cggacgcgtgggtgcgccttcttcttcgacgcggagccgctgggcgagcccgggcggcacgcgctggacgcctgcgcgctctgcgccaagccgctcagccgcaacagcgacatcttcatgtacaagggcgacaccccgttctgcagcgaggactgccgctatgagcagatgcaccacgacgcggcgtacgcaaggcaggcggccagcagccggcggaagcagcagcagtcgcagcggagcagaggggcctcgtccgtgggcgccaaggcggacgtgtccgtggccagctagtcagtagtagtaaaagcaagcacagcgaggccgagaaaagaggaggaggagaagaagaaggccgtgctggttcaagcagcgct

SEQ ID NO: 4192 - DNA, 393 bp, Zea mays
  Clone ID: LIB3279-005-P1-K1-D3
atctcgccttccgaggaaactcaccagcccaccacagacccgagcggaagaagccatgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccagggccgcaccctctacggcttcggcggctaggctgatgggctcctcgcgatgttctc

SEQ ID NO: 4193 - DNA, 288 bp, Zea mays
  Clone ID: LIB3279-005-P1-K1-D4
cgctggagacattcaattttttgatgttagaaggtcagcagaaccctacctgggtattgagggacacaggggttcactttcaacatttgcggtttaccggcatgccccaattgttggttgtggcttagccccaaccataattaaaaagtgtagtgtttgaagagagacgcatacacaaaaattcgctcccagccattttttatgggccaaagaatagactgtgaaccggcttcttttttacctatacaaaacacatatatcttcttgtggtggtgatgaagatttttt

SEQ ID NO: 4194 - DNA, 337 bp, Zea mays
  Clone ID: LIB3279-005-P1-K1-D5
gcggctggcagacattcaagtcgttcgataggaagaagggcagccaaggccctggacaggatgtttcggaccaagcagaccgaccgtaagtccaccggaggcaaggccccgcgcacgcagctcgccaccaaggcggcgaggaagtcggcgccaacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccc

SEQ ID NO: 4195 - DNA, 437 bp, Zea mays
  Clone ID: LIB3279-005-P1-K1-D6
aggcaccggtaccggcatgttccgggttctaccggctgcgacccgacgcgtctcgttccaaagggaccccaaaagaagtggccaccgaggttttgggtttgtcaccttcgctgatgagggtgtggcagaacgggtatctcgtagaagccatgaaattctgggccatgaggttgcaatagacacagctgcaccacttgagaatgattcagctggtggtggttatattgatcccatggatctttacggagcttatggttcaatgagatcttttggcaggttctgcggtggtctagattataattacggctatggccccagcagcggaagcagcagatcaaggtcggattggcgataccgaccttactgaacgtgttttagtttttacctctagggaaggaaactgaggagatggagaaaagaattacctgtctaagaat

SEQ ID NO: 4196 - DNA, 373 bp, Zea mays
  unsure (1)..(373): unsure at all n locations; Clone ID: LIB3279-005-P1-K1-D7
gttgaattgtcctcaaaatacgtgtccacttaggtttcgggagggtatctggngtgatgatggtggggcaaaccgatcatgatggagaagccatataatgcttacccatgatgttgcaatagacacagctgcaccacttgcgaatgattcatctacagctggttatatagataccatgaatctttacagagcttattgatcaatgagatcttgacgcaggttctgcggtggtctagattataattactgctatggccgcagcaatggaagcagcaaatcaaggtatgatcggcaatacccaccttactgaacgtgttatagtttttacctctaggaaagaaactgaagagatggagaaaagaattacctgtct

SEQ ID NO: 4197 - DNA, 373 bp, Zea mays
  Clone ID: LIB3279-005-P1-K1-D8
cccacgcgtccgagccagtcgcccgcacgactctttcccggctacccacaccgcgcgagatctccgatccccgcccaaatcccacgacgccggcggcggccatgggcggcaaggacctgacggaggaccagatcgcctcgatgcgggaggccttctcgctgttcgacacggacggggacggccgcatcgcgccctcggagctgggcgtcctcatgcgctcccttggcgggaaccccacgcaggcgcagctccgggacatcgcggcgcaggagaagctcaccgcacccttcgacttcccgcgcttcctcgacctcatgcgcgcccatctcaagcccgaggcctttcgaccgcccgttccgcgacgccttccgcg

SEQ ID NO: 4198 - DNA, 311 bp, Zea mays
  unsure (1)..(311): unsure at all n locations; Clone ID: LIB3279-005-P1-K1-D9
cggtgccgtgctcgaggacgtcgacggcggcggcggcggcatcgagcggcacggcgtcgtggaggtatncatnatcaaattctaccattctctatgaccatcaatctctattaaggaccatgacaaaatacacagataatattcatgcggaaggacttctccctgttttacacggacgggtacagtcgcatttcgcccttgtatttgaacatactcatgcgctcccttagaaataactttacataatcacagctttactacatcgttctacatgagaagctcaccgtaccactttactttccgtgctttct

SEQ ID NO: 4199 - DNA, 385 bp, Zea mays
  Clone ID: LIB3279-005-P1-K1-E1
agacgatcaagattgcaccatactatctcttagttgtctcctataattaaaaaactgagccaattctctaggttgtacatgccctaaggacatcattactaaatgaatatttcttagggaccttattggttatttcttctttagctacagttagacaaaagcagtttctagggagctaattaaaacaatcaagagacgagctcttcgtgaaaagcatgttctacacgactctctatacttatatattatgtattgactgtatttagaatttatacgatcaagattgtatcatactatctcttagttgtctcttgtaattaaaaaaaaactgagccaattctctaggttgtacatactctaaggacatcattactaaatgaatatt

SEQ ID NO: 4200 - DNA, 385 bp, Zea mays
  Clone ID: LIB3279-005-P1-K1-E10
cccgttcgcgccggcctctggaagaagaatccaccgaaggcgaaaacgacgatggaggtccggctgactcgtctgggtctttgcaacagcggcaagcgggttggagctccgcttcgggcaggggagaaccacgtggagacctggagtcacgctgcctagactcgccgctgggtggattcgtcgcggtggaggtcggattgtgaacacgccgtccagttaggacgctgtcgtctccagatccaggggatggggttgcttggcatggcggccaagggcccctcgcccacgcgtcgcctactgccacagccgcacttggccgtctcctcgctggcggcctccgtggctctgatccactgcttcctcaacacccggagatggttgacgt

SEQ ID NO: 4201 - DNA, 376 bp, Zea mays
  Clone ID: LIB3279-005-P1-K1-E11
cccacgcgtccggggacgcgtgggcaaagccaaaaccccaatcgcacaggagagaccgagagagaggttttccatccatggctcccggcgtcgcttccgtgctggtcccgcaggagcccgtcctcctcaaggacatcctcgcctcaccgtccctctgcggaaacaaccgttgtttgcgtccgccacctcttcggcaacggagtaacgccgccacgctcctcggacgatggcattaaggaccccactgccgaccgccacggtgaccgcgaactatgcatccccaagatcttcaccggagacgtgctggacctgctcgacgatgcttctaggctggaccttatgctggcgctgaccggggacggctgagcggcgtcca

SEQ ID NO: 4202 - DNA, 379 bp, Zea mays
  Clone ID: LIB3279-005-P1-K1-E12
cgaggaagctgatgatggtaaagtcattggcactgaggatgaaatggaaacagtatatcttggaaatggtagtgctgaagaggtaaaagatgtagcagaatgtaatgaacagccaaattgttgtactgaggatgagcgattgaaaaatacagaagggattgaacggcatccagatgtttcaaatcactataccgacatatgtacaaacgaggctgcctctgttgcagcagaatcttcagccccatcagttgagatagtggcagagaaaacagtagatgaaccatcggaggcagaaagagcagtggatgaaccggcagaatcatctttggacagttctgtctctatacctttgcctgctcctgttaatagtagggagcct

SEQ ID NO: 4203 - DNA, 400 bp, Zea mays
  Clone ID: LIB3279-005-P1-K1-E2
gaccgacgcgtccgggcggatcttgatattggagaacgtattggtttaggatcatttggggaagtttatcgtgcagactggaatggcacggaggttgcagtgaagaaatttcttgaccaggatttatcaggtgtttcactagagcaatttaaatgtgaagtgagaatcatgtcaaggctaaggcatcccaatgttgttcttttcttgggatatgtgacacaatcgcctaatctctctatattaactgagtacctcccaagggggagcctatatcgtctgttgcataggccaaatagtcgaattgatgaagtacggaggctaaaaatggcattagatgtggcaaaagggatgaactacctgcactctagccatcctaccattgttcaccgtgacctgaaat

SEQ ID NO: 4204 - DNA, 377 bp, Zea mays
  Clone ID: LIB3279-005-P1-K1-E3
ggaccatcttaagaactgggcagacagtgcaaatctccaattgctaaatttaacgtacgatgccaccccacctgattatgtgtcgatgatcataactgactaccgcatgcttccgccaactagtgtaccggtcattgtgagagagtaccgcaaggagcaactatggatatgactcgctgccctactggcgtatggtagcatttttggtgacctttgcctgagtgcaacatgataaatgattgcactgttggcctgagtttttttttgtctgtcctcggtgccttcttaccaaaaaacgagccgtcgtgttttgcgatcacctgtataacttgctactctgaatggtgcacccgtgtgccctcggacatcgatgagtc

SEQ ID NO: 4205 - DNA, 383 bp, Zea mays
  Clone ID: LIB3279-005-P1-K1-E4
caagaagcccgaggaggcctccgaggcatcctccttcaccctcatccagttcgcagacacgatggagaaagcgaggaagctggggacgttcaagaacttcgttgccgggcgggccagcgaggccaccgtcgtgaacgtcttcgagaagcactccgctgtgctgcgctacctcggtgccatcgaccccaccggcgagaacctccgaaacactgacaaaattaacgcgaccaagcactgcaactgcacaattgctgacgtggagcacattctggccaagtacacatgggctaaaggctcagaagaagattgcaaagctcaaggaagaagggaagccattaccaaagtcatttaacgaggtccaaaatctaatgggttctacacca

SEQ ID NO: 4206 - DNA, 383 bp, Zea mays
  Clone ID: LIB3279-005-P1-K1-E5
ctggttttcgttcgaacttaccaaaaatatggttcgaaaaggtttattaagttccttgcttggttcatggctataattcagagtctccttataattgcttctcgcaagcactactcggtcgatgttgttgttgcgtggtacactgtaaacttagtagtattctttgtccacaacaagctgccagaaatgccggatcggacgagtggactacatttgctttcattaagctccaaagaaaaagagggcaggcagaaggaggagaaagacagtaaactgaaggacgagttccacaagttactgaatgggaaccatgcggatcctactgatcggcgacagcgggcacagatgaacgggaggcacgacgaagacatcaatcacgcgct

SEQ ID NO: 4207 - DNA, 383 bp, Zea mays
  Clone ID: LIB3279-005-P1-K1-E6
cccacgcgtgcggcgaccccgggcaagtttcccacgggcggggcgacgaatcgagggctccgaccgcgacgaatcgagggcctcccaccgccaccgcgatgaaccgagtggagcacgtcgtctccacaccaccatccagctcagatccatcatctgcgcaccacgccatcaaccagcttggatccatcatccagctctgctccgacgtccagctctgctcgcgagcaggacatcaccgctcgtcgtccaccatccctggcttgctgtcctccgcgcgtcatctccatccctggcttgaggtattcaacgatgttctccctcttctcgtaccatacatactagctagggttttgaataattccgatcggcgatctggtggcggc

SEQ ID NO: 4208 - DNA, 383 bp, Zea mays
  Clone ID: LIB3279-005-P1-K1-E7
cccacgcgtccgggagcaaccgcttgcgtcacacgcacactgacggagagtgatcactgatttctggtcatggcaaccgtaactgaggaagttgctccggtcgtcaccgtctccgaggagccggcgccggaggcggcgaaggaggtggcggagaagccggaggaggggaagaagcccgacgaggagggtggcgaggggaagaaggccgcccccgccgccgagaaggagaagaaggcgaggaagccgcggagcaggaagcccaagtccgccgggccgcaccacccgccctacttcgagatgatcaaggaggcgatcctgtcgcaggacggcgggaaggtcggggcgagcccgtacgcgatcgccaagcacatgggggagaagca

SEQ ID NO: 4209 - DNA, 365 bp, Zea mays
  Clone ID: LIB3279-005-P1-K1-E8
cgtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctaattcgtcggcaccgtttgccatgggtacaatggctcgtcttggaaacctgcacttcagtaggccatctatacgggtttctagctatatccagagttgtgtgctaagacaaatcagtcagtcgttttgcgaacctatta

SEQ ID NO: 4210 - DNA, 384 bp, Zea mays
  Clone ID: LIB3279-005-P1-K1-E9
actcgtcgggctattggtaatctgaaacagtggcggctatgcacggatctgggctagacatggacaggatttcagctattcaattggcaaaaagattcaccactacgaactctggaaccctccactctgcaagcactctatgaactcatctcactggtccatgatggtgctgaagcggttagccaaatggacaaaatagaagccacatcccaggataaatcctccaaccaaagagatgacacagatactagtgctgctgcagacgattcatccctcttggacaaagatcctgttgcaaaaatcattttgccagttgaaccacttgaattgcggactatgctgcttgcaatggtgcatactttcccaaggacgttagaaaatttg

SEQ ID NO: 4211 - DNA, 343 bp, Zea mays
  Clone ID: LIB3279-005-P1-K1-F1
ggcacgaacaggatatggtacaagggccaggtattcaagattgtacagaacgttagccagcaaagtgacggccttgaaagagactgttgcagagatggagagaggtggtgttttcaaagatgtacgataaatgctgtgttattgtagagttatttatgatattgatgttgtatatggatgccatttgtcggcatcccttgtaactgtatttgtttttactatgtggaaacctatgttgtaacactattctttggcaagagatgagccttgcctgccccaacccgaaatactatggttgtgcaaggcattaatgtaaattgtagctgcagctgataaatgtttg

SEQ ID NO: 4212 - DNA, 258 bp, Zea mays
  Clone ID: LIB3279-005-P1-K1-F10
gtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttct

SEQ ID NO: 4213 - DNA, 380 bp, Zea mays
  Clone ID: LIB3279-005-P1-K1-F12
tgcactcggaaggcttgctccaaatcatacgtgtacccacatgttgaacggtgctctaagggaagtacttggtgatcatgttgaccagaagggttcaattgttctaccagagaagctaagatttgatttctctcatggaaaacctgtccagcctgaagatctgaggaaaatcgagttcatagtgaaccagcaaataaaggacgagctgggtgtgtatgcacttgaaataaaactagaggatgcgaagcgcataaatggtcttcgtgctgtgtttggtgaaatctaccctgatccagtaagagttgtatcagttggtcgcaaagttgaagatctgcttgcagatcctgatagcaaagagtggctatccatatcgactgaac

SEQ ID NO: 4214 - DNA, 371 bp, Zea mays
  Clone ID: LIB3279-005-P1-K1-F2
cccacgcgtccgatcatgatggaggcagaaaatcttgcacgtctcagagaatcacaaacgcctttattaggaggtgataacccagagcttcatgcgtcagatatgcatggagatgagcctttcaagactgtgctaccgtctccggatcaactggtaccttctttggcaggccatgacggtcttgatggcccatggattaatttgactccattcagagcggtgcagacatttggtctaccacagggcgccacttcttttttggttgagctgaacattaatgtggtgggaatgcacgacatcactaaacttgtgctttgtaggcaagccgaactgagggaaagcctgcgatctggttttgcttctattccaca

SEQ ID NO: 4215 - DNA, 308 bp, Zea mays
  Clone ID: LIB3279-005-P1-K1-F3
tgggacgccggcggtaccggtcgggtagacccacgcggacgatgtctgcggaaccgtgcccgtagcgctagccgacgccgacgtcaacaatggagagcctactggtcgctaggacccaccgaccgattctaccttttaggacctggtatagtcacatgcgtcgctgacgtttgcacctgcacatacactcttaccccaatcccctctacctctcaccccccatcgcctcccacctctcacctatacctcgccgacacctgaccgcggtactcgcctgcgtattgggctgtgaagcgagctctaagccg

SEQ ID NO: 4216 - DNA, 385 bp, Zea mays
  Clone ID: LIB3279-005-P1-K1-F4
atggctctggacgccccggtggagcgacgggacgaggtacagatcgcgatggggaacggaaacggcgtggcgccgtctcaaccgtcgcggccagccggtcggccaacggctgctgcggcggcagcgccatacgcggacaggcggctgcggctgaacccaaatgcggatcacaagccggaagactacagcgacgtgcgcggcgagtacgcgccggccgtgtacagcgcactcgagcggcatctcccacccagcctcatcgatgccgaccgcgatgtcaagctacacttcatgcgggacattctcgcgcgctactggccgcaaggcgagcgtaacagggtgcaaaggcacagagaatataggcggaggatactacacctttacaagc

SEQ ID NO: 4217 - DNA, 303 bp, Zea mays
  Clone ID: LIB3279-005-P1-K1-F5
gcggcatggacgaggacgcccccgctggcagcggcggccctggccccaagatcgaggaggtggactaagcggtttgttgtcagtcttgagcgtgctgcagttgctggctggcccagtcgctgccgcgagttatcgtcgtcggtcggtgcggtgtgtccgcttaaactttatttgtggtgggctggtacttttgtggaggttattttttttggacctcgtgatagtcggtcggttccatgttatcgcggctactggcaaaccttaagtgatacggtaattcttcttttcggtctttgtttctgc

SEQ ID NO: 4218 - DNA, 430 bp, Zea mays
  Clone ID: LIB3279-005-P1-K1-F6
tggacgcccgcagggaccgggccggaaatccacgggtggcccaagccttcggatgctttaaacaccttgtttaaagagacacgtgctcggaaaagcacgacccccgctctttttgttgaccttgaacccactgtcatcgatgaggggagaactggcgcctaccaccagctgttctaccctgagcagctcatcataggggaggaggatgcagccaacaacatttcccgcggtgactacaccattggcaaggagattgttgacctctgccttgatcgcatcaagaagattgtcgacaactgcactggtgttcaggggtttctcgtcttcaacaatgtttgtggaggaacgagctctctccttggttccctcctcctagagcgcctgtctgttgactactgcaagaaatacaagcttgggtgcactgagtgcc

SEQ ID NO: 4219 - DNA, 379 bp, Zea mays
  Clone ID: LIB3279-005-P1-K1-F7
ggcacgaacaggaaatggtacaagggccaggtgttcaagattgtacagaaccttagccagcagagggacggacttgaaagagactgttgcagagatggagagaggtgctgttttcaaagatgtacgataaatgctgtgttattgtagagttatttatgatattgatgttgtatatggatgccatttgtcggcatcccttgtaactgtatttgtttttactatgtggaaacctatgttgtaacactattctttggcaagagatgagccttgcctgccccaacccgtaatactatggttgtgcaaggcattaatgtaaattgtagctgcagctgataaatgtctgcagtgctgcaagtctgaactttccaggttatggaac

SEQ ID NO: 4220 - DNA, 378 bp, Zea mays
  Clone ID: LIB3279-005-P1-K1-F8
agaagtggagcaagggaaagctaaaggagaaggtaaacaacgcggtgctgttcgaccaggctacctacgacaagctgctctcggaggtgcccaagtacaagcaaatcaccccttccatcctctccgagcgtctgaggatcaacggctcccttgctcggagggccatcaaggacttgatggcgcgtggcctcattcggatggtctcggtccactcaagccagcagatctacaccagggcaaccaatacataaggatggggaagaggtctaaaatgcattgtctgccctctctgcaggaggagctcgtctttagaacagttgccatctttgtcaagagttgccaatgttatgttactggtgatgagttccaggtgacggc

SEQ ID NO: 4221 - DNA, 389 bp, Zea mays
  Clone ID: LIB3279-005-P1-K1-G1
gttatgagttcctttatggggtcccaccttttgaagctaaggagcactcagaaacatacagaaggatagtaaaagtcgacttgaagttcccactgaaaccattcgtttcgcccgccgcaaaggatttgatttcccagatgctggtcaagaactcggcccagcggctgcctctccacaaggttcttgagcacccatggatcgtccagaacgccgacccttccggtgtgtgcagaggatagaaccaccaccaccggctgaagggagtgcgattctttccactctccccatttcgaggggagtgcgattctttcgactgtttatggcttctgtcgcccgaattgccccaccccgaactgtatcttgtagcaccgtgtactgtgtagttgggg

SEQ ID NO: 4222 - DNA, 353 bp, Zea mays
  Clone ID: LIB3279-005-P1-K1-G10
gcgcacgtcctatgttctctatccacgcggatgactcgctcggtgcgcctccgatcccttccatgccggttccgggctccggctagccactcgcccggtgcgcccgcgctcaccgctccctccccctacgggctcccaagaaaagggcagatgctatctcaggcttgctgaatttgatatgaagcgccaaatgaggtatagactgatacagaagtacttcaatgcgatatatgcaaatcaagtgaggactacattgcctatttcaagcatgtctgacaatgagtggagaaagttggtggagaagttgtctgccccaaatcacaaggaaagttgtgtgaagaacaaacttaatc

SEQ ID NO: 4223 - DNA, 304 bp, Zea mays
  Clone ID: LIB3279-005-P1-K1-G11
aacatataaagattttatagccgaaaaaaagcgactgattgtcaaccaccatctactagttagaaggagcaagagggctgctcccgctcacaagcgctatcttatgcagctatatgacgtcagggctcacgtaccgagatacagccatctagatcttctggtccgatgtatatggatatgagggcgtgaatgttgagactcagattgacaccaatgacaattctgctgcggctcaagtctactatgctgaaggtgtcaccccattgatgacggtgacagtcgctgacaaggaagatgtaccggg

SEQ ID NO: 4224 - DNA, 216 bp, Zea mays
  Clone ID: LIB3279-005-P1-K1-G12
aagatctgctgctggcataacattacgacaatagttcatgcgttcgacaacaaatttgggcccactttccacaggttcagcactggaccattttaagttcccaccccagggctttttaggtcaaaagaaaagggagaattaaccacatggccatttttagtccatttttactccaacaaaaccttaaaggctgttcgggaacatgaacactttgac

SEQ ID NO: 4225 - DNA, 372 bp, Zea mays
  unsure (1)..(372): unsure at all n locations; Clone ID: LIB3279-005-P1-K1-G2
ccacgcttactattgctagccggcggttgcgactttaaactgtagatcgggctctagaactattttggctcaactttttacactcttcccactctttcctggcgaacgggaaactgacacagctttacaaaatctccactgcccttgggaccccccattgcactattttttcaaagggaatgaaccctgcctcgaccatccacctttaagttttttaagaatcctccaaaaacacatcgtatcttatttatcccggcggatttgatctaatctgaccactctagctatgccgncgcgcgatgccacaacgatgggagtgatcggagcatctactagctgcaactgcaatgcaagcctgcaaccgcgtggatt

SEQ ID NO: 4226 - DNA, 383 bp, Zea mays
  Clone ID: LIB3279-005-P1-K1-G3
gtgcagccgtcccgctgcacagaagagttccgcctgaggaaggcgaagaatgaccagctgaaggcggatgccaaaaagtgcggcgaggttatcagcaccaagaggcagccattgggtcccaagcccggcttcatggtcgagggcaccaccattgagaccgtaactcccatcccatatgatgtggtcaatgatctcaagggtggatactaggttgtttggtccatctacctgcagtacccagttctacatctgtgttactctagtgcgtgcaactttgctcactctgagcagtagtatgaacctgttgtgtgttcctgttgaaagatttcccattttaagtgcaaacctgagtttctccgaacgcgttataccatgaccttgct

SEQ ID NO: 4227 - DNA, 384 bp, Zea mays
  Clone ID: LIB3279-005-P1-K1-G4
tgcagccggcagtcctcgcctccgcctcctgcaccctgaccgtcaacagaggaagacgaggatgtcgggatccaaggtgtacaccctcgaggaggtggctaagcacaacaccaaggacgactgctggctcgtcatcggcggcaaggtgtacaatgtgaccaagtttctggaggatcaccctggaggcgatgatgttctgctgtcttccactgccaaggatgctaccgatgatttcgaagatgtggggcacagcagcactgcccgtgcaatgatggacgagtacttagtgggtgagattgatgcagccacgatacccaccaaggtgaagtacacgccccccaagcagccgcattacaaccaggacaagacccatgagttcgtcat

SEQ ID NO: 4228 - DNA, 370 bp, Zea mays
  Clone ID: LIB3279-005-P1-K1-G6
ctgctctcgtccctagaaataaagcagctcctccgcggggcggcgaactactacccatcgccaaaaccctagccccgatccggtcgaggagcactacttcttggcatggcgggcacccctagccaggcaagcctcctgctccagaagcagctcaaggatctggcgaagaacccgggggttgggttctccgaagggctggaaaacaatagcaacgttttgagggggcaggtaacaataatgggcccgcccgcccccctttttaacggaggctacttaaaggcaaaaagaaccttcccccaaaacattcccacaagcccgccttaagaaaaattaactttgggatggggcattccaatggttattccggtgg

SEQ ID NO: 4229 - DNA, 303 bp, Zea mays
  Clone ID: LIB3279-005-P1-K1-G7
tttgggctgagctttttacactgtccacaattttttctggcggacgtgaagctgaccagttttacaatacatgcactgagctcgggacccctgatggctctatatgggcagagggaatgcacctggctcgttcatgccgctttaagttttttcagaatcctacaagaaacttaccaccaccggctgaagggagtgcgattctttccactctccccatttcgacaactgtgctactgggatccttgaaggaggccaactgctgagcaagcattacaacatgctttgtttaatgtgtgccattgg

SEQ ID NO: 4230 - DNA, 267 bp, Zea mays
  Clone ID: LIB3279-005-P1-K1-G8
cacgccgccgacgccgacgctgtttccgggcggcggctacgactacgggcagtccaaggagcttcgggaggcggcggatctcaagcggcggcacttccacgcgctcggggccgacctgagcctctacaagccgttggccgacgccggggccgcggagaagcccctgcggcgtttcttctacgagtggccgcgggagagaggcgacactaggccgtcgtgggcgggggcggaggacccaacccagttttccatttccatccccccggt

SEQ ID NO: 4231 - DNA, 291 bp, Zea mays
  Clone ID: LIB3279-005-P1-K1-G9
atccggggcggcccaagccttccgtgcagccgtcccgctttacaaaagaggttcgcctggggaaaggcaaaaatggccaactggaggggggtggcaaaaaaggccgggagggttttaacaccaaaaaggcagccttgggttccaaagcccggtttattggtcaggggccccaccatggaaaccgaacctcccatccaatatgatgtgggcaaggatctcaaggggggatactaggtggttgggtccatttacctgcagaacccagttctacatttgtgttcttctagggcg

SEQ ID NO: 4232 - DNA, 383 bp, Zea mays
  Clone ID: LIB3279-005-P1-K1-H1
accaggcgtcctgcatgcatcaggagggggatgaatactgagaacgcacgcccgtgacatatcagtggatgtgagttacagagatatggctcgtaattcctgggcaccggcatgtggtgttgtgactgtcctgccactctagtgtttttggctggcaaacaccgctatgtgctactgctttgcttgcgaggatctatcacctgccaacattatcgatctcgacgagcttacaccgggggctgtatttcgactatccattgagaggataataagcccattttatgaatggtatgcggatcttgatatgtgagctggatttgtgctgtgcgaccattttctgaagacatgttattttatacatgcctgtcttgatgttatgaagc

SEQ ID NO: 4233 - DNA, 212 bp, Zea mays
  Clone ID: LIB3279-005-P1-K1-H10
tggtagcccattctcccaccacacttagttaggggtagattcggaggcatggggcggaatcaaaatccatggtgttgtacgccaatctcgacgcgctccggacgtcagcggacgacgtgcggatcgtcacgtgggacggccagaccataggcgcacacttctacgttctttcctcggcgtccccactactgtagaggtatgatccacaaggc

SEQ ID NO: 4234 - DNA, 342 bp, Zea mays
  Clone ID: LIB3279-005-P1-K1-H11
ctctgcacacctcccgccgcgccgaacacgcgcctttccccttttcctctcccccagatccacccggcgcgccacccctctcggctcctcccaggcggggtcggcccttttctcgccctcctccgtttctctccggcgtatatatgggttcgaaatcagtagatgaggtgctcgatgccgccgcccgagtccattgctctgctctccgtctggacgggcccaacgtacagttttccggctccttcgaggaagaaccaacgacgtctggcctggagaatggccatcacgagccctttgttattggcgttgctgggggggcatcgtcagggaaaaataccccgt

SEQ ID NO: 4235 - DNA, 81 bp, Zea mays
  Clone ID: LIB3279-005-P1-K1-H12
tcgggacttccgttgtctcttagaactttataccccagcgcggcgtgccgcagaagcaaaacagccggaggggctcttgga

SEQ ID NO: 4236 - DNA, 386 bp, Zea mays
  Clone ID: LIB3279-005-P1-K1-H2
ctgcgtatgacttaagctacatcttgagcaacatgctgcagatgggagagctgaatggatggagaaggtcagagatgcgccaccacatattgtcaagaaagaggacaaaaagagtgatcggcttgagaaaaataaaaggaaagagaaagataaacacaaagagaagaaaaaggataaagaggcaaggaaggagaaaagggaacataaccacaaacagcataataaaacacgagaaaacaggataagttatcccatagataggcttaacttgaagcactcggtccctcctttagccccaccagttgatgatggaaaatctgttgtgcctgatgagaacctgaagaagcgaaagaaccatgaaacgaatggttacttacgaaacaacc

SEQ ID NO: 4237 - DNA, 339 bp, Zea mays
  Clone ID: LIB3279-005-P1-K1-H3
cccacgacattttcctgaacgccccataatgcctggtgtcctgatggtcgaggctatggcccaggttgggggtctggggatgctgcaacctgaaagcggtggatctcgagacaacttctttgtcgtcgggattgacaaaggtaggttcacgaagccacagattgctggcgatacactgatcatgaggatgacactgactaactatcagaagaggtttggactctaccagatggaaggaaaagcttatgttggcggtgacctactttgtgaaggggagttcctcctagtgagcgcaactgagtagtgcaaaaacacttgatgattctctggggagaatca

SEQ ID NO: 4238 - DNA, 386 bp, Zea mays
  Clone ID: LIB3279-005-P1-K1-H4
ctgctctcttacgacccaaacctgagggaggcactttggccatcccgtgaggaggcccgcacccagatcttgagcatctgggaccaggcagatatcgtcaaggtcagcgaagtcgagcttgagttcttgacaggcatcaactcagtggaggacgatgttgtcatgaagctgtggcgacctaccatgaagctgctcctggtgactcttggagatcaaggatgcaagtactataccagggatttccatggagctgtcccttccttcaaagtacaacaagtcgatacgactggcgcaggcgatgcgtttgttggtgcgctgctccgaaggatcgttaaagatccatcctcgctacaagacgagaagaagcttgtagagtctattaaatt

SEQ ID NO: 4239 - DNA, 248 bp, Zea mays
  Clone ID: LIB3279-005-P1-K1-H5
attcaaaagtttgagcggatgtgcacgcttatatgtaaatggaattacagattgccacaacattgattggtcttatttcataatcatgaggcggacgtggtctacccaagaagaagaggctgttggtgcgtccgcacgtcgctaacattggcctccgcgtcacaacgggcacggcgaaccgttatcccgttcctgcgcgccagaacggacgacgtatacagtatagcaggggcgtgctgttgcaccac

SEQ ID NO: 4240 - DNA, 388 bp, Zea mays
  Clone ID: LIB3279-005-P1-K1-H6
tcgcacagatcaagggataccgtggcaagattgaggctgaattgagcaacatttgtgatggtatcctaaagctgcttgacacgcaccttgtgccttcctccactgccacagagtcgaaggtgttttacctcaagatgaagggtgattatcacaggtaccttgctgagtttaagactggtgctgagaggaaggaatctgcagagagcacaatggtagcttataaggcagctcaggatattgcattggctgaactgccacctattcatcccataaggcttggacttgcacttaacttctcagttttctattacgagattcagaactctccagacaaagcttgcaatcttgccaaggaggcgtttgatgaagctatttctcagttggacat

SEQ ID NO: 4241 - DNA, 404 bp, Zea mays
  Clone ID: LIB3279-005-P1-K1-H7
gtacccagcgcgtaccgcacgcctgcgtatgacttaagctacatcatgagcaacatgctgcagtatggataagctttatcgatggaggaggaatgagatacctcactacataatctcaagaatgaggacaataagagtgatcggcttgagaaaaataaaaggaaagagaaagatcaacacaaagagaagaaaaaggataaagaggcaaggaaggagaaaagggaacataacgccaaacagcgtcaggaatcacctgacaacaggtaccgcttcccattaatagtcttaacttgaagcactcggtccctcctttagtcccaccagttgatgatggaaaatctgttgtgcctgatgagaacctgaagaagcgaaagaaccatgaaacgaatggttacttacgaaac

SEQ ID NO: 4242 - DNA, 338 bp, Zea mays
  unsure (1)..(338): unsure at all n locations; Clone ID: LIB3279-005-P1-K1-H9
gggtggttttgcttcttacatccancataacaaggaaggacttgagctcttggacactcagagcaaaaacgctggattctccggcacggttgcgagagcgagagatggacggtgggatgttcggttatcgagaccccgccgatggcggcgctgcatcactttttggacgtgcccgacggtgactccagcgcagacggtgacaatggcgggcagagggggtaccactcgcacttacgtccgtgacgcgcgcgccatggtggacacccctgtcgacctcatggagctgtcgagtgcgttcacgttactggtggacatgccggggctgggcacggtcgaca

SEQ ID NO: 4243 - DNA, 408 bp, Zea mays
  unsure (1)..(408): unsure at all n locations; Clone ID: LIB3279-006-P1-K1-A1
gatgttcccctacaacacgcccgtcaacaaggaggcctactactaccggatgatattcgagaggctcttccctcaggactcggcgagggagacggtgccgtggggcccgagcatcgcctgcagcacgcccgcggccatcgagtgggtggagcagtggaaggcctccaacgacccctccggccgcttcatctcctcccacgactccgccgccaccgaccacaccggcggtaagccggcggtggccaacggcggcggccacggcgcggcgaacggcacggtcaacggcaaggacgtcgcagtcgcgatcgcggtctgacgagagtacgtgctcgcgcacctncctgcttctaccgggctgcatcctgcagcatgcactgggcgagcacagccgatcagcgccaataaact

SEQ ID NO: 4244 - DNA, 96 bp, Zea mays
  Clone ID: LIB3279-006-P1-K1-A10
acattatggtctttatgaaagagtgcacctcggttgatgttccttttgccggtgctggaactatgcgatttgctgtaattttgcttctttgtcctc

SEQ ID NO: 4245 - DNA, 400 bp, Zea mays
  Clone ID: LIB3279-006-P1-K1-A11
cccacgcgtccgcggacgcgtgggttgggatctctatctttgtcaacattggctctacgggattgacaatattcatgattgtcaagctcagacactgttggctcgacatcgagttccttgacaccacactgctgctagtgtacattatgtgtgctctctcattaatgtccaaggtaattaagcaaatactcctataacacacacacttagagctattggataaattaagccatatgtatctatggatctagctagcagtatgtaactgcggaacgatgatgaagaggcggccacgttgcatgcatgcttcggagcttggatggtgcatgcaagcatgtatatatgtgggtttagtgctggcggtatgttcttaccaagaccgccatcatgggcggacttt

SEQ ID NO: 4246 - DNA, 382 bp, Zea mays
  Clone ID: LIB3279-006-P1-K1-A12
cccacgcgtccgcggacgcgtgggcgccgcggagccgcaccaaatctcaccccgcatcctttagggttagggttctgcccgcacctgtgaattccgttgcgaaatctctcatctcctgagtcgagaatcgcagtttcccgctcggctcgtttggggaaatcggttattttcgtccggccgcgtgggctctctgaagtgtttgggctgtcggctatttgccccgagttttcaggtttgaaaaatcgtcgtaatttgttcatcacgcggctgccgaactttaagtggtggtggaagtttcgtgcctcggcgtggcccccgtgctccgattcctgatcacctgcccgccccgcacgctatgagcgccaggcgcgcgggctggggc

SEQ ID NO: 4247 - DNA, 404 bp, Zea mays
  Clone ID: LIB3279-006-P1-K1-A5
ctcgtgccctcgccctccttttttcttagtttacccgccgtcccgcgcgccgccgtttcggttgctcggctaggggggactgggggagtgccagcgagtccatggcagcggcgagggcgtgcttcgtcgcgctggcgctggtggcggcgctcttcgtggccggatcggcggcggcggcggcggcggcggggaatgccggaggccggccgcagctgacgctcaggcagcggcgccggcagctgctgcggcagcggcaggtgcgcagccacctcaagaggctcaacaaggcgccgctcgccaccatcgagagtccagacggagacatcatagactgcgtgcatatctccaaccagcccgccttggatcatcctttcctcaagaaccacaccgtccagatgcgggct

SEQ ID NO: 4248 - DNA, 406 bp, Zea mays
  Clone ID: LIB3279-006-P1-K1-A6
cccacgcgtccgaaccgcatcctctcatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggtttcggctaggcttacaggagtacagggcgactagcatgggagtagtgcaatacttttgggagcaatagataacgaggatcctggtctttcgaatagtattggtaatggaaattttccgtcggttgtgtttctgat

SEQ ID NO: 4249 - DNA, 390 bp, Zea mays
  Clone ID: LIB3279-006-P1-K1-A8
gaattctctcggtctctaccaaaaaaacagcgacctctaacgcttagctaggtgctttgtgtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgcttgcgtgttccttgggcgccgacccgtaccggagcacgtgcccccgtgccgaggagatcattcctgcggccgttgagagggccgtctcttcctacccacgcattgcagcgtttcttctgcgccttcatttccatgact

SEQ ID NO: 4250 - DNA, 347 bp, Zea mays
  Clone ID: LIB3279-006-P1-K1-A9
gcgccttcgacggcgcgtccatgaaccccgccgtgtccttcggccccgccgggggtcagctgggagtggggctaccagtgggtgtactgggtcgggcccctcatcggcggcggcctcgccggcgtcatctacgagctgctcttcatctcccacacccacgagcagctcccctccaccgactactaaaagccgaagccgaccgacccacgggtgcgcagctaggattcaactctcttttcccgctcgccggcgatcggttagtttttattgtgcacgtgcatgcattggcgactggctcaggccggcggttcgccggcgccgctcgcattggttgctttttcttggac

SEQ ID NO: 4251 - DNA, 420 bp, Zea mays
  unsure (1)..(420): unsure at all n locations; Clone ID: LIB3279-006-P1-K1-B1
cggaannccagggtccgagcccacgccgtacggcgtgcctgttgtacccggctttttagaccgcaactatccattcgcttgcgaaactatcgcattgggtggttcgtcatggcgcgccatgcgtcacccgtggcaaatactttaacacccaagggtcttataaatggtgagtattgcagtgcgcgtgggggagatttgtcatctcatgccttcagacgcctgcagcgaacatactaccaaacacannaccagggtgctcttctctttttgatgaagatccttcnttattgcaatantgtggagaatccctcaatctttcttggtcagcgaacctcgtgacatnnntcttcagggagggttcttcgctcttttgtgatcaatcccgtgccttcttggaaaaaaggaggaaaccacaatcat

SEQ ID NO: 4252 - DNA, 243 bp, Zea mays
  Clone ID: LIB3279-006-P1-K1-B10
tcgatttacgacaacccaaacaaacaacccccctacacacacacacaggggcccggtcccggtgggcgtttctattctatgcttttggccgcccatcaacgaacgagtcgcaaccggatccctacttacccgagggcgcttggccgtctcttaaacccgaaggagcgcgcgcgtttgacattggggagctcgcggggggttttttttccccgccgcccgccgtgctgtaagtggtttttttct

SEQ ID NO: 4253 - DNA, 371 bp, Zea mays
  Clone ID: LIB3279-006-P1-K1-B11
accagctcgcgggagttgtggccgtggaggtcaccggtgggcctgagattggcttccaccccggtagggaggacaagcctcagcccccacctgagggccgccttcctgatgccactaagggttctgaccacctgaggcaagtttttggcaagcagatgggcttgagcgatcaggacattgttgccctctctggtggccacaccttgggaaggtgccacaaagagcggtctggtttcgagggggcctggactacaaaccctttggtctttgacaactcttacttcaaggaacttctgagtggtgataaagagggccttcttcagcttccaagtgacaaaaccctgctgagtgaccctgtttttccccctctt

SEQ ID NO: 4254 - DNA, 367 bp, Zea mays
  unsure (1)..(367): unsure at all n locations; Clone ID: LIB3279-006-P1-K1-B12
cgctcctcttgctgctcgctgcggcctgtggacctgcagcacatgcccacggggctgtcgagctcccgcatcatggcttanccttgaaggaacaaatttcttcaaccaagattcctgcccgtctcaagagtggcagcggactatgctcggcctgtgaaaacttcacgagcgaagccgtcacttatctcggcaaggaacagacacaggacaggatcatggagttccttcatgatgcttgctcccaatcattctcctttgaacagaagtgtgtcgagctgatggactcttatgcgactctcctgtttgccaagatcacggagatcagaccggaagcgttctgcaaacggtatggcctgtgcagggacac

SEQ ID NO: 4255 - DNA, 314 bp, Zea mays
  Clone ID: LIB3279-006-P1-K1-B3
tatgattcctcagcttattctgttatacagtcaagggcagcatcatgtacccgcaggcttttttcttcagctgattctttcacaccaataaataaatactgcgttaccaatctgcttgtatccataaacagaatttttaagattgaaaaaaacaataatacttatgaaattgaaagtgcatttcagaccttttgtctaattttttcaacaagtcaaagagcacatttctttcttacatcatcaaatgttcccatacattttttctactcatcctttgaccgctaaggggagggtaaacacctccctcctttaca

SEQ ID NO: 4256 - DNA, 347 bp, Zea mays
  Clone ID: LIB3279-006-P1-K1-B4
ggcttcttggcagggaattttcagcagtgcaaggaaaaggtagaatcatgcgcagaacaatggattactgcacaaaatttggtgttggcacttggaagaaggaatgcagaagccatcggtttggttataagtgatgggaatgaggtgagcaaccaactgggtgcaagaatttcatctgctgttgctgctggatttgaagataatgacatttcaagcaaatcccttctaagttgtattgacgattcattgaagttggaccatggtattcgcgagaatgtgaaatccatcgtcatgacatccagagcacaacttcatgacttgggacatggtcactatgagatgacaaa

SEQ ID NO: 4257 - DNA, 401 bp, Zea mays
  unsure (1)..(401): unsure at all n locations; Clone ID: LIB3279-006-P1-K1-B5
cccacgcgtccgcggacgcgtggggccgccgccgcatcggcctcccangtgggcaggggcgtccaccccagccgccgccatgaatcgcaacccccgcgtcacgagctcccgccggaagtgccgcaaggcgcactttacgggcccgtcctccgtccgccgcgtgctcatgtccgcggcgctatcgacggagctccgccacaagtacaatgtgcgttccatcccgatccgcaaggacgacgaggtgcaagtcgtgcgcggcacctacaatggccgtgagggcaaagtggtgcaggtgtacccccgtcgctgggtcattcacgttgagcggatcacccgcgagaaggtgaacggcttcaccgtgaacgtgggcatccaccctttcaagggcatgggtacaaagc

SEQ ID NO: 4258 - DNA, 405 bp, Zea mays
  Clone ID: LIB3279-006-P1-K1-B6
gtcgaggcgctcgatccgtagcctggtcgttaaggctgcaactgtcgtcacggcaaggtgcactttactgaagcctctgggagatagggtgcttgtgaagcttggtgccgcacaggagaagacaggtggtggcattttgcttccatctactgcccagactaaaccacaaggaggtgaggttgttgctgttggagcaagaaggaccatcggggacaagaaaatagctgtggatatagagactggagcacaagtagtatactcaaagtatgctgggactgaggttgaattcaatgactcaaagcatcttattctcaaagaagacgatatcattggtattcttgagacagatgatgtgaaggacatgaagcctctcaatggccgtgttctcatcaagggtgcagaagc

SEQ ID NO: 4259 - DNA, 386 bp, Zea mays
  unsure (1)..(386): unsure at all n locations; Clone ID: LIB3279-006-P1-K1-B7
gtctgcaccaaggccagggttcgagcaatgtctgcgtggataatggttcaggagctgtggaattggaggatgccnataaggtccctaatatcaaagctgattggccagtccgcgtcattcagaggcaggaggggtatcaagctggtttcaaaggatggggtggttggggtgaccggcgtgatcgtgagctatgtttgagttttgcatacatgtaccatgttaaagatccatcgtcatcgtaactaggcacacggttttttggcataagtagagcccctggtgtaatattgtttggcatgtgccctttgatccatacacggtttgtgctataaatagctactgtagttgcccatcggcaaagtttttctagagtggttagagttttt

SEQ ID NO: 4260 - DNA, 363 bp, Zea mays
  Clone ID: LIB3279-006-P1-K1-B8
atgattcctcagctgattctgttatacggtcaagggcagcatcagttagtgggaggcttctttcttcagctgatgctttcacagcaataaataaatcctgcgttaccaatctgcttgtagccatagacagaattttgaagatggaagaaagcaagaatactgatgaaattgagagtgcattggagaccttgggtctaattggtacaaccaggcaaggagcacattttttggttacatcatcaaatgttgccagacatgttgtcgagtcattctttgaccgtcaaggcaagggtagacagcttgctgctttacatgcttttgggaacatctgtggtgttggtagacaagaagatcaaattaaac

SEQ ID NO: 4261 - DNA, 221 bp, Zea mays
  unsure (1)..(221): unsure at all n locations; Clone ID: LIB3279-006-P1-K1-B9
ggcaggcgcaggcgtgaccaggcataagcttccgcatccgtantcccagtggggcacccggggtcgctgacctgccacctcatcgtcgaggcgaggaccagacataccacaccgtacccgttaccagcgcggcgcacgaaccggccaattttattcggctgtcgtctcgtgctacggaattaagccagctaagtttttggggacccgggacaaaaatattc

SEQ ID NO: 4262 - DNA, 290 bp, Zea mays
  Clone ID: LIB3279-006-P1-K1-C10
gcaaacgatgtatcataacttaggtacgatgtttttgtaccttggcggcagtggtgtgtgttttgttcattgccttgctaaaggtggcaccaaatgttctttgatgggaaaattccttctgtagcactgagctgttttcagtcacaccttattttgtatacaatgaaacaaaacgctgtgctcatggcacagtgatttggtgaatgttcacatgtttgtttccgactccgttttaaaaaaaaaaaaaaaaaaaaaaaatccaaatacaaaaaaaaaggggggggggaggg

SEQ ID NO: 4263 - DNA, 356 bp, Zea mays
  unsure (1)..(356): unsure at all n locations; Clone ID: LIB3279-006-P1-K1-C11
agaccacagttgccgccgccgccgccctaagccagggtgctgaggctttcggtggcctcttcggcggcagcgagcacccaccagcagttctgtagaaatggctgatggtgaggacatccagcctcttgtctgcgacaatggcaccggaatggtcaaggctggttttgccggcgatgatgcaccaagggctgtattccctagcatcggtgggcgtcctcgtcacaccggtgtcatggtagggatggggcaaaaagatgcatatntttgtgatgaagcacaatccaagagaagtattctcaccctcaagtacccgattgagcacggtattgtaagccaactgggatgacatggagaaa

SEQ ID NO: 4264 - DNA, 391 bp, Zea mays
  unsure (1)..(391): unsure at all n locations; Clone ID: LIB3279-006-P1-K1-C12
cccttcggccacgccttcggattggtccaggtattctcaatcgaccctgttctgggagcgcgtaaagatgaaggttgttgctccctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcaatcccatttggccgcngcngtgtggctgttgcggcaagtgcacctgcttgttgcggagctgctcctgcagcttaggcaaaaaaaaaagagaaggtggaagagaaaggaaaaagcgattatnatatgggcttc

SEQ ID NO: 4265 - DNA, 411 bp, Zea mays
  Clone ID: LIB3279-006-P1-K1-C2
gaaaccctcgctttcgacgagatccagctgtcgccggagaagccggctaccggcggtgccttcgtgctgcacggcctcctcggttccggccgcaactggcgctccttctctcgcgccctcgtctccgaactccgtaaccgctccccttcagacgagtggaggatggttctcgtggacttgaggaaccatggcagatcggctgggatcaaggggctcggcccaccccacaacatatctactgccgccaaggacctcgctgatttagtgaaggcccgtggttggccatggccggatgttgttgtgggtcactccatgggtggaaaagtcgctctagatttcgcggagagctgctctcgcggtgtgtatggagattctgctaatcttcccaaacagctctgggtccttgattct

SEQ ID NO: 4266 - DNA, 410 bp, Zea mays
  unsure (1)..(410): unsure at all n locations; Clone ID: LIB3279-006-P1-K1-C3
gctagggaggttatagggggaagcctggaatcagatccanaggatgccctggcattgttgggcaagtactgcaaatgggccntagtgacacttgcttcaaagggatgcatggcaaagcatggcaaacaggtcgttcgagtcccggccatcggggagagcaacgcggtggacacaactggagcgggcgacctgttcgcgagcgggttcctgtacgggctggtgaaggggctgccgctggaagagtgctgcaaggtcggggcgtgcaacggcgggtctgtgacccgggcgctcggcggggaagtgctgcctgagaactggcagtggatgtacaagcagatgcacgccaggggcttgctgctcccggagctcaagaactgaatgaaactattgctgctgtagctttagctagc

SEQ ID NO: 4267 - DNA, 380 bp, Zea mays
  unsure (1)..(380): unsure at all n locations; Clone ID: LIB3279-006-P1-K1-C4
caaccaccaaagcaatcgaaaagcaaccctgcaagtgcaggcaaagaggggcgcgaccaaacagatccaatccaatggcgatggcaccgtccgcagcatgcgtcgtctcgttccccgcccgcccggcggcgttcacgggcgggccccgcgccgccgcgggcaccggggcggtccacgctgtcgcggggtcggcggagggagccaagtggtgggcgccgctgctggggtggtcggggaaggccgactacctggaggccccggcgccggcgcaagatgaggcgccgcggaggcagttcgtgggggtgatgactgaggagaaggcccgggagctgcgggcgcggatggcgcanacngagtccttccacgacgccatgtaccac

SEQ ID NO: 4268 - DNA, 340 bp, Zea mays
  unsure (1)..(340): unsure at all n locations; Clone ID: LIB3279-006-P1-K1-C5
cccacgcgtccgggaagcctcaaatccgctctattcctctctccccctctcggcccgatcgcaccagcaggcgagcgcgaggcggangagtaaagatggagtcggaccagggcaagcttttcatcggcggcatctcctgggaaacgacggaggagaagctgagcgagcacttctccgcctacggcgaggtaacgcaggccgccgtcatgcgcgacaagatcaccggccgcccccgcggcttcgggttcgtcgtcttcgcggatcccgccgccgtcgacagagcgctgcaggacccccacacccttgacgggcgcacggtcgatgtgaagcgggcactctc

SEQ ID NO: 4269 - DNA, 298 bp, Zea mays
  Clone ID: LIB3279-006-P1-K1-C6
gcctcattcatctccattcgaaacaccctcgcacccacactctcccttcggggccaggctaaatgcccggagcgatggctcgcacgaagcatacggtgcgcaagtccacgggcgggaaggcccctaggaagcatctggcgaccaaggcggctcgcaagtcggcccctgcgaccggcggggtgaagaagccgcaccgcttacgcccgggcaccgaggcgctgctcgagatccgcaagtaccagaagagcacggagcttctcatctccaagctgccctttcagagcctggtccgcgagat

SEQ ID NO: 4270 - DNA, 188 bp, Zea mays
  Clone ID: LIB3279-006-P1-K1-C7
cgttaacacgtcatgttaatatcaatcagtttccctacacaaaaaagaaccggaaaaaaaaaattctataaaaccccaaaaggtcttcaccataaattactcccctttttccatcccattcacgcgcctgtttaagtatcctataatatcacttcaatgccattcacttgtctaatttttacaacggc

SEQ ID NO: 4271 - DNA, 238 bp, Zea mays
  unsure (1)..(238): unsure at all n locations; Clone ID: LIB3279-006-P1-K1-C8
agaataccccgaacacgaccagaaggcctactaaaccctgcctccggcgcgggcgcgccatgggcgacgagctcnactagctgatcggcttcctctccgaccgcaacccccaagtgcggggcgcggcggcggacatcgtgcgcgggctgacgggtggggaggacggccttccggcgcttacggggcgcgccgatagcgcccttccggcgttgcttcccctggtggccttccctggcgg

SEQ ID NO: 4272 - DNA, 393 bp, Zea mays
  Clone ID: LIB3279-006-P1-K1-C9
cgcctccgccttaaaccctaaaccatgacctctcgcgccgccgcgggggcgggcctccttcttgcggtccgcctccactctgccccgctccgcctgcgcttcttctgtacctctgcctcccggctccgatgggcgtgttccgcggcggcgctgcttgccatcatttctctcgtcaccgccatctgggctatgcccgacgccggcgcccgcaccaacgttgaaaccgatgcccacccttttcggttggagattgaaacgctcaagctaaaaggcgcgcgggggggattttttttaaaggcaaatttcaaagcattaaacattaaagctagtatcttggggggggacaacaaactcaatgaagcaatggaacgtgaaatccatctttttacgaat

SEQ ID NO: 4273 - DNA, 406 bp, Zea mays
  Clone ID: LIB3279-006-P1-K1-D1
ctccttccaacggttgtcctctaaccaataatattttttcacctaatgaatattgggcttttattttctttaccccaaaacaaaattatgctagttctgagattttagagtaaactaaaattgagtgttgcgattagactatgtccataggcatgagaattacaaaatatatatgtccttacttattggtggttatttctttgtgctaatgactacactgttgaagttattgttctcgtgaggaattatttgtgaaagtctccaattttctgtacaacgttgatatgattcatgtcggcgttgtggagcatgctcatatgcgtgaaagagaagatcatgtactcatgcttcgacgcgaacgcgaggcatgaaaccatcgtcaacacttcatcgtgtccgccatgct

SEQ ID NO: 4274 - DNA, 201 bp, Zea mays
  unsure (1)..(201): unsure at all n locations; Clone ID: LIB3279-006-P1-K1-D10
cccacgcgtccgcggaatcccggattccgagtaccaggccatcgtgcgcatgccttctgctgagtttatgaggatctgcaaagatcttancagcatcggagacacagtcgtcatctcggtgactaaagagggcgtgaaattctccacatctggagaaattgggagtgcaaacattgtctgcaggcagaaccaaactattga

SEQ ID NO: 4275 - DNA, 226 bp, Zea mays
  unsure (1)..(226): unsure at all n locations; Clone ID: LIB3279-006-P1-K1-D11
cggagtcgcgccgccacgctcctatgacaaccgcatcaangacggggctggcggacccccacggtgaccgccacctctccatccacaagatcttcaccggagacgtgctggacctgctcgaccatgctgcgaggctggacctgatgctggccctgacaggggacggcggtgcggcgttcatggccggcttctccgcgcgcgggtggtgggtctctaatgaggatgg

SEQ ID NO: 4276 - DNA, 399 bp, Zea mays
  unsure (1)..(399): unsure at all n locations; Clone ID: LIB3279-006-P1-K1-D12
gtcaggcccgacggggtgacgttcgtggcgctgctgtcggcgtgcggccaggccggcctggtggtcgaggccagggagttcttcttccagatgctgccggtgttcggcctaccgccccagcccgagcactacggctgcatggtggacctcctgtgccgcgtgggccacgtggacgaggccgcgcggctcgtgcaggcgatgcccggccgccccaacgccaaggtgctcggagccctcctgctcgacgcccacgtcctgcancggtggcaagaggacggtgtgaggctgggctagtgggccgctcggcggatatcggagctggacctccacgacggcgcggcgtacagtctgtccaacgggtacgcgtcgctgcagcgatgggatcgcgttgaggaacac

SEQ ID NO: 4277 - DNA, 358 bp, Zea mays
  Clone ID: LIB3279-006-P1-K1-D2
cggacgcgtgggtttaaaagcggtacataaatgtgtttctggtggaggtagagttcggattccaacgtttgctctgggaagagctcaagaactatgtatgttactggatgactattgggagaggatgggcttgaaagatcctatttatttttcagctggtttaaccattcaagctaatgtgtactacaaaatgttgattgggtggactaggcaaaaaatcaaggacagccatacagggcataatccatttgacttaagcatgtttggcactttgaacgtttctttattaacaaccctgggccctgtgtactttttgcaacacctgggatgattactgggggatttcccttgaggcggt

SEQ ID NO: 4278 - DNA, 83 bp, Zea mays
  Clone ID: LIB3279-006-P1-K1-D3
cccacgcgtacgggttggcttctcctacccatacggttcgggttcaggttggggagggtctccagggttcggtttcgtgggtg

SEQ ID NO: 4279 - DNA, 402 bp, Zea mays
  Clone ID: LIB3279-006-P1-K1-D4
caataatgaagttattttcaactatgcaaggatttgtttctgttagtgggagggaggaaagtgcttgcaataagatgcttccgtttacaatatggactgcgttctttgccaatgttctcactggttcagccttagttcaattcgagattttccttaatccaaaggagctaccttcaaaacttgcagttcttgtaccagcgcaggcctctttctttattgcatatgtggtcacatcgtggacaagcataacatctgaactcactcaaattactgctcttttctgtcatctggggggaaagtgtgcgaagtgttgcaagcgggattactccaaagctccatcaatgccttattatagggaaattccacggattctcttgtttgggcttattggactcgcatatt

SEQ ID NO: 4280 - DNA, 218 bp, Zea mays
  Clone ID: LIB3279-006-P1-K1-D5
cactaatcaacaagcaggaccagctagctagctcctcccactgctatcaccggggcccgggccagccatctcgctgaaagagaaaagcgcacccatgaagactactagctcgggcattgcagtcgtcctcctggtggcgatgctggcagtccactccgcgggggccgacatcttgtgctccgacgtgctcaacgacctgtcggcgggcctggcctttc

SEQ ID NO: 4281 - DNA, 273 bp, Zea mays
  unsure (1)..(273): unsure at all n locations; Clone ID: LIB3279-006-P1-K1-D6
tgcatgtggcacaggttctaagcctgtgctttatattaccctgtggtggggcggctaacggggcccttagttctctgccttgcantttgacactttggcttactggtctgaagtcacttttacggccccgtttggatccttggaatggaattccattttaataatagaaatttaggcgtgttaatttaactcaacacagttataagaaaaatatttgtatattattattagcaagatgtgtgagatatttatgtgctacatttttacataaag

SEQ ID NO: 4282 - DNA, 406 bp, Zea mays
  Clone ID: LIB3279-006-P1-K1-D7
cccacgcgtccggggaatcaaacagatcggcgtaatcggctggggctcgcggggtcctgcgcaagctcaaaacttgaaagactcacttgttgaggcaaagtcagatattgttgttaagattggtctccggaaaggttctaaatcttttgaagaaacccgagcagcaagattcacccaaaagagggggacgctgggtgatatatgggagactgtatcaaacaatgatcttgttttgctactgatatctgattctgctcaagctgataactacaagaaaattttttcgcacatgaaaccaaacagtattcttggtttgtcacatggatttcttcttggacatttgcaatctctgggttttgatttccctaaaagcatcaatgtgattgctgtatgccccaagggaatg

SEQ ID NO: 4283 - DNA, 369 bp, Zea mays
  unsure (1)..(369): unsure at all n locations; Clone ID: LIB3279-006-P1-K1-D9
aagacattctcatttttcagagtgaagagtttgtcaaaaggaagcggcgccgagaaagacttgtctttggcactncctttaagagagtcgaactcttccccactgccttcagttgtaccctcattctctgcatctgagctgatgaacgatatcaccgggagaagcaatttcggttggcccaagcagcagtatgttaaagaacagcctgctccaacatttgttgaaccaatgcccaaggcaaaggatgcgggggagttcacatcatcaaatatagctgaagtaccagatataatgtaccaacttggaaggcagccatcaaagaaacatgtcactttggcgaacaatatgagaaattccggtgcttaccca

SEQ ID NO: 4284 - DNA, 290 bp, Zea mays
  Clone ID: LIB3279-006-P1-K1-E10
acgcggacgcctggggaaaggcgagagagagagataaaatatatatgggggagggggaaagagagaggagtggaaaacccccaaaaggttcccttttagggaccttaaactcagcgactgcaaaggaggattaagggaatggccggaatcgaaccaatcagccagaattggaacccgttctttttccgaaaaaaggacccaccctccccctccaaaaagaataaaaaggccgtaaccccccgcccgcctcccgttccgagatttattccattaaaaaatgcaagggtggg

SEQ ID NO: 4285 - DNA, 355 bp, Zea mays
  unsure (1)..(355): unsure at all n locations; Clone ID: LIB3279-006-P1-K1-E11
ctcgaaatttgggggaagcaagcgagagcagcagcaagcctcatcgggaaggggagagatggaggcggcggntcgcctcctcctcctcatcgtctcctccctcctcctgctcctctcgccggagcggccggcggaggccgcgccgcggcgaatccagccgctcgccaccgccgcgctgagccgcctctacgacacctccaactacggcaggctgcaactcaacaacggcctcgcgctcactccgcagatggggtggaacaactggaatttcttcgcctgcaacattaacgagacggtcatccgcgagacagctgatgcgctggtgtccacgggactggctgcgctgggctacaac

SEQ ID NO: 4286 - DNA, 376 bp, Zea mays
  unsure (1)..(376): unsure at all n locations; Clone ID: LIB3279-006-P1-K1-E12
gggccggggagactccactccacgtctgtgtcctcttcatcgcaactgcctgggcctgctttcgtttctgtttgtttgtgtgtcggagaacctcccggctccccgcagtccccctggcctcgcagatccgcggcctgcttcgttgctgccttgccagcaagcagccgcgctcatcctcgcggacgccagcggcggggcagccccctctcctgtgatccactccggcgcccggggccgcggttgctcccgtaggtgccgccgcctactnctncccctgttgatactgctcccagatctatccccgggcccgcggcacctgccggcgtcgggaaatcaagtggcttgacggcaaaggaccctttaataaagagatttg

SEQ ID NO: 4287 - DNA, 400 bp, Zea mays
  Clone ID: LIB3279-006-P1-K1-E2
gctgcagcacccgcacctcggcgacttcgccggctgcacgtcgcccaccggggtgggggattccagggaccccttcgatctgcaacagccacagatcggaccaaggatgatgtacgggaacatcgccaaccacgaggcgttcctgaggaggaagctcgaagagcagcatcaggccatcgagctggagggccgccgcttcatggggctgcatctcctcgacctcaagatcaggggccaccacctcggctcctcccccgccacgaccgtcgtggggcaaggcgagggcggcaagggcagtggcaatggcaatgccgtccagctggaggatgtcatcgtccaagatactcctacgaagatgaacagtaacagcgttgcaatgagtgcgcctgcagctgctgta

SEQ ID NO: 4288 - DNA, 191 bp, Zea mays
  Clone ID: LIB3279-006-P1-K1-E3
gctacaccacctcaacttctttcactacacaacacctatcgacctcattctgcttccgcattataggtacgctggccatcttcacccgtctcaaatcgtagtatttagctggtgcaggcacataacaaaatatgatatccgtgtggcttcgccgcccggaccccagtcccctaccttcttacctcacgcaa

SEQ ID NO: 4289 - DNA, 361 bp, Zea mays
  Clone ID: LIB3279-006-P1-K1-E4
cggacgcgtgggcggacgcgtgggcggacgcgtgggcgcacgcgcgctggcgaggcgaggcggctgcgggtgggtcccacgtgcagcctcacgagccgcgtcacgcccccggatggggtgcctgttcttcccagacgaggagagcgagggagcgagacgagatccattcccaacttcagctgcgcctcgactcgtagcccgaaccctagccaccaagccggaggcgagagagcagccatggcgcggtgcctcgcgctcgtcgccctcctcgtactcgggctcggcggcgccggctctcggggcgacgcgcccttcgtcgtcgcgcacaagaagatttcgctctcccgccccaagccgggcg

SEQ ID NO: 4290 - DNA, 395 bp, Zea mays
  Clone ID: LIB3279-006-P1-K1-E5
ctgcagtatgctagagtgcttttggattgcgctacctctgatcctgatgggggtaagagagcccttctaatcggaggaggaatcgctaacttcacagatgttgcttctacatttagtggcatcattcgggctttaagagagaaggagtccaaattaaaggctgcaaggatgaacatttatgtccggagaggtggtccgaactaccaaactggactcgccaaaatgcgcaccctaggcgccgaacttggcgttccaattgaggtctatggaccagaggcgaccatgactgggatctgcaaagaagccattgattgcatcatggccgcgtaaatcacaaatgtggttgttccatttgaagtcacatccgttttgtactagacgttccttgtacgtga

SEQ ID NO: 4291 - DNA, 365 bp, Zea mays
  Clone ID: LIB3279-006-P1-K1-E6
cccacgcgtccgcccacgcgttcgatttgaacagggaccacaatatgtctgcgcaaaggtctggacctttgtttgtaccaattgcagtggatcacatcgggagtttacacatcgagtaaaatctgtttccatggccaaatttaccgcacaagaagttgctgcccttcaagaaggggggaatgagcgtgctagagaagtatttttcaaggaatgggatcctcaacgaaatggataccctgacagcaggggaccttttttattaatttatttttgtaaattgcaatgcttaaatctgtatggaaatatgacatgtttcttttggcctcagtaacgctgacaaattgagaaattttattaagcatgtg

SEQ ID NO: 4292 - DNA, 370 bp, Zea mays
  Clone ID: LIB3279-006-P1-K1-E7
gctaagttcaagttccctggccgccaaaagatcattgagagcagaaagtggggcttcaccaagttcagccgcgctcactacctgaagtacaagagcgagggtagaattgttcctgatggtgtcaacgcaaagctgctcggcaaccacggcagacttgagaagcgtgctcctgggaaggctttcctcgatgccgttgcttaagtgctgatgcgaatcctgacgttttgctttagcgtatcttactttgtttcgtggaacatgaatttcaagtgttttgagggtattacagtgccttatgtgaacttgcctatcttgggctgaacatccgaatctattcttcgaggttgtttaatcgcattaattttttttt

SEQ ID NO: 4293 - DNA, 345 bp, Zea mays
  Clone ID: LIB3279-006-P1-K1-E8
cccacgcgtacgcccacgcgtccggcgccacctacaccgagcagccaagcggggaagcgaagacccatttcccctagcgcaagagtaccatggcggcggcggcagtttatggcggcctcaaggggaagcttggcgtctaggatgcccccgagctgcagctgaatcgcatccgcatcaccctctcatccaagaacgtcaagaacctggagaaagtttgtgcggatttggtaaagggagccaaggataagcatctgagggttaaagggcctgtcaggatccctactaaagttctccacatcaccacccgcaaattcccttgcggggaagggacaaacacattggacc

SEQ ID NO: 4294 - DNA, 392 bp, Zea mays
  Clone ID: LIB3279-006-P1-K1-E9
cgcgtgctttttagctaccgaacggcggcgatgcgtcttttctccggcggggtgcgattcttcgtccgcgcttgcctccgccgtcctgggctccgtgtccgaccgcctcggattctcgcgcatagtttgcggtcgagcgagcccttcgaacatgccggctctcgcttgttctgccgctaccggcgcccagaaaccgtggctcttcgtcggtctggggaaccccgggcggatgtacaaaggcactcggcataacgttgggtttgagatgattgatgctattgcggaagctgagggcatatcattcagcagtaagcaatttaaggcagttgtcggaaaaggcctcattggtgatgtccctgtaatgcttgccaagccacacacttttatgaatg

SEQ ID NO: 4295 - DNA, 433 bp, Zea mays
  Clone ID: LIB3279-006-P1-K1-F1
ccggaacggcagggccgacccacgcgtccgcccacgcgtccgccaggctcaaatagaggaccttggggcagtcaagctccatctgcgtatggaactggagggtatggtggcagtgctgggtatagtgcttggaacaactcttctggtggcggcaatgctctgaatagtcaagcccctggtggacctgcaagctatggaagccagggctatgggtatggtggatatggaggggatccatcatacgctagtcacggaggatatggggcttatggagcacgtattgatagtgctggcaatcctgctactggtggatcatctggatacaatgcaagctatggaagtggtggtgccaactctggctattcaagtgcttggagtgatccttcgcaaggtggtggatttggcggttcggtcaatggaggtgctgaaggac

SEQ ID NO: 4296 - DNA, 349 bp, Zea mays
  Clone ID: LIB3279-006-P1-K1-F10
cgcacatgttgttaactttgaaaaccttaacaccaataacgttgtgggcggggatgttgagggggacatcactaaggtggtctaccacttccagaataaccttggaaatattgttgatggaaatacccagattcagatcatacactgtgagctgaccaaacaacttaaacctgaccacatatttaacattggagcagggaaacaggctctgaataatataaatctaattgcttacttattcaatatacaagataatccacttccttattagacaaaggagcggggcatagttcttgaaattaatcttaatgatctggaacccaatttagcttgagtaagcacagaatgg

SEQ ID NO: 4297 - DNA, 276 bp, Zea mays
  Clone ID: LIB3279-006-P1-K1-F11
cccacgcgtccgtactgctcctggcatactacctcgttctaacggggtgcgggctcctatagttatggcacacagtcatgcactacaacaactactacgtcaccgccgggccgggccaccgccgccacgtagtcgtcaccgtgcacgacaagccaccacgccggagcggcatggaggaggcggccatccgccggatccccacgttccggtaccgccacggcagtacgcgcctcgtgctggcggctgaagccaaacaagcctctttcgccgtgtgcc

SEQ ID NO: 4298 - DNA, 361 bp, Zea mays
  unsure (1)..(361): unsure at all n locations; Clone ID: LIB3279-006-P1-K1-F12
ggaggagtagagatggagtcggaccagggcaagcttttcatcggcggcatcgcctgggaaacgacggaggagaagctgagcgagcacttctccgcctacggcgaggtaacgcaggccgccgtcatgcgcgacaagatcaccggccgcccccgcggcttcgggttcgtcgtcttcgcggatcccgccgccgtcgacagagcgctgcaggacccccacaccctcgacggccgcacggtcgatgtgaagcgggcactctcgcgggaggagcagcaggcctccaaggccgcgaaccctagcggtggaaggaactcctgtggcggaggaagcggccgtggcngcagcaatgcaagtggtgctcgga

SEQ ID NO: 4299 - DNA, 429 bp, Zea mays
  unsure (1)..(429): unsure at all n locations; Clone ID: LIB3279-006-P1-K1-F2
cgnntccggggattatgagggtgcttttnntagttccagtgagtgggcccgtggtgcctagtttttgtggaggatgnnataatggaagtccttgcatncgcanatgccaatatgaaacaaacgagagttactaaaagaaagatgtttggtgatgagagaagctcttatcctgctaaaccggctggcgtcacacgcaaactattcgaaaccaaccttggaagtgctgacgagaagcaagttatgcgcgacctggacgatcgatgttgcgaaccggctgccccatacgcggatggcaaatgatctcgcggagctggcccagaaattcaggtcgcgagtgtatgctttcatagaggagaaacccttgacaagcgacggttccaatctgggcgcttctaacaagagatgagatacccaggactggcgcaacct

SEQ ID NO: 4300 - DNA, 290 bp, Zea mays
  Clone ID: LIB3279-006-P1-K1-F3
cggacgcgtgggtagcagttttgtaacttgagagctctagagtggttactaagatgtaagatcaaaggaacataattaccgtgtgaagaagttcctttgcaaaaaaaaaaaaaaaaaaaaaaataaaaaaaaaaaaaaaaattataaaaaaacaaaaaaaaaaaacaaaaaaaaaaaaaataaaaaaaaaaaaaaaggaaaatatgatttaaaaaaaaaaaataaaagggcctccttttgggggggtctatttatgggtccccctttttcgaacgtaaaatttttcttat

SEQ ID NO: 4301 - DNA, 359 bp, Zea mays
  Clone ID: LIB3279-006-P1-K1-F5
ctggaccacacccgcctcaacatcaacacgtattgagctgttgaccttaaggggggggagggagagtcctttactgtagcgcactacaccctcttagaccttaatcaaactgcgaactatctggacattaatgggctaccgaacctgcgccgccatatcatatatacgggatatataggggatctttagaggaggtctgctaaaacaacatgaggaacgactagatcatacttctcaagctagtttaacgacaaaccattgcctgctgctacataaagcaaagggcagggaagtttatcttctatatacaagaaactgattgagactagatgactgtacttcatgagtattgggctaaa

SEQ ID NO: 4302 - DNA, 393 bp, Zea mays
  Clone ID: LIB3279-006-P1-K1-F6
gtcagcggccacatcagcgagaaaatgttcatgaaaggctacggcggcaacggcggcgggtcctatctgaaggccaacatgctcgccgcggaggcagtgagcaacatccggacgggggctgccttctgctccgaggagaaggtgataaagctctacgcggacgagctcagggagccttctaagaggtccttccggcgaggccagggcgccggcctcttttacggagtctcccaggtcttcctcttctcatcctacgcactggcgttatggtatggttcagtgctgatgagcaaggaattggccagcttcaagtccgtgatgaagtccttcatggtgctcatagtgacggcgctggccatgggggagacactggcaatggcacctgatatcatc

SEQ ID NO: 4303 - DNA, 359 bp, Zea mays
  Clone ID: LIB3279-006-P1-K1-F7
atccgttcatcctggtggttttgtgaggtcgaaagcggcgagcgaattaggggatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgatgccgtcgaccccgacgacgccggtgacgccgtcgtcgtcgtcgtcgtcgacgacgccgcgcggggcccgcaacgtgtggcgcagcgtctttcacccggggagcaacctgggcaccaagggcatgggcgccaacctctttgaccgggcgcagcccaacttcccc

SEQ ID NO: 4304 - DNA, 352 bp, Zea mays
  Clone ID: LIB3279-006-P1-K1-F8
acgccgacaacaccacgtatgataccgtcaccatcggtgagcactgagacggggacctgatacagcctggggtccaagatgatagctgaccgcttctctgtcactcttggtttcgtggcatttgtgtcaatcctagctttctgaagaattgggcggcattcgtcaggcagttagaattatggcttagagaaacttagttgcttttccgatggccgcttgtttcctagagagacaacccgcccaggaaaaaatactgtatgtccatcccgggtggtcttgttcggctacaacatttgggttttcaggtgcaaaaaacaaaaacaccaacctttttcaccgggcggagcccaac

SEQ ID NO: 4305 - DNA, 371 bp, Zea mays
  Clone ID: LIB3279-006-P1-K1-F9
ggcttccaagaaggccaagtagagggcgaagttcttctccacatggctttgcgttagtaagtctgaagatcgaataacaggaccatatctgaagatcgaataacggatcatataaatgagttactcggaaaatgttctgaaatccttacgaacagaacgttgccttcatgtttacactgtactcatgagtcacagtgatatggagatggcatagcctactattggaagtatatgcattctgtgtaatctatgcatcggattgcagctggaacttccgtggaaattgacagtgatgtgtctacataggaactgcgatttggttcaatgaccacgtaaagggaatgtactggcgggatccttttatttatagc

SEQ ID NO: 4306 - DNA, 319 bp, Zea mays
  Clone ID: LIB3279-006-P1-K1-G1
gcgtccgccgaagaaagctactcataccactacatcccccagttggcaaggaacattggcgacgtcaactaggcctggcctcaccccttcatcaacctcaagggaatccttgcgggcaacgcggtcaccgacaactactacgacaacatcggcacggtcacctactggtggacgcacgccatgatctccgaccgcacctacaaggccattctcaggtggtgcatcttcagcagcagcagcatctctcgcccctgcaaccgcgctatgagctacgccatgaaccacgagtgcggggacatcgaccatttcatcatttaca

SEQ ID NO: 4307 - DNA, 354 bp, Zea mays
  Clone ID: LIB3279-006-P1-K1-G10
cttccccactcgcctccgctcaccttgcctcgatcgttccaggagtaatagggcactaaaatggcgagggcggcggcgaggagagcgctcctggcccacctccgcgtgccggtggtccaccctgcagcggcggcagcgaccatccccgcggcagggcggctcctgtcgtcgacgacggagagaaagggctcgttcctcgacaagggcgaggtcgctgaccgggtcgtctccgtcgtcaagaacttccagaagggcgaaccctcaaaggggacacctagtgctcattttcagaaggaccttggacttgatagcttggacactggggagatcgggatggcgtttgagggaaaattt

SEQ ID NO: 4308 - DNA, 348 bp, Zea mays
  unsure (1)..(348): unsure at all n locations; Clone ID: LIB3279-006-P1-K1-G5
nacaggcattactatactanacattaatattatttccacctaatgtaacaatccggtagggtaataccaggtgggcattcttccttcaattctcttacttttttctatattaaaatataactcatttataactttacccctgtccccactgacatcactctcataaagggcttaatgatgtggaatgatgctctatacttctcttcttcataccatttacttgctcttggcagatggccatcattaaactaatcctctctgggtggttttgcttttttctgtttttgtcaagaccagctttaattatcctctatgtagattacccctttaccctttaatcaaaccttt

SEQ ID NO: 4309 - DNA, 298 bp, Zea mays
  unsure (1)..(298): unsure at all n locations; Clone ID: LIB3279-006-P1-K1-G8
ctggggggttcagatcggatcggaagcttccataagtttccatctggcttgggcgctcgccggtatggcgatccacaaggggtctttntactccgtcgcggcacttttcacgctcgcctctgtcgccgccgtcgcacgggaggtcttcttccatgagaagttctaagatggctgggaaagtctgtgggtcaagtccgagtggaagaaggatgagaacatggctggtgaatggaaccacacttttggaaaatggaatggagatgcctaggacaaacgtattcaaacctcccaggattac

SEQ ID NO: 4310 - DNA, 402 bp, Zea mays
  Clone ID: LIB3279-006-P1-K1-H1
agcggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagaaaaagctaaggctgagtacaccaagaagatcgacgcttacaacaacaagcagtctggagaccccacggcgtctggtgat

SEQ ID NO: 4311 - DNA, 354 bp, Zea mays
  Clone ID: LIB3279-006-P1-K1-H10
ggagattgtggactcggttatcctacgtgactagtctgaagcaacgatcggtgttgatggttggagtttgtacactgaaatgaaccagaacgtcgtctccttgtttcaggcatctaaggaaagttagactgcaatgctactttcgcttccgcctcaatcagatggacaaacgagtagtttcatctctgccctctagaacctcctcgaggaacaacatatcctcctcttgcctcttttcttttttgaagttattctcttttttcctgggaagaaggtgctgctgctgggagaatactatgtggctacgaattgtcgctttgtgagtacaactgtcgagcacagcaatttttttag

SEQ ID NO: 4312 - DNA, 277 bp, Zea mays
  Clone ID: LIB3279-006-P1-K1-H11
cgctcggattcctgctcgctttctcctcccacaattccatcgcccgccgcgcctattccattcctttttcccttgctcgcccacccgcccaagaggactctccttcgcgcttctaccccagatcgtacttcgagcttcatagccagccgtacccgagagaggatgagaggatcctacctgcctggtaccctcgctcgggagccggccagaatcacgcccagccaccgtacccctccctggacatgtgcgtggacgggcttgactaccacccaacaag

SEQ ID NO: 4313 - DNA, 406 bp, Zea mays
  Clone ID: LIB3279-006-P1-K1-H12
ctcccgtctgcccctccctctctctcgtggagacgactgggccgggggccgccgtcgttgctgccctacgcggctacacccacgtcttcttcgggcccttagccgcgacgagcaccaccagggagtagaagaggttaaccttctggttggaaacgatgtacttcgaaggctatggcttccgtggaagtactttcgagcagacatatcgctgctatcctgcgtctttcatcgacaagccacaacttgaggccggtgacaaaattataatgccaccatcagctcttgatcgtcttgcatctctgcatattgaataccctatgctatttgaagtccacaatgcaacaacagaacggactttgcattgtggtgttcttgagttcattgcagaagaaggcatgatctacat

SEQ ID NO: 4314 - DNA, 307 bp, Zea mays
  Clone ID: LIB3279-006-P1-K1-H2
cccacgcgtccgctctcaggagacccaagtagagaatcagaagtgctgcgggcctgaatctacagtccagtatgaaacgcttgcactgattagtgaagatatgaaaatcctagaagaaacgaacttgccagacagacagacagatactgctctagcggagcaaccggataaaatgattcattgcaatgatgctggagattctcagaaggggaggcaactagaaaatgaaagcagtgctcgttcagttcctgacacccttagtactcggaagcacctgaagcccgagtctaagaagagagtagcattt

SEQ ID NO: 4315 - DNA, 378 bp, Zea mays
  Clone ID: LIB3279-006-P1-K1-H3
cccacgcgtccgaagactgcaagctcaacaagccaattcagaatctgcctagagaggaatgtctgatgtcttttggagaaccctacatcatgagggtgtttctggattctacaagggaattctaccaaatctccttaaagtggtgcctgctgcaagtattacctatctagtttacgaggcgatgaagaaaaatttgtctcttgattaaattgtggagttgttggtgggaaaaacagccatcattattggcatggctgactgtatagataatgacgacacatgaattttactggttgaatagtttctttttgaagataaaaatggggcctttcaatataaaactagaaacaaccgtggcattttccttctaatttttga

SEQ ID NO: 4316 - DNA, 381 bp, Zea mays
  Clone ID: LIB3279-006-P1-K1-H4
acccaaggactaaagacccttctcttcggtgacaagccggtcaccgtctttggcatcaggaaccctgaggaaatcccgtggggtgaggctgccgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgctagctgcaccacaaactgccttgctccccttgctaaggtcattcatgacaacttctgcattgttgagggtttgatgacaactggtcatgccatcactgccacacagaaaact

SEQ ID NO: 4317 - DNA, 362 bp, Zea mays
  Clone ID: LIB3279-006-P1-K1-H5
cccacgcgtccgctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccggctcctgggatggaga

SEQ ID NO: 4318 - DNA, 322 bp, Zea mays
  Clone ID: LIB3279-006-P1-K1-H6
gcctagaacatggcataggtaaaaataactacacgcacgtaactaaagaacttcattaggttttaacagacacgactcaagacaagaaacaaacttgctatagctgccacggttgaaaacatgactacacgggacaaatcactgtggcagatgttaaaacttacaggcgcagggttccatatatttaagcaggctccaactgaccgcctactggagagatcattgcgcgattatgctcgtggctttagcacatggctaaacaccactaccttatggctcggggccattggccatgggtgctgtagcattttctagcttagag

SEQ ID NO: 4319 - DNA, 414 bp, Zea mays
  Clone ID: LIB3279-006-P1-K1-H7
cccactcttccggcaacataaagacatgcctttggttgattaaaaagagcagattcacctttctttttttaaaaaaaaaaaacacaatacaacaactaacacatacatactctttacttacttataccaatgctttgttgaaaaacaaacaataacaagacccccccctttaaaaattccaatttttcttccccctttcttcaaagtaataattcttttttaaccccccctaaattcaattcactcccccttcttaaacaactcctgacctgaaaaacccccttccttccccaatttataccccttccaaaaaattccctttttaccccatgcctataattacccaaaaacccccccccttttccccttcttccaacattttcccccccctctatttcctatttttcccccccc

SEQ ID NO: 4320 - DNA, 66 bp, Zea mays
  Clone ID: LIB3279-006-P1-K1-H9
gtcttatcagcatctgggactgggagtcgacgccacgattctcatctgcggggggagtttctattt

SEQ ID NO: 4321 - DNA, 343 bp, Zea mays
  Clone ID: LIB3279-007-P1-K1-A1
gggattggttctttatcagctagggaagctgaaggtagagcaaacattacaactggtgacaaggaagcccataaacttttgcagcctgttgacaacaccctcaagacaatggcactagaatttgctgagtatcaggtctgtgtggatgtattcctcaccacacaatcctatgttgatattgcttctatatccgttgtgcctcaaactacaggtggccgggtctactactactatccgttttctgctctttcagatccagccaagctcttcaatgatctcagatggaatatcagtagaccccagggttttgaggctgttatgcgtgtaaggtgcagtcagggtc

SEQ ID NO: 4322 - DNA, 429 bp, Zea mays
  unsure (1)..(429): unsure at all n locations; Clone ID: LIB3279-007-P1-K1-A10
cggacgcgtgggctgccctagcaccagccatggcgaagccgcagcttcttctctgtttcctactcgccgcctccgcgccgctaatcgtcgccacggccaagaaatccggggacgtgtcggagctccagatcggcgtcaagtacaagccggaatcatgcagcattcaagctcacaaaggtgacaaggttaaagttcactaccgtggaaaacttactgatggaacggtttttgattcaagctatgaaagaggtgacccgattgaatttgaattgggcactggacaagtgatcaaaggatgggatcagggtctcctgggaatgtgcgntggtgaaaagcggaagttgaagatcccatcaaagcttggctatgggcctcaaggctcgccacctactattcctggtggagcaaccctcatatttgacacggagc

SEQ ID NO: 4323 - DNA, 432 bp, Zea mays
  Clone ID: LIB3279-007-P1-K1-A11
cattgatggaaaaaacattgttaagggagatgtgcttataggtcttccttccagtggtgttcattctaacgggttctctcttgttagaagagtactgcagaaaagtggactttctttggatgatcagctcccaagaaatgatggcataacaactacggttggtgaagctctaatggcaccaaccttcatctatgttaagcaggtgcttgagattattagcaaaggtggtgtgaaaggactagcccacatcactggtggtggctttactggcaatatcccaagagtattcccctctggatgcggggcaaaaaattttactgggtcatgggaaatacctccaatcttcagttggcttcaacatgcaagaacaaatgatcttcaaacttcgcctttgattttcagtagcaactgttctgagaaacatcatgcact

SEQ ID NO: 4324 - DNA, 421 bp, Zea mays
  Clone ID: LIB3279-007-P1-K1-A12
atcggcgtcaagtacaagccggaatcatgcagcattcaagctcacaaaggtgacaaggttaaagttcactaccgtggaaaacttactgatggaacggtttttgattcaagctatgaaagaggtgacccgattgaatttgaattgggcactggacaagtgatcaaaggatgggatcagggtctcctgggaatgtgcgttggtgaaaagcggaagttgaagatcccatcaaagcttggctatgggcctcaaggctcgccacctactattcctggtggagcaaccctcatatttgacacggagcttgtcgctgtcaatggagaaccaaccaaccaatctgacgagctttagattcatcaaacaaatgaatccattcacctttttactcggaactcagcagatgtaatactttccaagaaatgag

SEQ ID NO: 4325 - DNA, 425 bp, Zea mays
  Clone ID: LIB3279-007-P1-K1-A5
aagctagctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccgcacatggacttttggggataggcttgccaccgtgttttgctagatgagtcgtggaataagcttttacttcctcgctgctgtgggtgaagtgactggaattcggaaatttggaactaacaaaaccccccgtggatttgtatg

SEQ ID NO: 4326 - DNA, 461 bp, Zea mays
  unsure (1)..(461): unsure at all n locations; Clone ID: LIB3279-007-P1-K1-A6
tcgcaccactctacagtagtagcaagagggatagagcaaggccttcttttttctttnttgggggtttattttatttttggtttttatttttttttttgttttttaattgtttttctctttattttttattttattataattttaattgagtactatataatttattaatattttttttttttaaaaattattttgtttttaaatttgttttaatttattttttttatattatatttatttaatttgttatattaattaattattattttttttattataatttttttattaatttttttatattttatattttattttataaaatatttattattttttttaatttatataatatttttattaaatttattattttatatttaaattaattattttatataatatttaattattatatatttatattattttttaataaaattttaatttaatttttattt

SEQ ID NO: 4327 - DNA, 404 bp, Zea mays
  Clone ID: LIB3279-007-P1-K1-A7
tccgtccgattcggtcgcccacgcgtcgtaaattttttatttcaacagtaatggtggaagattcaactgggggggatccataacttttgcatctgttgacaacacccttaaaaatggcacttgaatttgctgatattagtctgtgtggatgtattcctaccacacaatcttgttgatattgtttattccgtgtgcctaaactacaggtgccggtctactactactatccttttctgctctttagatccaccagctcttcaatgatctagatggaatatcagtagaccccagggttttgaggctgttatgcgtgtaagtgcagtcaggtctcaagttaagactattatggcaatttctgaagcgtgttccaccgattgatcttcagcgattgatttgacaaactg

SEQ ID NO: 4328 - DNA, 441 bp, Zea mays
  Clone ID: LIB3279-007-P1-K1-A8
gtacattcttctttgtggtgtccctccattctgggcagaaacggaacagggtgttgctcaggcaatcattcgatctgtcattgatttcaaaagagatccatggccaagggtgtctgataacgccaaagaccttgtcagaggaatgctgaatccggacccaaaacgacgattgacagctcaccaagtgcttggtcacccatggttgcagaacattaagaaggctccaaatgtcaatttgggtgaaactgttaaggccagactccaacaattctctgtgatgaacaagttcaagaagcatgcacttagggttatagctgagcatctttcggtagaagaggctgctgacataaaggatatgtttgagaagatggatcttaacaaggatcaaatgcttagtttcgaggagctgaagcttggtctgcataagtttggtcaccaaat

SEQ ID NO: 4329 - DNA, 378 bp, Zea mays
  Clone ID: LIB3279-007-P1-K1-A9
catgcctgatgttcctcgtcatcacggtcgtgtggagccggagcgtggcgctggcggcgctcttcacggcggggttcgggtccgtggagctgacgtacctgtcggcgtgcctcgccaaggtgccgcacggcgggtggctgccgctgctgctgtcgctgggcacgctgctggccatgtcgacgtggcactacggcacgaagaggaagcgggagcacgaggcgcagagcaaggtgcgcctggaccggttcctgggcctgagcgccggcatgggcctggtgcgcgtcccgggggtgggcttcgtctacgccggcagcgccgccgctggaggcggcgtcccccccgtgttcgcgcacttcgtcaccaacttccccggcgttc

SEQ ID NO: 4330 - DNA, 444 bp, Zea mays
  Clone ID: LIB3279-007-P1-K1-B1
cgctgcctccgcgtttcgctttccccccgtcttcccaagcctttgcttcgctcttcgctgcggattccctctgctcatggccgggagagggaaggcgatcggctcaggggccgccaagaaggccatgtccaggagctccaaggccgggctccagttccccgtgggaaggatcgccaggttcctcaaggccggcaagtacgccgagagggtcggcgccggcgcccccgtctacctcgctgccgtgctcgagtatcttgctgctggggttctcgagcttgccgggaacgcggctcgtgacaacaagaagacccgcatcgtcccgcgccacatccagctcgccgtccgcaacgacgaggagctctcccgcttgctgggcacggtgaccatcgccagcggcggtgtcatgcccaacatccataacctgctgctgcccaagaagtctgg

SEQ ID NO: 4331 - DNA, 422 bp, Zea mays
  Clone ID: LIB3279-007-P1-K1-B11
gtgtaacttagcatctacaatccctgaaatgaagatgtttcgagaaatttcagttcctggatttgatcgcacaagttttcaagttaagcaggtttttgttcctagcaaggatggaaccaaaattcccatgttcataatgtcgaagaaagatatcgatcttaatggatcgcatccaactttgctatatggttatggaggattcaacataagcataacaccttcatttagtgttggtcgcgttgtgctatgcaagaacatgggctttgttgtctgtgtagcaaacattcggggtggtggagagtacggggaggagtggcacaaagctggagcacttgcaatgaaacaaaattgttttgatgactttgcttgctgtgctgaattcctcatttctaatggttacaccagttccagacgtttatgta

SEQ ID NO: 4332 - DNA, 430 bp, Zea mays
  Clone ID: LIB3279-007-P1-K1-B12
cttgtgtacgagtatgtggacaatggtaatcttgaccagtggcttcatggtgatgttggagaagtaagcccactaacatgggacgtcaggatgaacattatgcttggaaccgccaaagggttggcttatcttcacgaggggctggaaccgaaggttgttcaccgtgacatcaaagctagcaacattcttcttgaccagcagtggaacgctagagtatcagattttgggcttgcaaagctattgtggtcagagaaaagctatgttacaacccgtgttatgggaacctttggttacgtggcgcctgaatatgccagcaccggaatgctgaacgagaggagtgatgtatatagctttggcgtactcataatggagatcatcactggtagatctcctgtagactacacaagagcagctggagaggtcaacttgg

SEQ ID NO: 4333 - DNA, 291 bp, Zea mays
  Clone ID: LIB3279-007-P1-K1-B2
aaacaaactgtccggaagccaaataccagcaatagagagcattgcgcttcgactgagggagacatacataacacatgggaggtagtagatatgacaccaatggccacagaccaaggtgtgcaacggatggttcgaaggcaacttaattaccaccaacgcgactgtctgcacatctgtcgccttaagcttactggccgagatcctatccaatcgacctcgccggcgtgacaagcttgtgactgggctggactttcctaggcacactatctttaaccgtgcctacaagaaaac

SEQ ID NO: 4334 - DNA, 410 bp, Zea mays
  Clone ID: LIB3279-007-P1-K1-B3
gttcagatattcaaattctttgggggactcagcacaaacattcaaatgttcagatattcaaattcttcgaaaatgttcagactttagacaaaaagtaactctaatatagcagcttcacacacgcacaggggacaactccgaaactgagtgggcagaagacttaacacggtcgaaaagctaaagcctatgggcgagcagcaaccggtgctggagatggagctgtagcagcagcaccaggaccagggcgggggcctccttgtccaccagcaggcctatcctccctgcgcctgaagcgctccggcggcttgcggtccctgcgcttctcacgggatcggacgcggacgatgtgagcgtggatcgcgcacgagacgcaatggtgcaccttggcgtacagctttgggaggacgtac

SEQ ID NO: 4335 - DNA, 439 bp, Zea mays
  Clone ID: LIB3279-007-P1-K1-B4
caacccgtcagcccctctcgtttttcatccgccttcgcctccaaccgcgtgcgctccgcgcctcctccaggaaagcgagagcttctgcataagaacaacaaatcaaaagcgtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccaaagctaggccaggtcattcagctccaaggtgatcagcgcaagaatgttgc

SEQ ID NO: 4336 - DNA, 431 bp, Zea mays
  unsure (1)..(431): unsure at all n locations; Clone ID: LIB3279-007-P1-K1-B6
cggacgcgtgggcgaacaagcacttgaatcaccagaattcatgatctggactgttttgggttagaccaataaccgcaggaaaatgttagctcatcttacttaggggtaatttggtaactctatttttccaagacatttttatttttctaagagaaaattaactaatttttcttagtaaaatagaaatcccttagaaaaatgaggttgccaaaccagctcttaaaaatttgcctacggactctgttcctctgttatttcctgcttgctatcggtgtgatcggtataccttaaactgattgtaagttatgctttagagtgattgtttatgaacanaaaaaaaataataaataatataatttaaatataatttataaattataattttataatttatattatttttttaattattatttatattttatttaatt

SEQ ID NO: 4337 - DNA, 445 bp, Zea mays
  Clone ID: LIB3279-007-P1-K1-B7
cttacaacaaaagataagcccacgaatcagtagatcgaggtcccgcccagtccagcagaagcgcacacggagatgtcccagctgagccctgctggccacatggctgcgacgctcctcctcatcctcctggcctccgcagcagcagcagcggtgtcagctgaccaacaggtctctgcctgccagaatgacatagacgcactgtggcgcagctgcaagcagttcgtccagaaggaggggcccaagatgcctccgtccgaggactgctgcaaaaccatcaaggccttagacgcgcacgcgtcctgcatctgcgactacgtcggctccccggacgccaggaataagctagacctggacaaggtgttcttcgttaccaaacagtgcggcgtcaccgtccccaagggcttgggtgagtataatagctttagctgggcatggccaatgatca

SEQ ID NO: 4338 - DNA, 404 bp, Zea mays
  Clone ID: LIB3279-007-P1-K1-B8
ggagtatgttagggagaccttctcctggcagtactactactggtatctcaccaacgggggcattgagcacctacgcaactacctgaacctcccgtctgagatcgtgcctgccacgctcaagaagtctgccaagccacctggccgcccatttggctctggccctcctggtgaccgcccaaggggcccaggccgttttgacggcgacaggccaaggtttggtgacagggatgggtaccgtggtggtcctcgtggtgctcctggtgactttgggggcgataagagtggagctcctgctgagttccagccatcattcatgaggcctggcttttggcgtggtggcgggagcgtgttctgcgcagggccaacctctttttccatggagtgaagttgcccttggtttggac

SEQ ID NO: 4339 - DNA, 443 bp, Zea mays
  Clone ID: LIB3279-007-P1-K1-B9
gttctataacatgatttggatgtgcttcctcaacatgatatgaaagagattgctgaatgtatatatgtggaagccatacctattcttctgcaaaatcatacaagcaacttgttggtaactttctaactcatttagtttcagttggatgtgggcatccaaatggcaaccaaagcacatatgttttttgattgttgcttaatgatcgactcaaaaccaaaatgttcttaggagaaaattatgcaactagagtcatacacatgtgaaaatattgtattctccaaatagaggaaacaatggtgcacctatttgtaaaatgtaattttgctaaagcatgttgggattcaattaggctctttcctccatgaacaagttgcccacaaagagcaatcaatagacttaggatacaactagaagtgtcatgtgacatgaagggtgtggagtat

SEQ ID NO: 4340 - DNA, 286 bp, Zea mays
  Clone ID: LIB3279-007-P1-K1-C1
cccacgcgtccgcccacgcgtccgctcatatccataaaaacaacggcaaagcaagtccagcaatctcgaaagcgaatatgtctttgagaaagtcaatagtgccaaagggcctctagacaagttggttagttggtttcagtagcactctttaggtcctggattcgactatctgtggaagcgaatttcatgttgtggttaaaaaattttctccgtatgtcccataccctgccctcggattaaagccgcagcgaacatggtgaatgaattggatgtctttattcagaac

SEQ ID NO: 4341 - DNA, 434 bp, Zea mays
  Clone ID: LIB3279-007-P1-K1-C10
gctggtttcaagaaggatgacaagcagctggatgctgatatccatcgcaagtacatggatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaaggttggtcccatcgaagtagtgctatcttatgcggcgatcagtatttgtgctatggcatttatc

SEQ ID NO: 4342 - DNA, 438 bp, Zea mays
  unsure (1)..(438): unsure at all n locations; Clone ID: LIB3279-007-P1-K1-C11
gaaagctggtccacaacaagtcctggattcactgtttaaaattcctgaaacacgcacgtatgagccaagttctatggactggaaaaaggtagtaaagaaactgcaaacaatcaattataccgctgcatcaaacaatcacgaaaggcctaaggatgggggtggctatcgtgagctccgtggtgttgctgcaaggcattacgataaaatgaaagaatactatcagaaagctgcctttgcatattcgaagggtgacaggtcatatgcttcttaccttgctgaggaggggaaacattatcgagaactgggtcgcatagaagacgagaaggccagcaggaatatatttgaagccagaaataagcatataacgaacacagtaaccatcgacttgcatgccaacatgtncaacatgctatgaaccttctcaaaattcacatgatg

SEQ ID NO: 4343 - DNA, 392 bp, Zea mays
  Clone ID: LIB3279-007-P1-K1-C12
ggcgcgtgggcatccattctacacgcgccgcgactcctgtacacgccccgcgggccgcctccaccaccacagcgcgcaggaatccctcgttctcgcagagggtttcaggcgtcgtatgtaagagaagatggcgctctcagtatccatggagggcatcgaggcgcggcacgggatctcggggtggaccttccgctgtcgatctggactcatcaccctcccggccggcgaggacttcgcatcgcagtgatgacgaggaggtacttcgtggtgaggatcttccagacttgaatgggttgtccacattattgtcgggacaatctgccggtggtcttcagaaagttgagaggctggaatgtctacgcagatctacagcaatggagcgataaagaaaa

SEQ ID NO: 4344 - DNA, 440 bp, Zea mays
  Clone ID: LIB3279-007-P1-K1-C2
cccacgcgtccgcccacgcgtccggttagtaccatgccaactgaatgtaagatagaagtaagctatggtgccagattgaaaggcaccccctcctcagtcctccgaggatttgagatagctatcttcaaatgtccctaaattggaggataatcagacttgtaaggtctatcaccatcatgatagcaaccctgtttatgggaagaggtcatcattcgatatctttaagcgaagcagccaggtgtgtgtacaagtgtagaggagatcctcattacgctatgaatccttaaggcttaacaataaatattacataaaataagaggactaatttttgtagagggcctctttgactagattgcttattattcttaatgcattgtccaaatgaattttagattcaattgttgtgtatcccttgtcgaaacaaccaaaaataacatatg

SEQ ID NO: 4345 - DNA, 398 bp, Zea mays
  Clone ID: LIB3279-007-P1-K1-C3
cggacgcgtgggtcactcagtcactagcaagtgcctcgtcacatggcagcggcagcgctagcggcgtggtggtggtctctgtcgctcctggctaccatcgtcggcggaggcagcgcctcaccgtcaccggtgcccggctgctacacgcgcatcttcagcttcggcgactcgctgaccgacacgggcaactacgtccacctgacggcgagcagccacagcccctacggcgcgccgccgtacgggaggacgttcttcggcaaacctaccggccgcgccagcgacggacgcctcgtcatcgacttcatcgcggaagagttcgggctggcgaaggtgacggcgatccaggcgggcacggcgccaggggactttcagaacggcgccaacttcgccatcatctc

SEQ ID NO: 4346 - DNA, 394 bp, Zea mays
  Clone ID: LIB3279-007-P1-K1-C4
caacgatgtgctgttggaaaatggcaacgattttgatttgaacttacctctagatgagtgtggcgcggttgtagagaaccaccgacgaaaagagatgacaaaagatatgaggaaacaagtgtaccaagcgttgttggctagaagcaataacgggagactccacaagaaagatacccaaattgttgccaaccaatttgatctccaccttcggtcagtgcagcgcgtatggaacagaggtaaaatacaacttgcaaactcggtgccggttgtggttgctagtctaaaaaagggaagagttggtcgtaaagcaattcctattgatttggaagttttgcgtaacattcctttaaaggataggatgaccttagaggatgtttgtgccaaggctaacatg

SEQ ID NO: 4347 - DNA, 437 bp, Zea mays
  Clone ID: LIB3279-007-P1-K1-C5
cccacgcgtccgttactcttatcttgagagagctgactgacccactgaaaaaaatgtgagaaggatgaagctgttcaaaaggtggtagagtttatggatacatactctttaagccaggaagacttcgatacgattgttgaagtatccaaatttaagggtcatccaagtcctatggatgggattcaacctgctgttaaaagtgccttgacaaaggcatacaaacaaggaagtagttcccgtgttgttcgagcagcagatctaataaacattccaggcatgaaaaagcctttaaagaaacgagtggcggcgatcttggagccggtagaagagagcctacctgaagaaaatggactagcatcagctgaagatgatgaagatggttcttctgatgctgacaataatgatgagcttgtgcctgctgactctacgccgaagct

SEQ ID NO: 4348 - DNA, 282 bp, Zea mays
  Clone ID: LIB3279-007-P1-K1-C6
gcaaaggttgttgagtgtgcttgcgtcattgaattggcagaactgaagggccgagacaggcttggggacagggcagtttttgttcttgtggaagcagatgcttgagcggaacttgggacttctcttctcagagagttagagttagcgctgttgatgctacctctctggaaacaacaaagtttcccatgttggctatattctggctgacacgtaataaagtttcattccaaattgtgatcccctgaatgatttgtcaatgtagacatgattgctggtccttgt

SEQ ID NO: 4349 - DNA, 296 bp, Zea mays
  Clone ID: LIB3279-007-P1-K1-C8
gcttttggttggtagtggcttaccatcgtcagatggtgaaggaggaaggagggaacatggatctggatggtggcaggctgtgactgtgagccacagattacattacagtagtagagtaaactaagagagttcttgtggactgaaggtgtgtagtggtggatagggtagcttctccggggttcttttgtgtgtaattagcctgtgtcgccctgtggtgtcatgttacaacagcaagtggaaatctatgctggttcgtccgttgttggagaatcaggaaaaaaaatttgtcgtgcttc

SEQ ID NO: 4350 - DNA, 437 bp, Zea mays
  Clone ID: LIB3279-007-P1-K1-C9
gagtgatcaggacattgttgccctctctggtggccacaccttgggaaggtgccacaaagagcggtctggttttgagggggcctggactacgaaccctttggtctttgacaactcttacttcaaggaacttctgagtggcgacaaggagggccttcttcagctcccaagtgacaaagccctgctgagcgaccctgtcttccgccctcttgtggagaaatatgctgcagatgagaaggcattctttgatgactacaaagaggcccacctcaagctctccgaactggggtatgctgatgcttaaatggtccatatcctggagcgggacacaaactgctgcctgtatggactcgtgcgattcagggtgaaccatcagattgtctagtgtcttctttggaataaatttatctgttcttggtactttgtctatggttgaatcg

SEQ ID NO: 4351 - DNA, 329 bp, Zea mays
  Clone ID: LIB3279-007-P1-K1-D1
gagaaaatgagactggtgcgcccagctttgtgctccagttgtgagggaaccaaggaacgccttcaagtcgctctagtgcttttctctcaactttgcagtatagattctggttccagtgtagtgttgtggacttcatgatgaattgatttgtatttctataaattttataatattgctgtaacagcggaattcagaaatatgagttggtagactctttcaagttagctagcttcatatatgggagaagcactgtctcagctcatttttcttgctgtgctgtgtctgcttatgatcatatctacagtttcatctttcttttgctttaaaaa

SEQ ID NO: 4352 - DNA, 369 bp, Zea mays
  unsure (1)..(369): unsure at all n locations; Clone ID: LIB3279-007-P1-K1-D10
ggagaaagaagaaaggcatagcagcgggcagcggcatgggcaccagccccgtcatccctgcgacgatgctcttcgtcgctcttcttgtcgctgtctgcttcggcgccaccgccgccaggtccagccacgcccgccacaccgacgccgacgacgcgattcgtctccccagcagctttggcgctggtggtcgaccgtggaattgctgcgactccgctatcaaggacgcctccctgccggcgtggcgctgcaacgacgtggtggacaagtgctccgccgactgccaggactgcgaggcgtcgccggccggcgacggcttcgtctgcggtgactntatcttaagcctgaccgagcccccggtctgcacaccga

SEQ ID NO: 4353 - DNA, 198 bp, Zea mays
  Clone ID: LIB3279-007-P1-K1-D11
tgaggctgaagctgaggagtaggaaggaaagcatggctttgtttcctctgtttttagctcagttccacctttaggacctggggttttgctaaagatggaacttaagtggtgttactgtatgatggcaaggaccttttgctgccgaaggttatgttttgaagttcatgctaccttttaaagtacggattaccttgtgct

SEQ ID NO: 4354 - DNA, 433 bp, Zea mays
  Clone ID: LIB3279-007-P1-K1-D12
gtcgctgatgtgtggtcatgtggagtaacgctgtacgtgatgctggtcggtgcatatgggtttgaggacccagatgagcctaagaatttcaggaagacaattcagagaatattaggtgtgcagtactcaattcaagactatgtccacatatctccagagcgccaaaatcttgtctctaggattttcgacgctgacccagccaccaggatcaccatccctgagatagggaaccatccatggttcttgaagaacctgccagctgacctaatggatgacaacacaatgagcaagcagtacaaggagcctgagcaaccgatgtagagcatggatgaaatcatgcagatccttgccgaggcgaccattccagcagctggttcccgtggactcaatcagttcctgaacgacggccttgacctcgacgatgacatggatg

SEQ ID NO: 4355 - DNA, 289 bp, Zea mays
  Clone ID: LIB3279-007-P1-K1-D2
tcggcgggtggtcaggggtggacccaacccgaaccccggcttcaacaacaagtattaaaggcgggcggctaacccaggcaaaattccctggtccggccgagggattcaccttcaaaggagcgttggtcttcacatcgacttttttgggacacttaaaccgatctggaaggcgggctgttgtgtctattaaccgagagccaagcattgaggcggagcaaacacgtagccgcacgactgacacaagcgcaggggcaacatttcagagggctggagctccgcggtggagcct

SEQ ID NO: 4356 - DNA, 391 bp, Zea mays
  Clone ID: LIB3279-007-P1-K1-D3
gctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctc

SEQ ID NO: 4357 - DNA, 375 bp, Zea mays
  Clone ID: LIB3279-007-P1-K1-D4
cagagcttgagaatgctatagaagaaatggatggtaaaacggtgagaggacctggccgaggaccgtctttcaagatccaggtgtcagttgctcgacctacggcagacaacgacaagaagcgatctcgtgaagaagtgagaactagaagatcaaatgcatcaggagataggcgagattattctcatggaagatatggacacgattcacttgatcgtcaagtgaaagctccaagattatctaattatgtggccgatgctgctgacccctatgaatcagctgttaattcattaccttcagctgtcaaggaagtcttgcttcgaattctacgtctaagaattggtactcgatatgatattgatatccattgtgtaaaaa

SEQ ID NO: 4358 - DNA, 230 bp, Zea mays
  Clone ID: LIB3279-007-P1-K1-D5
tcgttacgctttcgctgacgcgtaggcaggcgcgcatggctttgtttcctctgtttttagggcagtttcatctttgggacctgcgattttgctaaagatggaacttaagtggtgttactgtatgatggcaaggaccttttgctgccgaaggttatgttttgaagttcatgctaccttttaaagtacggattaccttgtgctcaaataataatttattctgttagcctttt

SEQ ID NO: 4359 - DNA, 431 bp, Zea mays
  unsure (1)..(431): unsure at all n locations; Clone ID: LIB3279-007-P1-K1-D6
caccagcagtcccgcacgactagcggaataatatccaccggcgacgggaacgggaggcggcgcggccggagattcgaagcgatggcgttcacgatgcgggcagtgaaggtgcctccgaactcggcctcgctggaggaggcccggcaccgcgtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaaccccaaggtggttgatatgcttctgttcaacgcgacggaggagctgaacaacatagtcgaacatgcaaagcagcgccatcatgtgattgggcagtatgtgatcggccaagagggcctggtgcatgagcntgggtcgaaggatct

SEQ ID NO: 4360 - DNA, 441 bp, Zea mays
  Clone ID: LIB3279-007-P1-K1-D7
gcttcttcaactttgtgcagcctacagtgccaacattgtctaggagccaattgcattgggaaggcatttgcttgttgtcaaatgggtctggtcgaaagatgagtctcttggagttgtctgtctgtcaagattttctggtgtaatccttatttatttagtggcaggatgttggttgtgccgtgggacccttggatgccaaaacatgtagggttgatttggtgatcagagatcacgaggaatccatgggagatgaatccattgctattcaaattgaatagcaaggggattcctccccatggattcccttgtgattcctggtcaccaaaccagcccataaggaaaacaacattagctttgtggaggattcgtctgtttggtttggctgaggattttgtttcgaggctgaagtttctttttttggggcagtctaatggtgtactg

SEQ ID NO: 4361 - DNA, 442 bp, Zea mays
  Clone ID: LIB3279-007-P1-K1-D9
atgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaac

SEQ ID NO: 4362 - DNA, 445 bp, Zea mays
  Clone ID: LIB3279-007-P1-K1-E1
gctcctcgcgccgccgccgcgtctcctcctgtacaggtaaggagaggaagagggcgagggggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctccaaccattggtatttctgttgatcaccgccgcaagaacaaatcccttgagggactgcaggccaatgtccagaggcttaagacatacaaggccaagctggttatctttccaaggcgg

SEQ ID NO: 4363 - DNA, 411 bp, Zea mays
  Clone ID: LIB3279-007-P1-K1-E10
tggggatatgtttacgaaggagtctgggtataagatggaagaggtcaaattgcgagggacctatgttgctcctccacagccaccctctccagttccagaggaatctgaagaaggttcttcacctagggcttctgaatcagaaaacggagatggaccttctggaggattcaccagagcactaagagagcgcattgagcctcaagacaaatctacagaggctggagctttggtttccaagttgactgaagagaagaattccgcgattcaacagaatcatagacttagacaggaacttgacttggtgaggcaggagatcagcaagaggcgtggagggggcttctccttcatcgtcgtcataatcgttgctctgatcggcgccatcctcggctacctgatgaagtcgtaattctt

SEQ ID NO: 4364 - DNA, 437 bp, Zea mays
  Clone ID: LIB3279-007-P1-K1-E11
aaaaggcaactaccggctggtcctgaatgcaagcctctacaacgacatgtcgctcaaggacatggacaagaagggcgtgacatttgcctgtatgaacagcattggggagtcgccgagcagcctcgctacatttgctctgaagttcaaggacacggccaccagggaggaattcaaggatgcggtggagtctcacaagacaagcaaggcacaggaactgccgctgaagacgcccgagaactctccgaaggcagcagaagtctgaagccgcacccgagtcacgcttgctcgtgtcttttgtacgtgtccaggaaggaaggaactgagagagtttctgttgttgcggagtttttaagaatgtcgcgtcatgacatatgatgtcctgagttgtattttgcgtacgggttccctggtgctgtttttgggaacttaccattact

SEQ ID NO: 4365 - DNA, 434 bp, Zea mays
  Clone ID: LIB3279-007-P1-K1-E12
cggacgcgtgggagaaattacagaagccacaaaggaagaggttacaatcatccatggagatctaagtgccttccagaaggaaatggaaacagttcatctcgtagttcgtagtctggagacaaagcttggacgcctagcttatactcaagatcggacaacacgaggaatatatgatttgtgtgaattcactaaaagattggatcagagcccgaaagctgatactcgtcaggttacatcatcaacttctcgtcctgctattgaatcctcagagagaattgttagggttgcttctttacccctggctttggaaccggagtctcctagaattgaggcacctaaggttgtgcgctcatctacagtcatgtcagcatcgggtcttagtttgctagctggaactacaataccacctaaaagagatcaaccgggtgtgtaca

SEQ ID NO: 4366 - DNA, 280 bp, Zea mays
  unsure (1)..(280): unsure at all n locations; Clone ID: LIB3279-007-P1-K1-E2
cggaaacccgggggcgcgagcgccganncgcaagcngaganncnncgccgcccgagcaaaacagcaccggcggggggaccagagggaagcaggnacgaaggcgagagccacacaaccagagaccagagagccacgcgaagaagcccgccgggccacccggcgagggggagcaacaaagaagcaaagaacncgagcgcgagcggcgacccgacagcgaaaaggaaagaggccggaaagacaggagcacagcgcacagaagaaaagccggagagncaaaaag

SEQ ID NO: 4367 - DNA, 440 bp, Zea mays
  Clone ID: LIB3279-007-P1-K1-E3
cccacgcgtccgctcatttatgtcaaattatatacctaccagatatttcgaggcttaggctatattcacacagtacctggagtttgccacagggatgtgaaaccacaaaatcttttggttgatccactgactcaccaagtgaagatatgtgattttgggagtgccaaaatgttggtcaaaggtgaagcaaacatatcatatatatgttcacgttattaccgtgctccagagctcatatttggggcaactgagtacacaacatcaattgatatttggtcagctggatgtgttcttgctgagctgcttcttggccagcctctcttccctggtgaaagtgctgtggatcagcttgttgagataataaaggttcttggtaccccaacgcgcgaggaaatccgatgtatgaatccaaactacaccgagtttagatttcctcagat

SEQ ID NO: 4368 - DNA, 425 bp, Zea mays
  Clone ID: LIB3279-007-P1-K1-E4
gccgcaactccctgtcactacagtgttaggacttgaagaaggaaaggattgcataattggtggaactttatataagcacatgaagttgaagccttcaattcttgatgaatatgccaaagagaggtctgcaattccccttgtcaaaccacataatttcatgcatcctgatgatcatctcattctggaagatgaaagcggaagagttacacttgcaggagccatacctccagcagcattcgtgactggggttgtagtggctctccatgggaaggaaacaagtgctggcaattttcttgtggaagatgttcttgaggctggtcttccaccccaaactgcattgtctagcgcagaagaagacaagtatgtagtattcatatcagggctaagtgtaggaagtgacacattcaatcctctacagttccaac

SEQ ID NO: 4369 - DNA, 434 bp, Zea mays
  Clone ID: LIB3279-007-P1-K1-E5
gtacgcaagtacgtgaacacataccgcaggacattcactaccaagaacggcaagaagggcagcaaggcacctaagatccaacggcttgtgacacccttgaccctccagaggaagcgtgctagaatcgctgacaagaagaagaggataactaagaagaagtctgaggctgctgagtaccagaagcttcttgcccagaggctgaaggaacagagggaccgccggagcgagagcttggccaagaggaggtccaagctttctgccgccgtcaaggcttctgctgccacctctgcttaagaatattcagtgttttgggatctttgtaaggtctatctcgttacagcgaaagtgcctctctacttagatttatgagtaattgttgcttttttgtatgaacatggtaatggcttgtcggagtaccagaggtttactatgtt

SEQ ID NO: 4370 - DNA, 435 bp, Zea mays
  Clone ID: LIB3279-007-P1-K1-E6
cccacgcgtccggagcaaagctcagcctcacacagcctctcctctcgagctagagtgctgctagcttagaagaagcagcagcttaccgctgaagctgcagcaatggcgaaatcttacaccttactgttcgtcgcactggtcgttctggcccttctagtgagccccattgcttgctcccgcaagctcgccaagccgaacaagcccaagccgacccacaagccggcggccagggtcacgcccggcagcaaccacaccggtatccccgcagtgtccgccgcctacggctccggcggctggttgtctgccggcgcgacgtactacggcgccccaaacggcgacggcagtgacggcggtgcgtgcgggtaccagaccgccgtcgggcagcgccccttctcgtcgatgatcgccgccgggagcccgtctctgttcaaggga

SEQ ID NO: 4371 - DNA, 216 bp, Zea mays
  Clone ID: LIB3279-007-P1-K1-E7
gtcgatttgtgttgttgaagtggtaaacattttcatcctgggctgtatcgtcatcatgtatagataggctcgagtctctctctttttttttggctccacaattttttggagatataaaagcggcaggagttatgacatgcccacagtcggccctccttgtagaaatcctttggatgtaacctgtctctttcttatatacatactgaaagtcaaggc

SEQ ID NO: 4372 - DNA, 393 bp, Zea mays
  Clone ID: LIB3279-007-P1-K1-E8
ggaggacggctgccgctgacatggttcaagaacgagtacgtcaaccagatccccatgacgtccatggcgctgcgtcccgacgcagcgcttggctaccccggccggacgtacaagttctacggcggcccggccgtgctctacccgttcggccacggcctcagctacaccaacttcagctacgcgtccggcaccaccggcgccactgtcaccatccacatcggcgcctgggagcactgcaagatgctcacctacaagatgggtgcgccgtcgccgtcgccagcctgcccggccctcaacgtcgctagccacatgtgcagcgaggtggtgagcttcagcctcagggtggcgaacaccggcggtgtcggcggcgaccacgtggtgccagtgtacacc

SEQ ID NO: 4373 - DNA, 428 bp, Zea mays
  Clone ID: LIB3279-007-P1-K1-E9
tgacgaccagaagctgcgtgccttttatgaccgaaggatatcccaggaggtcagtggtgatgctctgggtgaggagttcaagggttatgtcttcaagatcatgggtggatgtgacaagcaaggcttcccaatgaagcaaggagttttgacttctggtcgtgttcgtcttctgctccataggggcactccctgcttccgtggttatggcaggcgtaatggtgagcgcaggaggaagtctgtccgtggttgcatcgtgagccaagacctatctgttatcaacttggtgattgtgaagaagggtgagaatgatctgcctggtctgactgacactgagaagccaaggatgaggggtcccaagagggcctccaagatcagaaagctgttcaaccttaacaaggatgatgatgtacgcaagtacgtgaacacat

SEQ ID NO: 4374 - DNA, 301 bp, Zea mays
  Clone ID: LIB3279-007-P1-K1-F10
ggggtcatgggccacaacacgccaccaccggtcataccagcaccaggagcttatgcaggggagggagcttatgcaggggagggagcttatgcaggagaggatccaaccccgttacacgacttcgtcgaccagttattggcttctggaggtagtggacacaactccaacgaccccaatgtgtgattaagttagctttgtgtcgcactgtgttgtaatgaactattttgtggactttatgtttgtatggactatttgcggactttatatttgtatggactcaagttttaggttgtgaactcaa

SEQ ID NO: 4375 - DNA, 439 bp, Zea mays
  Clone ID: LIB3279-007-P1-K1-F12
gtcgaaggtagcggtgccggagtcggtgctccgcaagcggaagcgcgaggaacagtgggccaccgagaagaaggagaaggccctagtcgagaagaagaagtccatcgagagccgcaagctcatcttcacccgcgcaaagcagtacgccgaggaatacgatgcccaggagaaggaactggtgcagcttaagcgcgaggcccgtttgaagggtggtttctatgtcagtcctgaggcaaagctgctctttgtggtccgcatccggggtattaacgccatgcaccctaagaccaggaagatcttgcagcttctgcgattgaggcagatcttcaatggtgtgttcctcaaagtcaacaaggcgactattaacatgctacgcagggttgagccatatgttgcatatgggtacccaaacttgaagagtgtcagggagttgatctac

SEQ ID NO: 4376 - DNA, 405 bp, Zea mays
  Clone ID: LIB3279-007-P1-K1-F2
accagcagcctcaatcttctgtgtcattgttcaagtcccacgactccttgtccttcacaaatgaaataagctcaacttcatatattactgtgctgttaggtggaacaacagcaagatcctgctttgactcagttgaaccaaatgcatattcaggaggaattgtgacaagagcaacctcgcccttcttcatgttcaacacagcacgatcaagaccggcaataacttcctcttcatcggtcttgaatttaaatggctcttcgtcatgccccttctttgtaaacaccgcgccatcctgaagctttccgataattttgacttcaacaacagcaccctcgttgggacgctcataaccttctccctccttgagaaccttcttaaggattttcttatcatccccaatttctg

SEQ ID NO: 4377 - DNA, 406 bp, Zea mays
  Clone ID: LIB3279-007-P1-K1-F3
cctctctctcgctgtttgaggagaactacctgctcctgctccctcttccgctcctccgcgctcccgctcgccatccccaggcttcatttcggacggggatggacgactacgcccgggagatgatggagctgaagacgctcgtcacccgcaccctcgagaagaagggcgttctcgccaagattagggctgagctaagagcaagcgtgtttgaagccattgaagaggaggatcgggtgatggagaatgatgatggcggtaatcctgctttgcttggtagctgtaatgaccgggctaagcaactgcatgcttcaccttcaggtaggttactaactgcacttgtttgcgaatacttggagtgggcgcaattaagtcacacaatgaaagtttacttgccagagtgtaacct

SEQ ID NO: 4378 - DNA, 435 bp, Zea mays
  Clone ID: LIB3279-007-P1-K1-F4
tgcgaaggctggaataattgcatctttaaacgctaggacatctgtcctggcatgtgcgaatcctactgaatcacgttacaatccaaggctctctgtaattgacaacatccacttagcgccaacgctactttcaagattcgacctgatttatcttatcttggacaaggcggatgagcaaactgataggcgcctggcaaagcatattgtttcgttgcattttgagaatccaaatttagaggagctcgaggtcttggacttgcagacactagtttcctacataagctatgcaaggaagtatattcagccacagttatctgatgaagctgcagaagagttaactcgtggctatgtcgagatgagaaaaagagggaatagccctgggagcagaaagaaggtcataacagcaaccgctagacaaatagagagtttgatccg

SEQ ID NO: 4379 - DNA, 439 bp, Zea mays
  Clone ID: LIB3279-007-P1-K1-F6
gggaaaataccctaggctctcgccagtctccggcgcggctcaacaccgaccgaacccgggaaaaattcgttctcctttcgatccgtttggcggggggctcggccggatccgaccggaggggcgccgccgatccatccagtcgcagccgcatctgatttggtgcggattttggcgagataccccgcccctagctccgctgtttcaaggataacaaagatggcgtcgccgcggggcgggttcgatgagcaagatcgccggacggagaagggcaccgaggtgttcgtcggcggtctgccgcggtcggccacggaaagcacgctccgagagatattttcttcatgcggagagattattgacgcgcgcataatgaaagatcagagtggtcactcaaagggatatggttttgtgcggtttgcaaagagggattatgctaatactg

SEQ ID NO: 4380 - DNA, 419 bp, Zea mays
  Clone ID: LIB3279-007-P1-K1-F7
cagcgagcagactggtttaggtggtgtcggaaatgttgggcgccttcggcttccgaaggtcctcaaaaacatgatttaacaatgcctctggagtataatgtgtggacagggatcttcgaacaagagcccacggtatgaagaagcacggaaataatacgaaagatggagcagagccgaagctgcgcagaagggagcttcggcatgatggcagaaaagaggaaaccgacttaaagaggaaaagactatctagacccagataaattactatagagttgttgtcataggcaaagggcctggatgtaattttgcatgggctgcgacccgtgcctataaataggtgaacagtattcccgtactgttcacgctgacttggcatctgctttcgcgtcacgcttgtacccttgctttccttcgagccg

SEQ ID NO: 4381 - DNA, 419 bp, Zea mays
  Clone ID: LIB3279-007-P1-K1-F8
cggacgcgtggggtgattccaccggtcatggcggctccgatccgagcacctccggcatgggcgggcgcgggttcctccccggcggcgaggccctagcagcggcctctcctggtgggcacggcctgccccggcgacgcggtagcagccgtcccggcccgtgcgcgggtgcggcggtcaaagggcgagcaggaccgacctggctcgggcggcaccagccactgccggcgcggggcacggccttcggcttaggcccctggaggctcggcctccagcgtgggcacgaccttggcgattggagcagccctcggtgcgagtgcgcaaccccggcgcgtgctccagcgggtgcgggcagcatccggcggcgcacacggcgcggtgggcgtggcccctgcctggctccccggtgacccacggcgtgc

SEQ ID NO: 4382 - DNA, 416 bp, Zea mays
  Clone ID: LIB3279-007-P1-K1-F9
cggacgcgtgggtttggctcggggacctgaactaccggatagctctttcgtatcgctgagtgaaggctttagttgagatgcacagctggaaacagttgctggagaaggaccagcttcgcatagagcagagatttggtcgggtctttgcaggctggaaagaaggaaggatttactttcctcccacctacaagtactcatacaactccgatagatacgctggcgacgacatgcacccgaacgagaagcgaaggactccagcatggtgtgaccggattctatggtacgggcgaggcctgtcccagctatgctacgtgcgcggcgagtctcggttctcggatcacaggcctgtgtacagcatattcacggcggaggttgagattccgagccagtcagctgctcacttcggcgcatcactc

SEQ ID NO: 4383 - DNA, 286 bp, Zea mays
  Clone ID: LIB3279-007-P1-K1-G1
cttgtgagtagcatgatctcacagggtggcacagacagctttattactctctctccggttgagaaccaagatggagatctggttacaaacaatcagtggctgacatttcatacactgtttccaaggatagcatggtcctcgctagacctctttgagcagagggacgtcattaaagagctcacactgcgaactaagcgcaacagatcactaatagcatggataggtgagagaccgtattcaatctttcagatgattgctgtagcgtgcaaaccatgagctagaaaac

SEQ ID NO: 4384 - DNA, 390 bp, Zea mays
  Clone ID: LIB3279-007-P1-K1-G10
acttccccagcagagcaggcaaaccgctcccagtcccagtctctcacctgaggtgactggcgtctcttgtcgcaagccgccagaagcttcggcccctgacgcgtgggggccccgtccgcccccgcccccgtccccacgttgccggccatggcggggcagccaccgccgtccggggcctccgaggacgacttcctcgagcacttcttcgccttcccctccgcggcctccgccggcgctgccgggggccacgcgggcgccggtgttggcggggaccaccccttccccctcgccctcagcctcgacgccgccgccgaggccaagccggaccgtgatcccgtgcagctcgccggcctcttcccgccggtgttcgctggcgccggcggcgtgcac

SEQ ID NO: 4385 - DNA, 437 bp, Zea mays
  Clone ID: LIB3279-007-P1-K1-G11
cccacgcgtccggcgtgacttgcaagctcagcaggagcaagaagagcgacatagaattggtgaatcacttgattttgagataaagaggtgggctgctggcaaagaaggcaacctacgggccttgctaacaacgttgcaatatattctttggcctgaatgtggctggcgacctgtatcattgactgatctgattacagcagcatctgtcaagaaagaatacaggaaagcaacattgtgtatccatcctgataaggtgcagcagaagggtgcaaatcttcaacagaaatacattgcagaaaaggtatttgaccttctgaaggaagcctggaaaaaattcaactcagaagaactcttctaacaacttgtttaggaaaatgttgatcgcaaaacaagtattgggaaggacaggtaggcaagctatggtagatatttttatt

SEQ ID NO: 4386 - DNA, 440 bp, Zea mays
  Clone ID: LIB3279-007-P1-K1-G12
cgcctcgcctggatctcgcgctagggttggagccagggtcctcacagccgcctctatcgctcgcctggagctcgcgctagggttcctctcgcagccgccgctgttgaggtgctacttgcaaaagcgtgtactgaacagctcaaaaggccctgttgtacgtgcactgcgtgctcagactgataagagagagtatgcaatagagatgaagaacagtgtggaaaggtccatatggtaaaggaaatcagtggcgaagtctatctttttctcctcctgccgtacgtccgttccagcttgcaaagcgctcgcgagctgctgccatggccagcgccggtgcacccgcagttccccaggctggtcgcccagcctccaacttcgacgtcatcgtggtgggcgccggcatcatgggcagctgcacggcgcacgcggcggtgtctcgcggc

SEQ ID NO: 4387 - DNA, 407 bp, Zea mays
  Clone ID: LIB3279-007-P1-K1-G3
cccacgcgtgcgagctcgcgtctgcgagggctcttacaaggggctccgcaagccctgtgggtgaatgagaatagtggtgtccaaacaactaatggacacctgattgtactactccttgtaggagcccggctaggtgatggagttgctgttgcggattgacgagggtgagcgcctctccacggcctgtcccaagtgcgtgtccaatctacgaggacagatgaccatcgcactgggagtaacaatacagtatatatgctcaatatataatgacttatactgagggcgatggatgaattacaggaatagggccagcctcgagtgagacaggaatgaatgacgggctaccgcactctttacataatcttaccacagctaaggtgagaccagagctctgtgagctgtgcact

SEQ ID NO: 4388 - DNA, 437 bp, Zea mays
  Clone ID: LIB3279-007-P1-K1-G4
cccacgcgtccggtcctctgttccttcccctccccgatctcccccaatccgaccaaacgggcagagccggggggcggcgatggcgctgcgacgggcgctcctcagatcggcagagatctctttcgaacgcaaggctgcaattgagtacattcattctttatcaagggcacagcctgctcgttctctcaatggtgctggcctttgtcctgctagtagatcacttagcacccaggccgccactacgtcaagcacaccacagcctccgcctcccccaccccctccagagaagactcactttggtggcctcaaagacgaggatcgcattttcaccaacctctatggtctgcatgacccttttctgaaaggcgcgatgaagagaggtgactggtataggaccaaggatttggtgatcaaggaggcagactggatagttaatg

SEQ ID NO: 4389 - DNA, 436 bp, Zea mays
  Clone ID: LIB3279-007-P1-K1-G5
cggacgcgtgggcgccaagccaatcacacggaaaaagaccctaacctaccacaaacttatcttccaaccaatccatgcgctgttgctagacatctcggtgtttttgtagattgaggatgaatcgaagatccgatcgatgaaccggaagcgcggtgacgaagctctcgccgagccagtcacggtgatgttctgggttgcaccagaagatgaacgaaccatgagaaattcctcgttggagttgtcgttagagttgggaagagagtcgtacttcgacgagatggtcatggcggcttatggctacaagcttatctggcaatgggctgttgcgaggctatagagaagataagtctatggttgatggcaggtgcgacactaggtatttacggctctgagaaaggagagtccgatagagatttcctatcttttctttcaactc

SEQ ID NO: 4390 - DNA, 441 bp, Zea mays
  Clone ID: LIB3279-007-P1-K1-G6
ccgacagctaaaactcctgggttcctctttttcctccagagatttccgtcccgtccacgcgagctccaagatcccaaccatggtggccgcgacggcactctccttctcctttctgtcactagcaacgacactcttccttctcctcctgcgcagcctcatcaacaacaagaagcgccactgtcgcttcccaccgagcccgccgtcgtccctgcccgtcatcggccacctgcaccttttgaagaagccgctccaccgaacgctgtctgctcttgcggcgcagcacggccctgttctcctcttccgattcggctcccgccgcgttgtccacgtcgccgaccctgccgtcgccgcggagtgtttgagcacccacgacgtcaccttcgccaaccgcccgcggcttccctccgcccgctacctctccaacgactacaccacgttggg

SEQ ID NO: 4391 - DNA, 361 bp, Zea mays
  Clone ID: LIB3279-007-P1-K1-G7
gtgtttaaatcgatgacggtgagacagacagtcaccctgtaccaagaggacatgaaggttcgaatgcggttgcgcgccatcaaagaccacatcagtcaggaccggtacgagcgaccacaagagcgcgaccttatgatactgaccttcaatcctgaatagacgtacagacactcacacgacgcccacatattggacaacatgatcgagggctggtgactacaccgcgaaaacaccggcagtgtgctgacctggatgttcatggtcctcgacgaccacaccgagtttctaaaggaccgaaccgagggcgtcaaggcatgctaacccgacttgatcaccaaggccaacagttatgttcatggcg

SEQ ID NO: 4392 - DNA, 297 bp, Zea mays
  Clone ID: LIB3279-007-P1-K1-G8
aaaaaaaaacaaggcattttttcttccattctaaatagcaaaggacaacttgcagcaggacacatacacatacaagcacattcgtcccatttgcagcctacgcatcaccgcatactggtaacagggtactgctaaacatcaaatcactccggacagtcagtttatgcctttttaggggacttggcggcctttttgggcgactttgcctccttgctcccgccactggacgccttttccgccgtttttttgggcaacaaaacagggttgatattggggagcacaccgccgggagcgatg

SEQ ID NO: 4393 - DNA, 425 bp, Zea mays
  Clone ID: LIB3279-007-P1-K1-G9
cccacgcgtccggtcaccggcaatctcagcttcaacaccacggcgccgccaacggatgcgcagccaaacggcgagtccccgcggcctcgtcctacgcctggcgcacctgctggtgctgggggtaaaaatagtgcaggggggatccctgggagtgggaagaaggcctcatcagctgtgttgctgggcacaaccattccagtggcggtgagcgtggtcgccctggtctccgtgggcgccgtgttcttgtgcaagagaagagcgtcggtgccgccgcaggcagcctccgtggtggtgcatccccgtaatagctctgatccggacaacctggccaagatcgtggtggccaccaacgacggcagcagcagcggcacgtcccatagccacgggagcagcagcagccaggctggcgacgtgcacatggtcga

SEQ ID NO: 4394 - DNA, 234 bp, Zea mays
  Clone ID: LIB3279-007-P1-K1-H1
gttttggagttttggatcctgcattgaagattacgataacgtccaatgacatgatcttgagctgttacattttgggagtttgaaatcttgcgtatattttggagtttgagatcctgcattgaagattgtaatttcctccgtgcaaattaaggacctaggcttctccaagatgccggtgttgcttcttctacacttacattgttacattttctggattaagacatgttagcttcc

SEQ ID NO: 4395 - DNA, 440 bp, Zea mays
  Clone ID: LIB3279-007-P1-K1-H10
atctagacaaaaaggccgaaagcaaacataatgcgatacaagatttggcagtggaatgttctgttccaaagggaagttgcttaggctcacagtcaatagagggaatgcagaggtcaaagccaaagatttctgcagaagaggtgatagaagcaatcttcactgtacctgaacgattggaggaggagccaaaattaaaacgatatggattgggcgcaaaccgaaacagagtcccacatcagaaaccagtcctgaaacctcttgaggacgttccaacatattctactgagtttcccatcaacattatcataggtagcaaagcaccgtctatgaatgaggacgaataccagaactaccgcagggctgcaaagcagcactggtttatgatgaagcagtactatgagaaggctgctgatgctttcagggagggtaaccagaaagaa

SEQ ID NO: 4396 - DNA, 437 bp, Zea mays
  unsure (1)..(437): unsure at all n locations; Clone ID: LIB3279-007-P1-K1-H11
cccgtctccgcagacgcctcccttttcttctcactccactccgccgcccggattcagagcgagaggaggcggagagggcggacatggcggcgatgttggtgggcgcgctgcggaggggaagtggatgccgcggcggcttgcgccttatcgctcattcgcttcgcagattcgtgagcacgctcgtcgtagcggagcacgaaggcgggttcgtcaagccgtcgtcgctgagcgcattggccgccgcggaggccattgccaaggacaacaaagtttctgtcctgctgggtggttccgggccggcgcttcacaaggccgccgaccatgccgcgtgcagccatccactggtgtctgaggtgctcgtggccgattcggaagccttggcgcatcctctggctgaaccctgngccgagctactccgttccgttcagcagaaagga

SEQ ID NO: 4397 - DNA, 359 bp, Zea mays
  Clone ID: LIB3279-007-P1-K1-H12
agacgaatgagtgcactgtgcaggcagtgcctgacctatcacatacagcctgaagaatggccttcgacccttgctgcttcagcggcaccgcaccagctgtgggcttgggggggtcaccgccaagcggtgccggcgcgagacaggctggaggggcaggtggagcttgagactggcgctttcttcggcatgcgacgctacttctggctcaacctgccgcgcgccggctgccgcgtttgcgccaacgtccgccgcgccgatcgcgtccagtcgctctgcgactagaacaactcttgcgatgcctgcagagccccccgcgcggtggatatgacggtcgacatcgccatccgtgggttgtgcct

SEQ ID NO: 4398 - DNA, 236 bp, Zea mays
  Clone ID: LIB3279-007-P1-K1-H2
aaaaaaaaaaaaaaaaaaaaaaaaaaaaaaaaaaaaaaaaaaaaaaaaaaaaaaaaaaaaggggcttccaaaaaaaaagagaaccacgcttacatacacaaacatacaaaaaacatgcctcttttttgtggtaacctaattctacttccctggccgtcaatttacaacctcttccctgggaaaaccctgtcctgacctatcttattttttttgcacaacatccccttttctccccc

SEQ ID NO: 4399 - DNA, 244 bp, Zea mays
  Clone ID: LIB3279-007-P1-K1-H3
cggaaataatggtggtttctgcaaaagtggtggtaaataaaagggcgacaagccgacaactatcttgtttttcttagtaacttgtaactttacgatgcgataatggaacatggcctgcgttatctgtttctcgtgaagcatttttgcaggcaggttctgaattggagaaaattgcatttttaacactgccagtgtgcagtcaatattacacagttcagttagaatcttatatattggacggcat

SEQ ID NO: 4400 - DNA, 440 bp, Zea mays
  Clone ID: LIB3279-007-P1-K1-H4
cgcgaggtcgacgcggattttcttctttataccgcgggcaggcggactgggcggctggcggagccgcggagggaaccgagtggccccggcgacgcgaggccgaggcgagctaatctgacggcggcagtgacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcaattggtgtcacaacatctcttctattggaaaaaccccaaggagcagaaagccatacttattattgtgctgatggctccactatacgctatctcttccttcgtgggtcttcttgatatccagggtagcaagacatttttcacattctta

SEQ ID NO: 4401 - DNA, 267 bp, Zea mays
  Clone ID: LIB3279-007-P1-K1-H5
aaaaaaagttgtcgcgttgtaaaatttaattttaaaaatttcaaatggaacaatatctgtgattcgatttgtagattcgtgagcacgctcgtcgtagcggagcacgaaggcgggttcgtcaagccgtcgtcgctgaaaaaaaccatgtttttgggtttccaaaggaaaaatcaaaaaaaagggaggcatgttgttgtttaaatgaaaagtagggaaaaattttttaaaagggggttttttcaaaaactaatggttaaaaaagggaaa

SEQ ID NO: 4402 - DNA, 443 bp, Zea mays
  unsure (1)..(443): unsure at all n locations; Clone ID: LIB3279-007-P1-K1-H6
cacaggctcctgagggacctcgagcatggncgggctacatgtncgagcaanaaagacaatgggagatcaatcccagagaactcctatcanntggatgagctccgcaaggcgtgccgaggtctgacanagaatgacanagtcagtcaagcggatctcgtgatgctgctgttcgagaactgctctcctgacctccggcttcagcctggatgaccccaacaccttcggcaaccggatccaccgcatgctcaaactcggtctgagcatcgatgaggacgagcctgttgaggcagaggctgagatgcctcagcttgaggacgacgctggtgaaagcaagatggaggaggtcgactaagtgtcgcatcgcatgcttgccgtttatcttatccctagctaagctacctgtgatagcttaattttcactattgttcgaggtttttggcacg

SEQ ID NO: 4403 - DNA, 368 bp, Zea mays
  Clone ID: LIB3279-007-P1-K1-H7
gacacattgaggatgctctgaagcacttgtcacttgcaaccccgcagcctgacctcctagaattgcacaaattgcaaacagtggagaagcacttggggagatgtctggatgcgagaaaggctggggactggaagagtgtgctaagggaaagtgatgcagctattgcggctggagctgactcctcggctctgctcttggctgctagagcagaagcccttctccgtctcaatttacttgatgaggctgatcttgcaatctctagtgcctccaaattggattatacatcttcatgctcctcagacaccaaattttgtgggtttcttgccaacgcctacctgttttatgtacatgcccaaattgacatgtca

SEQ ID NO: 4404 - DNA, 420 bp, Zea mays
  Clone ID: LIB3279-007-P1-K1-H8
aggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcaactctgtttgggcccaacatcttagtgaagaagtgaggagaaggttctacaagaactggtgcaagagcaagaagaaggctttcacaaagtatgctctcaaatatgaaaatgatgctggcaagaaggaaattcagctgcagcttgagaagatgaagaaatatgcttct

SEQ ID NO: 4405 - DNA, 370 bp, Zea mays
  Clone ID: LIB3279-007-P1-K1-H9
cccacgcgtccgcccacgcgtccggaagaggtcccgcacaatttgcaccgcctcatgaatagctcgccgaggatctctcacgctggactgcccaagaggcctcgcacgaccgctgctggggatgccaaaaatggagctgtagcacccggtggaggtaacggcgctggtgtttgtaacggttcttcagttcaggtgccgacggaggctggcggttggttgggtaatggatgctctgaggcgaaatctcatgagagaaccgttccattgctcaaccacgaggtctctggtgaagactcatccaggcatgccgcgaagagtagcggcggcattgctgacaacggagtcggggttgggaactcgagtgctggtc

SEQ ID NO: 4406 - DNA, 201 bp, Zea mays
  Clone ID: LIB3279-008-P1-K1-A1
cccacgcgtccgcgcgcgtcgagcgctggctcctcggggaggaggtgaagaacatcgtggcctgcgacggcgcggaccggcgggagcggcacgagcgcctggaccgctgggcggcgcggatggagggcgccggcttcgcccgcgtaccgctcagctactacgcgctgttgcaggcccggcgggcggtacatgggctgggct

SEQ ID NO: 4407 - DNA, 364 bp, Zea mays
  Clone ID: LIB3279-008-P1-K1-A11
cgccgccgccgcaagccgtccgccttgcccctcgaaggcttggtcctccttgtatcccgacctcctccgccacagacccgtttccccgctagagttatcgttcctctgcagcgatggcgatcaagcggaccaaggcggagaagaagatcgcgtacgacaagaagctgtgcagcctgctcgatgagtacaccaaggtgctcatcgccctcgccgacaacgtcggctccaagcagctccaagacatccgccggggcctcaggggcgactcggtggtgctcatgggcaagaacacgctcatcaggcgctgcatcaaggtctacgccgagaagaccggcaaccacacctttgacccgctcatggacct

SEQ ID NO: 4408 - DNA, 338 bp, Zea mays
  unsure (1)..(338): unsure at all n locations; Clone ID: LIB3279-008-P1-K1-A2
gctccatgattcatcatacctcctccttcctgcaaatcgccaaatcctgcaggcaccaccggtcgttttcctgtgcggngaacaggagagaaggggagagaccgagagagggggaggcgcggcgtccgccggatctgctccgacccccgacgcagcctgtcacgccgtcctcactctcagccagcgaaaatgggtgccggaggcaggatgaccgagaaggagcgggaggagcaggagcaggagcaggtcgcccgtgctaccggcggtggcgcggcagtgcagcggtcgccggtggagaagccaatgaggcgtcatggcatatcaaaaaggatatccca

SEQ ID NO: 4409 - DNA, 377 bp, Zea mays
  Clone ID: LIB3279-008-P1-K1-A3
cccacgcgtccgcccacgcgtccgatcgagacgatcgactgctttgtctcgcctccccaagcgagaagcgaccgactcccgccgccgttgccagccatggacggcggtgacgacctcgccgccctgcacgagcaggtcgccctcgcattctccgccgccatctcggcctccgacctcgaccttgccttccagctccaggtcgccgaggccatccaagcctccctcggcttgcccaatgccgccgccccgtcatcatcgtcgcaagccgccccagagtcatcctccgacgccacctacgccttcgccgtccaggccgccgatctcgcgcgcgcagaggaggaccgccgcgacgccgaggcctgccgagccgtcaacgc

SEQ ID NO: 4410 - DNA, 151 bp, Zea mays
  Clone ID: LIB3279-008-P1-K1-A4
caaatcaacccttagtggtccgaaaggtggtccggtggcctggcccccacgcccagcatggtgcccggtgcggccttggtcagcgcgaggcgcatcctcttctcttctcttgcgttgttgcccgttcacttgtctttcgtttcttgttttt

SEQ ID NO: 4411 - DNA, 376 bp, Zea mays
  Clone ID: LIB3279-008-P1-K1-A5
cggacgcgtgggcggcggcgcgccctcctgcaggaaaaaaaaatagaagacgatgctgccccgcttgccaatccgcctcgcgccgccgctcgccggcgtccttcgcggcatctgcgctaccgcgctgccgcaatccaagcccccacctcaacccctctccccgtccgacctggacgcgatctccgcgctcctcccgcgtctcctctacgcgggccacgtccccgccgccggccgccttctctccgcggcgctcctcctcccgggctcccaggacggccttcccctcaattccctcgccgcgtaccttgcctcgcttccgaccctctccgctgccttcgcgctcctcaccgcgctgcgccatcacccggcccggccc

SEQ ID NO: 4412 - DNA, 390 bp, Zea mays
  unsure (1)..(390): unsure at all n locations; Clone ID: LIB3279-008-P1-K1-A6
ataatttgccacgccagattgatcattccttttattgaagactatgttctgaattgaccataataggagagagaagcatggggagttagcatctcggcctcatccatttccaacaagccaaaagcactaactgaaagtctggcacttttaagcaaaaataacatgtcctaaaagcacagtagtataattgatcacaattcagttcataaaatacatggataagtcataagtgcttgtatgtgagtacaaagaagaggtgattgtatttacctagatctgcaaacgctacatgttagttgtgtaatctccttttgtttctctctcatccgctcgatgagcacagatgaaatgtatatgtttacaacgtnctcataaccatccctcaccata

SEQ ID NO: 4413 - DNA, 455 bp, Zea mays
  Clone ID: LIB3279-008-P1-K1-A7
atggattcagcatacgactccgatgcatctgaagaaggggatgatgatggtgatgatctctctgtaaggcaggacacaccatatactcacattcatgagatagttttctccacaatcgataagccaaagctccttagtcagctatctgcattgctatctgacattggattgaacatcagagaagcacatgttttctctacccatgatggctattctcttgatgtttttgttgttgatggctggcctgttcaggatgctgatggtttgcacaaagcactggaagcatccattctaagaaatgagggttcatggtctggttcatctcattcctcagccgctgaaagaacactgcccttccaagttaaaggtggtgagtgggaaatcgacaaacgacttctgaagatgggagggatggttgcttctggttcttgtggggacttgtatcacgggactta

SEQ ID NO: 4414 - DNA, 347 bp, Zea mays
  Clone ID: LIB3279-008-P1-K1-A8
agatgaaactagcacaactgatagcgaggatagattcaattgatgtgaaatatttgatatgaactggcatcaaaaactgaataagcactgcccaacaggcaggaaccacagattttaaaactacaggttttcttaacacaaattgctgagacaggaaaacactatcagttcagatatagatttcaaaaccaggaggcgaacaaggactgaaacctaggcggtgagcacgacggcgccgcctgctgccttgatcttattctcggcgaccttggagatgagcttggccttgacgacaatgggcttgggcgggagcaccctctttccgagcaccttgaagtagccggact

SEQ ID NO: 4415 - DNA, 96 bp, Zea mays
  Clone ID: LIB3279-008-P1-K1-A9
tttcccgtgaggaaaatgtgtacatggcgaaacttgccgagcaggcggagaggtacgaggagatggttgagttcatggagaaggtagccaagactg

SEQ ID NO: 4416 - DNA, 411 bp, Zea mays
  Clone ID: LIB3279-008-P1-K1-B1
gaagttcaccgccgcctccatcctccgccgctaccgcgtacgcgtcgtcgagggccaccccgtcgcgcccaagatggcgctcaccatgtacatgaagcacgggctcaaggtgacgctcaccaagagaggcaaggccaattaattaagctctgaaccgtgtggtgtgccgagatcgagcttgccaattgtaaggcgcagagacgactcgagaaacacatgaaacaagcactactttcgtcgtgccactttgtgactgggatggaagtgttgatgctgctgcggaacaagatctctgtgttttcatgcgttttatttctcactttctttgtactaggccatatatatatatatatatatatacaccggtgttttggacttcgtttgtttcaaaaaaaaaaaaaaaaggggggg

SEQ ID NO: 4417 - DNA, 308 bp, Zea mays
  Clone ID: LIB3279-008-P1-K1-B10
ccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggcggccccggtggtctcctcctcccgccgcagatcagcggacgcgccgttgcccgggtcaggcgagtccaacgcagtgcagttcacgctcgagcacgaccttggcgacggcaagggcttcgtctc

SEQ ID NO: 4418 - DNA, 441 bp, Zea mays
  Clone ID: LIB3279-008-P1-K1-B11
agttcccacaaatcaaagcacacccatggcacaaggtattccacaaaaggatgccgccagaagctgttgatctggtctctcggctactccagtactccccaaatctgagatgcactgctatggaggcacttgttcacccattctttgatgagcttcgagatcctaatactcgccttccaaatggtcgctttttgccaccactattcaatttcaagcctcacgaacttaaaggagtcccatcagacattgtcgcgaaattgattccagaacatgcaaagaagcaatgctcctatgttggattgtgaaatgaccgcgccttgagactggaacctgtggttgcaactgtgcatttcccctgggatgtttgacgatctgaggcatgcgagcctgttgttgaagatgcaaggttacgtacttgtacgacaatgtgacctgtgtagc

SEQ ID NO: 4419 - DNA, 448 bp, Zea mays
  Clone ID: LIB3279-008-P1-K1-B12
ctccggggaagcgaggcaaggccaaaggggcggcgccgccgccgcccaccgcggcggcgagtaccggagctgtagggttccctggctgcctccgcctgatgccgccgtcgaccgtggccatatctatacacgccaagcccggctccaaggtcgccaccatcacagagattggggacgaggcggtgggcgtgcagatcgacgcgccggcgagggatggcgaagccaacgccgcgcttgtcgactttatcagctcggtacttggggtgaagaaaagagaagtgtctataggctcgggttctaaatcgagggaaaaggttgtgctggtacaagatgcgactcttgaaggtgtctacgatgctctgaagaagtcttgtaattgtgcatgagcttgcaaacacaagttagaaaatgaagtgagacgaggctgaattgttcgttcttggttgat

SEQ ID NO: 4420 - DNA, 458 bp, Zea mays
  Clone ID: LIB3279-008-P1-K1-B2
aaaaattgtctcatgatggttgcaagatagtttgctttgttggttgttactccttttgttctaaactataagatattttgttttttagatacaatagtttttctaaatatataggagagataatatatatttaaatgtatagcaaaattatatagttaaaatgaaaatatgttatctatactatacttaaagcaccagtttcaacggtcgtcatgcgtcatctttttacaaataaccctcacaactatttcaaattaatccgttgcacacctataaatggccaaacagtggctcggcacgggccagatgcacgcggaccacaactatggcttaggcacgtcatgccggcctactgactgtgccgggccagcccatcggcccatttgattaaatcagcataaaatgttaaaaaatgatgcaggaggtgggttcgccctaatgaaagaaggggcggagaa

SEQ ID NO: 4421 - DNA, 454 bp, Zea mays
  Clone ID: LIB3279-008-P1-K1-B3
cccacgcgtccgcgcatgcacccaggaactgccacacgcatgcaggaaatcgaccatggcacacatgcagcaaacggctagggaggccttgccgaggatgcacggacgggttgccggagggccggagggggctagtggcgcatagaggcgggctggccgcacctggccctggttccaagctacaagagcggaggacactacgagctgcccatacctgaactaggaaacgacgacgttgtcagcgccagattgctcggtgtcgaagtccccctggcaacgaacaggccgtgcccgcagaacccttcgcgtagatcctccactatctctctcccatgctggttgcaggcgtagcagcgactcccgaggttcggtgaagcacccaggtcggcaccgagacgaggacatgggcccacagcggcggccgtcagctttcttccccgcggcgatgtagatc

SEQ ID NO: 4422 - DNA, 404 bp, Zea mays
  Clone ID: LIB3279-008-P1-K1-B4
ctggcatccgttctttctaaaccctgatgcgcctaaggagggcgtcaggaaatctgacttctacaaggcgaagtttggtcctgttcagtatgagcgtgtcatttctcgcatggccgagatatttcgaggactcgggcttgagtatgacatgtcggggctgacaggggatacgatggatagtcataggctcatagcacttgctggacaccaaggctatgacaagcaaaatgctcttgttggagaattattcctttattacttttgtgaaggaaagtatattggtgacaagcaggttttgctggacgctgcaagaaaggtgggcatagaaggggccgaagaactgttcaagacctaccaaagagtcgtgaggttaagaagactaagagtattcattgcatctcggg

SEQ ID NO: 4423 - DNA, 434 bp, Zea mays
  Clone ID: LIB3279-008-P1-K1-B5
gttttccatgctctacatattgtatcaaattgttgcatggatgaggtttccatgctctctagattgatgtaaagatgaaagttaccttacctggagtacatgatgcctctggatttttctagctacttatcagtagcacattgtataccgagatgtgtttgtgatgttattttagtagtgtgataagtgttgtctgttatgctcttaaatggaggcatttgaccatccaatttagcttttctatgtgaagtcaatgaagcagaacctcttttttttgtgtgtgcacgtaatgtacctgggccttgtaaagtacggagcgtttgggattatgtcggtttacattttgttttgctctttacattacagaaccacggcaatcctacgagccataaaccaaagctagtactgaacaatttcactacacgccttggtca

SEQ ID NO: 4424 - DNA, 449 bp, Zea mays
  Clone ID: LIB3279-008-P1-K1-B6
aaaacttagcgaggcagagaagaaccggaaactgaatgatctcttggacgctcttgatttcaaccaagttgtgatattcgtgaagagtgttagcagagctgccgaactgaataagttactttgtgaatgcaacttcccatcaatctgcattcattctggaatgactcaggaagaaaggctaacaagatataagaacttcaaggaaggccacaagagaattcttgtggctacagatttagttggcaggggcattgacattgagcgtgtcaacattgtgataaactatgacatgccagactcagctgatacttatttgcacagggttggaagggctggacgttttggcacgaaaggacttgcaattacctttgtttcctctgcttcggattctgatgttcttaaccaggtgcaagaaaggtttgaggtagacataaaggaactgcctgagc

SEQ ID NO: 4425 - DNA, 374 bp, Zea mays
  Clone ID: LIB3279-008-P1-K1-B7
cagagagttcaaggtcgctggccttcctgtcgatgacagcagtttgggcccgggggatgaatatgagtttggactctatactcctaagctgcttgcagttactggagatgattatgtgtctaacccccgcatgccagacgaggatgagttcgaccatttctaccgtgttgtcgccaagaagactgacatgctgctcagctgccaccttccaaagccgcttgcagtttctgaagaggagaaggccgtgcaggagaagttcaaggagatggcgaacgaatgcatcgacctcctggttgatgcgatgcgccgcatcccagcggagaaaaggcgcccactgttctcggtgtttggtgagcttgacccggtatttgagt

SEQ ID NO: 4426 - DNA, 455 bp, Zea mays
  Clone ID: LIB3279-008-P1-K1-B8
gaagtagccgccggaggagcacgccaaggccgccgcctacgaggacggccatggggttctgggtgaccacgctcatctttctcctcgccggcgtcgccgcatccctcttcacgctcctctgctgcaaccgcgggccctccacaaacctattccatttgaccttggtgactacagctgtaatttgttgttggatgatgtatgctatcgtttaccttgctcagatgaagccattgatcaaccccatcctgagcggggagtgatctctcctctgcattaaaaagaatgaaagctaggtctgctgtaccattattcagtctgtgaacttcctattcatttggccccacctgatgaaataaataaactgccatgagtttttttttttttgctactccttcactgcagacattgagaaggctcgctgtgattagtgtatgcaattgtatgatatacgcaat

SEQ ID NO: 4427 - DNA, 392 bp, Zea mays
  Clone ID: LIB3279-008-P1-K1-B9
aaaaaggaaaaatgtcgagtacaatgagaactttaggagatttatgttagagtcggacaactttaggcgttatgttggtcgtgtacctctgcgtcctgctccaccatacaatcctccggcggctatgcccgacactctggatcagggggttcagcaaacatatggtgttcctttcgacgaagatatctctgatgatgaggaagaaatctctgatgatgaagatgagtccttctggtgaacatggtcattatgggggcttcttcttcttcttggtttctggtgctaaaaggagagaagtccgggcatttgatctagtctttgtgctgccgtttgagaggagaactaactatgtggatggatacttatgattatgtgctcaaacattgcctttc

SEQ ID NO: 4428 - DNA, 458 bp, Zea mays
  Clone ID: LIB3279-008-P1-K1-C1
ctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaac

SEQ ID NO: 4429 - DNA, 445 bp, Zea mays
  unsure (1)..(445): unsure at all n locations; Clone ID: LIB3279-008-P1-K1-C10
gcgactgctcccgctccacaatttcaacctccagatctggccactcccactctcacacgcccagtctcctcaatcctcacatcccattggccacggcaactgccatcgccatggccgggaggcgtccggcaccggcggccctcctcctcctcgccgtagccttcgctcccatctcctccgccgttcgcccagtctccgatgcgcacagatccgctgccgaggagctcttcgccccctccgccgacggttccttcggcgatttggagagtacgtatgaggcagtgaaaacgttccagatactcgggctggagaaatataatagtttatctgggaaggcgtgcaagtttgccgcggagaacctggcttccaccgattccaccgcgaaagatctgttccacgcagntccgatcagtggcgcgctgggatgtggcgttgatgccggcgt

SEQ ID NO: 4430 - DNA, 450 bp, Zea mays
  Clone ID: LIB3279-008-P1-K1-C11
cggtgagcgagcaagcgagagatggctgggaggctaaccgcggcagggtcccgcatcctgggcggcggcggcgcacgcgccgcggcttccgccctccgacaccgcgccggcatgggcctccccgtcggccgccacatcgtccccgacaagcccctccccgtgaacgacgagttggtatgggataacggcacgcccttcccggaaccctgcatcgaccgccttgccccgcacatcggcaagtacgaggcgttggcgtggctgtgcggagggctagggttcttcgctgccctcggtatggctgctgttgtgaacgacaaggcctccaatataccatatactcccaaagtctacccgtacgacaacttgagagctgagcttggtgatagaccatagaaggttttttgtctgtttgacaaggcactttgatgaatatgatctgagatctatatt

SEQ ID NO: 4431 - DNA, 123 bp, Zea mays
  Clone ID: LIB3279-008-P1-K1-C2
cccacgcgtccgatttgttggttctacgcttaactagtctgctcggcagggttatagtttcgaatgcccacctgtacaataccaagatcccattccttttttggtggtggcatattttggttc

SEQ ID NO: 4432 - DNA, 416 bp, Zea mays
  Clone ID: LIB3279-008-P1-K1-C3
cttgaagggttttgctattggcaacggactaacagatccagcaatacagtacaaggcataccctgattacgcgttggatatgggattaattacaaaaacacaatttaacaggatcaataaaatagttccaacttgtgaattcgctgtcaagctttgtggtacttctggaactgtatcttgccttgctgcgtactttgtctgcaatacaatattcagtgccatcaggacaatcataggcaataaaaattattatgacatcaggaaaccatgcatcggaagcctatgctatgatttctctaatttggagaaatttctcaacctcaaatctgtcagagagagcctaggggttggagatatagagtttgtttcatgcagcccaactgtctatgaggccatgctattagattggatgagga

SEQ ID NO: 4433 - DNA, 398 bp, Zea mays
  Clone ID: LIB3279-008-P1-K1-C4
atctcctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgccaagctcgcgcgctataacaa

SEQ ID NO: 4434 - DNA, 437 bp, Zea mays
  unsure (1)..(437): unsure at all n locations; Clone ID: LIB3279-008-P1-K1-C5
gcttcgcccactcgctccagccgcttcaccgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctcaatgactntgataggttcaaagtcatgctggcgaagattaagaggggcggtgctatcaggcaagagctcgccaagctg

SEQ ID NO: 4435 - DNA, 456 bp, Zea mays
  Clone ID: LIB3279-008-P1-K1-C7
ggactaaatgagtcagatgcggatgaggatgaagaagacgaagatcaagaagatgattcatcgccagtgcttgctccaaaacagaaggatcaagttaaagatgaacctgtggatagcagcccatctaaaccagcaccatcaggacatgctcgaggcacacctccggcatccaaatccaagcaaaagagaaaatcaggtgttgatgatgcaaaaacttctagtggtgcagcttcaaagaaagcaaaggtggaattggatgcgaaagcatcaggcctcaaagaggaggcatcatctttggcaaaacctgcatcaaagacctctgctgcatcaaaaagtgggacaaacgtatcacctgtcacagaggatgaaatcaggagtgttcttcttgcagtggctccagtcaccacacaagatctggtatccagattcaagtctaggcttcgaggtgcagaggac

SEQ ID NO: 4436 - DNA, 428 bp, Zea mays
  Clone ID: LIB3279-008-P1-K1-C8
gatgaacaggccaaagaaaggtccatggacattaacctaggatggttcttggagcctgtggttcgtggtgactaccccttctcaatgagatcgttagcgagggaacgactacccttcttcagtgacaaacagcaagagaagcttgtgggatcctataacatgttgggaataaactactacacctcaatattctccaaacatatcgacatctcaccaaaatactcgcctgttctcaacactgacgacgcctacgctagtcaagaaacgtatgggcctgacgggaaacccattggtcctcctatgggaaatccgtggatctacttgtacccagaaagcctaaaggatatccttatgatcatgaaagacaaatacggaaacccacctatctacatcactgagaacggaacggggatgttgatacataggag

SEQ ID NO: 4437 - DNA, 451 bp, Zea mays
  Clone ID: LIB3279-008-P1-K1-C9
acaagaagcaagtgatagtcaattggtcgtcaacgtgtgacaagtgttgacatcccgttactaatatgaccgtccctccacgaagtgggtctaatttcgacgcactttgtatgtgcttcatgcatttcattctcatatctctataatctcttataaagcaccaattttatttctcccaccgtcaccctttttgcaaaaaaggttcttatacttttttctaaacaatccgcgatttataagtcagatctgatcctgcggactccacccgaccccacacatctcgcaaacggtagttttgattgaccctgcctgtacccttcctccttatcgcctcgcatcccaactcgacagggtgacagtcgggcctacgtcaggtgttccaggcctacattttcaggccttatccagcgatgaacaccctatgtacgccccacctcgtctcctccgttcg

SEQ ID NO: 4438 - DNA, 458 bp, Zea mays
  unsure (1)..(458): unsure at all n locations; Clone ID: LIB3279-008-P1-K1-D1
aacaacactcgcgagtcgcgagcacagatcgaacaggcaggcggcctctgtcctctgatctgtcgccattgtctcgttgtgttgtcccggaggagcaggagcaggagcgatcaggccaacgctttggactcctggacctaccccgatggcgccagcctcctctccgatgagacagtaatccagcgagcgcgagtgagaggcaaccagcaaccatgaggccagacacggcggcctccgcctctccgactccgaagaagaaacccgacagtaaagccgcgctggacctcgcgtcgtggagcttcaacgtcaccacgtccgtcgggctcatcatggtcaacaaggctctaatggcgacgtacgggttcacgttcgccacgacgttaacggngctgcatttcgcgaccaccaccgtgatgaccctcgtgttccggtgggtcggcctgagccagccgtcgcag

SEQ ID NO: 4439 - DNA, 387 bp, Zea mays
  Clone ID: LIB3279-008-P1-K1-D10
cccacgcgtccgcccacgcgtccgcccacgcgtccgttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccaatcccgcggcggccgtggaggc

SEQ ID NO: 4440 - DNA, 239 bp, Zea mays
  Clone ID: LIB3279-008-P1-K1-D11
cagcaaaaaacaaaggatcaaatcaacggaccacccaaacgaacggggttcaatccagaggggggaatccaacaggggcttcagcacctaaaggacccgaagcataaaggccctaccattattggggggggcgccccgccaaatttaaattttcaggcaaggaaggggctgcacatgaaaccaaccgagggcggcctcatcccaactttgaaataggagggctggggggcctccatttt

SEQ ID NO: 4441 - DNA, 281 bp, Zea mays
  Clone ID: LIB3279-008-P1-K1-D12
cacatgcgttcggcccccgtgaatacacatgcagtccaactgcctagcgggcgagagtgtgcacatgagcacgagcagtgttgctctcgctcaccaacgtgtggatgaacatcgaccacacattatatgttgcacgtacgtgcattcgttgccgcatcgtgcgctaatatgacgcctggctcggaactacctcgatgttaattaattatacttacttaacaaacagcacaatagcgtagcacacctattgcaaatcaatggtggatattatccatatttaa

SEQ ID NO: 4442 - DNA, 422 bp, Zea mays
  unsure (1)..(422): unsure at all n locations; Clone ID: LIB3279-008-P1-K1-D2
gtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtctngcaggggtgggtggttagcacatccttggctggtgcaacactaggttctt

SEQ ID NO: 4443 - DNA, 418 bp, Zea mays
  Clone ID: LIB3279-008-P1-K1-D3
ccattcccaaatcctccgtcgacccctctacaccggcgatcggcggcgaacgatggggtgggcgacgcggttcctggcggcggtgtgcttctttgctgcgggcgtcctcttcgtcccagaggctatcggttccccatccggcgcaggagccgtcaccgccgccaagctggcccacgtcctctcctttgccacctcctggggcgccgccctctgggccaccttcatcggcggcatcataatgttcaagaacctggcgaggcacatggtccgcaacctgcaaaggaaggatgtcccgggcctccttaaccctattttctgattgcgcagccatctccgtcgccgccttcgcgtaccttcacccgtggaagacggcgtccactgtgcagcgctaccagcttggattcctcctctcagcgct

SEQ ID NO: 4444 - DNA, 449 bp, Zea mays
  Clone ID: LIB3279-008-P1-K1-D4
caacaagcaggaccagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaag

SEQ ID NO: 4445 - DNA, 453 bp, Zea mays
  Clone ID: LIB3279-008-P1-K1-D5
cgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggctccaacccaccccatcaggctcgggcttgctctcaacttctcagtgttctactacgagatcctcaactcccctgaccgtgcttgcaaccttgcaaagcaggcctttgatgaggcaatctccgagctagacagcctgggagaggagtcctacaaggacagcactctgatcatgcagctcctgcgtgacaacttgaccttatggacttccgacaccaacgaggacggcggtgatgagatcaa

SEQ ID NO: 4446 - DNA, 457 bp, Zea mays
  Clone ID: LIB3279-008-P1-K1-D6
cctgccaccgccgacgccgcgccgccgcagcaactgtcaccgtcgctatggcccgtatcaaggtgcacgagctccgggggaagagcaagacggacctgcaggcgcagctcaaggagctgaagtctgagctctccctcctccgcgtagccaaggtcaccggcggcgcacccaacaagctctccaagatcaaggtggtgcgcacctctatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctttctctgaagacggagagggaaaagaagcgtgagaagtacttccccatgaggaagtatgctatcaaggcataggtcagaactgtgagatgctgtgctttgcatatcatcgg

SEQ ID NO: 4447 - DNA, 319 bp, Zea mays
  Clone ID: LIB3279-008-P1-K1-D7
ctgacgcatgagctcacggcggaccattttatcgactaccagatcgacgggtccaagggggtcttcaatatcttctgcaacgacctaaactagttcttcacgaccaacttgctgtacactgtcatgcacttgcttttgaaaaagtatacagaggctcagctcgacgacaaaatcaacgaggtagatgctgatgtaaacgacatcattgatgtgcgagataacattaatcttatggctacgaagaataaggtcaccgtctctgacgaatagctcatggatgccttccgtatgtttaacaactaccaatacggattcattt

SEQ ID NO: 4448 - DNA, 450 bp, Zea mays
  Clone ID: LIB3279-008-P1-K1-D8
cccacgcgtccgattcactcgccttgcgcttcctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaa

SEQ ID NO: 4449 - DNA, 409 bp, Zea mays
  Clone ID: LIB3279-008-P1-K1-D9
caacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctctacggcttcggcggctaggctaggccggtcgcgcctcgttgtcgtcgctgcggttctattgtttttg

SEQ ID NO: 4450 - DNA, 450 bp, Zea mays
  Clone ID: LIB3279-008-P1-K1-E1
cccacgcgtccggcctctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagattggcaagaggcaggtcatgatcaggccgtcatccaaggtcatcatcaagttcctgacggtcatgcagcgccatggctacattggagagttcgagtacgttgatgaccaccgatcgggcaagattgtggtcgaactcaacgggaggctgaacaagtgcggcgtcatcagccctcgctttgatattggcgtgaaagacatcgagggatggactgcaaggctgctcccgtccaggcagttcggatacatcgtcctcacgacttcggcaggcatcatggaccacgaggaggcccgccggaagagcgt

SEQ ID NO: 4451 - DNA, 448 bp, Zea mays
  unsure (1)..(448): unsure at all n locations; Clone ID: LIB3279-008-P1-K1-E10
cttgccttcagtcgactggtgcaccggacagtccggtgcaccaccggacactgttcgatgcagatctctttcctattctggcgcgaccgaccgttgaagatttggagccgttggcgcaccggacactgtccgatgcacaccggacagtccggtgcctcatcagaccgttggcacggccatgcgtcacgcgcggattgcgcggccgaccgttggctcggccgaccgttggctcaccggacagtccggtgcactaccggacagtctggtgatttatagccgtacgccgccgttctgttcccgagagcggccagttgatcagcgccagcctggcgcaccagacactgtccggtgcacccagactgagcagagtcttggctgctcgagccaaggcttttccatttatcttttctctgattctagcactntgacaaatatgttagtacacaaa

SEQ ID NO: 4452 - DNA, 449 bp, Zea mays
  Clone ID: LIB3279-008-P1-K1-E11
cctcgccgctgttccccgcaacctatagacccaatctcgtccgacccggcgcgtcgtcccctccagatctccgtcgccctctccaggtagcagaaactgttctgcttcagtctgacaaagtggagggcttaggagtttctgcttcttttatgtctgaacaatctttgctttatttgggattgttgggagagtactctcgtgcaacgaggaaaaggcacaaggttccgttccactgcatgcgtcaagagcctgtctggttttcttgttctgatttgtcatttgctggtgctcaaagccggcttggtttcctcgaaggatcagcatctactcttgattgtggactttgtcgcatctgatatcaacttcataaatctttatccaagatggcgctgcaaaacattggtgcttcaaacagggatgatgccttctacaggtacaagatgcccaga

SEQ ID NO: 4453 - DNA, 430 bp, Zea mays
  unsure (1)..(430): unsure at all n locations; Clone ID: LIB3279-008-P1-K1-E12
cacatctcctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgccaagctcgcgcgctataacaagaagcctaccatcacctnccgtgagatcc

SEQ ID NO: 4454 - DNA, 429 bp, Zea mays
  Clone ID: LIB3279-008-P1-K1-E3
caaaaataggaggccggaggcgggcgaggaacgtgaataaaatatcattcggagaaacaagagaggccggggaatcgcgtcggaattccggcgaatcggcgggatccggccgggatctgcgcgccggatgaggggtcggcaccatgaaatggtccacattactcagtaaggtcgtcttcgccggcggccagcagcagcagccgccacctccgccgtcgccgccgccggagtctccgttccacggccagcaggtggtccaggacctctccaccccgaggctcagctccgcctccaccggcggtgacgagggcggcttcgacgcggcggccgggagctcgccctctgccgctgcgtcctctgccagggggagaaatgaattggagtcgaactttaggagattatgggaagaatttcgctcttccagctctg

SEQ ID NO: 4455 - DNA, 453 bp, Zea mays
  Clone ID: LIB3279-008-P1-K1-E4
gacgacaaaacgttttggaggccaaaagttcttacagggattgcaactggcaatagaatcagggaattgtggcaaggacaccattgatatgctgttgaaagatgctgattcctctgataaaataaacaggacgtcctccatcaaatctgccagctaattattatctggtcgatactgattcgatgcccagtcggaatatttatagggttttcattacaagtaaatatgtaaatagctgcagccttttgcttgcaggaagtgcattttgtttaatttgtaagcttgcgcaaaatgctagtagttgctactacgtaggaacctaggtcatgctttaattttgtggtttcgctttgtgaaacgagaatgcaacacgtaataaacgaaaaacaccggttggctttacaatgtggacttgtaacttaaggccgtttggatcttgtcatttttagagga

SEQ ID NO: 4456 - DNA, 298 bp, Zea mays
  Clone ID: LIB3279-008-P1-K1-E5
gaggaatcataaaagcatatggaggaactatgtataggctacaaagatgcatatgaagcatggtatagcaaaagccaagtgttctgatgattttgtttttttaattgggttttctgttattggttcagcatgctcatatattgccccagcaacaagtcgatgaagaatgccttactcttctacggcgagatcctaatatacatagtcatttggggccgcgggtctaggggatccaagcttactttcctgtgcttgcgacgtcttagtttttttattgcgtcacctaaatcaaattcat

SEQ ID NO: 4457 - DNA, 448 bp, Zea mays
  Clone ID: LIB3279-008-P1-K1-E6
ctgcaattcccggcgctgatgcggcagtggccatcgccgccgctgatcccggcgtccacgctgctccccgtgccggccacctcccaggaggacgaggtcctcctcgccatggccgagtccgacctcgaggacaagttgaatgagatccggaagaccaacagccacctgattatcatcgggaagcccacaggcgacaccaaggaggagtatgacgctgaggtggaggacgacgatgcagacaacgtcgaggagtctgatggcgatgacttcgaccaggagactggttgacccaggcggctccccgctccccccctgcttcgccggcatccttgagcgtcgccatccccactgcccagtctgtatttcgcaatccctgagtcgctcctgctatctagatgttctgtgttaccctaatctgctgctgctgtctgttctaggatttgagcat

SEQ ID NO: 4458 - DNA, 388 bp, Zea mays
  Clone ID: LIB3279-008-P1-K1-E7
tgagtttgtgacagtggttttctctgtgccgccttttgcaggggaagggggtctgggttgcgtacaggcgaaaggcacgcgccgccgctgccgcgcgagcctctccgtccccatcgccgcgcagatggatccgtcgtcggagcccctgtacgcgcaggtcgagccgtacgactccgggttcctcaaggtctccgatgtccacaccatctactacgagcagtccgggaacccgcagggccatgcggccgtgtttctccacggcggtcccggagccggcacgtcgcccggcaacaggaggttctttgacccgcagttctacaggatcgttctgtttgaccagaggggtgcaggcagaagcactccccatgcttgtttagagcaagacact

SEQ ID NO: 4459 - DNA, 437 bp, Zea mays
  unsure (1)..(437): unsure at all n locations; Clone ID: LIB3279-008-P1-K1-E8
ccgtgcttctccgccgtcgaggccgcgtcccagtgcgaagagactccgactcagatggccagccgctgggtccggcccgaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaatatgttggggacatncatgacctttaaaagtactttgagcgcttggtgatg

SEQ ID NO: 4460 - DNA, 340 bp, Zea mays
  Clone ID: LIB3279-008-P1-K1-E9
cgccgttttacactcctcctccttcgacaacccgtcgcagtagcgtccgtctctggtgtccggctgtccggctctggactcccgacctcgacatcaggatctgcgcctcccgaccggtatgtgggggctctgaagaaggtgcagaaggatctgggcgcgtcggtgttcgagccgctggtgcaggcgtacgccgccgtcgggaagttccctgggatgtggcagcggctgaagatcgagaacgtggaggtcggggaggggacggcccagctgcttgactctatctgcgccgatcaataggtggttttcttttgtcctcgccgtttgtgttcgtctaaataat

SEQ ID NO: 4461 - DNA, 398 bp, Zea mays
  Clone ID: LIB3279-008-P1-K1-F1
cccacgcgtccggttgatttaggctgtttccctgtgcttctagtagcaagagtttttattcatagtattcctgtatggccaaactcaatgcaacaaactgaataaattacaagtgatgctgtttcgtcttgcatagattttgtatgttctgaaatgcatgggtactgaattacccccacagatatctctgttttggtctatgatgttatgttctcttgaaccagggttgtcgaaatggcagatcttgtccatactctcatgattctggctcattggtctctgcacctgtcacatctggaatatgctctcaagaaagcaaaagcacctcattgtgcgatacaaggttgcttcctgctgatggagattggcatattcttgtcgtgaatgacaaaaccctg

SEQ ID NO: 4462 - DNA, 361 bp, Zea mays
  Clone ID: LIB3279-008-P1-K1-F10
cgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaaccaacaaaggtcatttcatccttaagcacaagaatcctaagactggaaagtatgtt

SEQ ID NO: 4463 - DNA, 265 bp, Zea mays
  unsure (1)..(265): unsure at all n locations; Clone ID: LIB3279-008-P1-K1-F11
cctattcaatacttaagnatatcatttaatttataatcatgccangcntcatgggctggggctactttttcctcctccataatcacatattttctcccaaatatcaacccttttctgctgcccaaaaagacgtcttaaatggtgtccagtggcggtagcaaggaggcaaagtcgcccaaaaaggcctccaattcctctaaaactcattaaactgactgtccgtaataacctttttttctctttcccatttttttccatttttcat

SEQ ID NO: 4464 - DNA, 400 bp, Zea mays
  Clone ID: LIB3279-008-P1-K1-F12
gtggcctccagttgcaaggacctacaagaactcagggtgtttccatcagaattttatgttcctggtgcttctgcagtgacagaggagggacttgttgcaatatcgtcaggctgcccaaaactgacctctttgctgtatttctgtcaccagatgaccaatgaagcgctaattactgcagctaataactgcccaaatttcatcagatttagactctgtatccttgagccaaagaagccagatgccatgacaggccagccgttagatgaaggttttggtgcgattgtacgtgaatgcaaagggctaagacgtctgtcaatatcatgtcttcttacagacaaggttttcatgtatattggaaaacatgcaaaatacctcgaaatgctttctatagcatttgctg

SEQ ID NO: 4465 - DNA, 450 bp, Zea mays
  Clone ID: LIB3279-008-P1-K1-F2
cccacgcgtccgcccacgcgtccgcccacgcgtccgccaccagcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgccctcaagcgccagggtcgcaccctctacggattcggcggctgagaggcgctaccgccgctggtggccgtggcaaaagtcttgggtcgcggtcaagaaatcgagagt

SEQ ID NO: 4466 - DNA, 444 bp, Zea mays
  Clone ID: LIB3279-008-P1-K1-F3
cccacgcgtccgtgggcaatctctaacccaaaatattgcatcagatattattgaaatgggatgcatggggaaagaaaatagcacgtaccaaatcctttcttgaaccttcaacaacaaatccactcctctgcattcaatctattgctaatctttcagtcatcacactggttggacagtgtgttggtgtgtgtgcatcatgttccttctcacgaaggtcctgtttagtggtagtgcctgcatgttccactggatgattttcttgttttatcgagcatgacgcacttgatccttgcttgcatttctcatcaggtgctgggtgaatagatccctgtcgttctctatagacacgcgttctttcctatgtgcagtttatgtgcacatattatggctagcgcaagtgaagcctattatcaaattgccaaagtggttgcagagcggttacat

SEQ ID NO: 4467 - DNA, 418 bp, Zea mays
  Clone ID: LIB3279-008-P1-K1-F4
gcgatgcacatacttttggtctcatcaaagtccgtgaaccctatccttttggggtggacccaagctggcgtggaagtcggtctgagctaccctttctaaattcattaaagatgaagatgtctatactaatgggtgttgcccagatgaacctggggattgtattaagttattttgatgcacgatatcatggaaatgctcttgacataaggtatcaattcataccacagatgattttcctcaatagcctttttggttacttagcactcctgattcttatcaagtggtgcacgggctctcaagctgatctttatcatgtgatgatatatatgttccttgatcctgctggagatcttggagaaaatcaactgttttggggccaaaaggaacttcagatattgttgtacttctggctttgatc

SEQ ID NO: 4468 - DNA, 389 bp, Zea mays
  Clone ID: LIB3279-008-P1-K1-F5
ccctacctatctatcctacagcggctagtctactcaactctgctctgctcgcgcggcgatcgaggcaccgtcgtcgccaccatcagcggctagcaccgatcgagccaccggccgatcagatcggccggcccaacgaccatgctggcctcgctgcggtacctggccggcacggcggggccgagcggcttcggctcgcggacgaccgccgaggaggccgcggccggcgacctgcgccacgtcaccgccatcatcacgggcgccacgtcggggatcggcgcggagacggcgcgggtgctggccgggcgcggcgcgcggctggtgctgccggcgcggagcctcaaggccgccgagggggcccgcgcgcgggtgccccgccgagtgcccgggcg

SEQ ID NO: 4469 - DNA, 368 bp, Zea mays
  Clone ID: LIB3279-008-P1-K1-F6
ctcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttgtatgtgtatgtgtcctgctgcaagttgtcctttgctatttagaatggaagaagaaatgccttgtttc

SEQ ID NO: 4470 - DNA, 418 bp, Zea mays
  Clone ID: LIB3279-008-P1-K1-F7
gccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattg

SEQ ID NO: 4471 - DNA, 343 bp, Zea mays
  Clone ID: LIB3279-008-P1-K1-F8
cccacgcgtccgcccacgcgtccgcccacgtgtccgcccacgcgtccggagaggagcgacgtgtacagcttcgggatcctgatcatggagatcatctccggccgaagccccgtcgactacgccaggcctgccggagaggtaaaccttgtagagtggctcaagaacaaggtgaccaacagggactacgaggccatcgtggacccgaagctgccggagaagccgtcctccaaggctctcaagaaggcgctcctggtcgcgctgaggtgcgtggatcccgactcgcagaaacggcccaagatggggcacgtaatccacatgctcgaagtcgacgactttccgtatc

SEQ ID NO: 4472 - DNA, 376 bp, Zea mays
  Clone ID: LIB3279-008-P1-K1-F9
tgtatatccatgctactctaatctttctgcctatatgacagcatttttcatttccatcaactgctcttgtctgattaggctccatttgttgtctctttattgatttttggttgcaaaatagacagccttggatattatactgataagagtgtagaggtcacaattgtttcaagtttcaaccatagttgtacatgtcagaatcatctgttaattttgttcttgaatcttgacacgcttagaaaaattcaaggcatgcataaagcaaaacatctttgtgagtttgatcgttccattaacattcactaacaagtcatatttatatttaaatctttttccttgaagccagtccaactttcaacttcttggaatcattttt

SEQ ID NO: 4473 - DNA, 377 bp, Zea mays
  Clone ID: LIB3279-008-P1-K1-G1
gtggatctcaaaggctgagtacgatgagtcaggaccagcgattgttcaccggaagtgcttctaagctcaagggcccccttcgtccccattctatgtattcctttccttgagtgcttttcttataagctactatgtttgagattgccggcctttgagcaggcaatgttgttggatctgtatcttgtggatcactacaatgcatgcgttgctccatcttcttttcatgccaagtttgctgtcatacttgctagtggggaaaacaacaatgacaacagtggtgagaacagcaaccacaaaaaaagagaggatggaaattattgaagttcctaggatcgtattgtaactgtacttgtgcgagtaacattattggttctctt

SEQ ID NO: 4474 - DNA, 372 bp, Zea mays
  Clone ID: LIB3279-008-P1-K1-G10
gttgatgcgttttgcatttacctataccgttgctaatgggggagtatatagcctatggaaaaaaaaaaaaaagaaaaaaaaaaaaaaaaaaaaaaaaaaagggaaataataaaaaaaaaaaggacaggggggggccaaggtagagaaagcatttttaaaacagcgtggaaggggacgtagacaatgtgatatggggtcaactaaatgaaatttaatggcggtagatttacaaggaggtgactgaaaaaaaccgggggagcctaaaagaaatgggaggggattaaaagcaactttggccaggtggcataataaaaaaaaggccctcacaggccgaccatcaaaaaagttatataaactgaaggagggaatggg

SEQ ID NO: 4475 - DNA, 451 bp, Zea mays
  Clone ID: LIB3279-008-P1-K1-G11
aacatttcatatctcagaagtagcaactatgttgaacgtaggcatgaccttgacactcaagtgttgctaattgggcacttattgtactcaggcaaaagtggagcatcataatctggctggggcttcttgtgggtcatcttcttcagtcttgtcgcaacaggaattacaggatatgcaccgtacaagtatagggcccggaggtacatggattcagagatatgtgccatcatggctcactacatgagctgtacaaccaaggagagatccaaatccattctcatcacattgagatgtgacgcagtaggacacagactttgacgaagggagactaggacttgatctatattaagtaatagatcacttacatcagttctattgtattctatttttatgtatgctttttcatacacactgtatgcttttcgtacgatgcaagtgcatcggtccctat

SEQ ID NO: 4476 - DNA, 443 bp, Zea mays
  Clone ID: LIB3279-008-P1-K1-G12
cgaggagattgcttggttggagcctggaggagttggtgaggagaggtcgcgaacatggagaaccttgctctgctttggagcatcatcggcccgggcgtgtccggtgccatcttcggggccggatggtggttctgggtggacgcggtcgtttgcagcgcggaccaggtctccttcctccactaccttccagggatcttcgcttcgctggcggcgctcatgttcaattgcgtgaacaaggatgagatcggatacgactattactcaccctacggggacgattcatagtggagagtgaagctctggctctttgtggcatatgtcggttcttttgtctgtttagctggatccgtgggtttattggtgcaagatgccctgacgaacaagggcccatctgtctggactggtgttgctggcgttctgcaatgtgttcttgtgttgataag

SEQ ID NO: 4477 - DNA, 362 bp, Zea mays
  Clone ID: LIB3279-008-P1-K1-G2
ctcactcgtgcgggacgccgacgtcgaacatgccgaaggagcgcccagagtgagattggtcaagcaggtaattgaagctctatgagcacggggctaagttcttaaggctaacacctattccgaaaattgagaccgccttgaaacgcataccattgttctattgctgggctcatgttgagcaactgacaataccatagattcgctctacttatgccctgtttactgcaacacgcctcttatattcgatcacgagcgcaatgaatgctatgctgacctctgcactcattctgttacctcgtgtcttgagtggcttaaggaagaacgagccgctgcgtttcttactatgcgcacgcctcaagcag

SEQ ID NO: 4478 - DNA, 351 bp, Zea mays
  Clone ID: LIB3279-008-P1-K1-G3
tgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgtggatgag

SEQ ID NO: 4479 - DNA, 422 bp, Zea mays
  Clone ID: LIB3279-008-P1-K1-G4
cccacgcgtccgcccacgcgtccgcccacgcgtccgcccacgcgtccgcggaattctagaccgtccaagccagcttacccctggcgccatacatacgtcttaccaattgtatccatcacaccgacctaccgcaccccctccaaatccatttttgtttgtttgtttgtttgtttgttgttgttgttaagttatcctcctctgtgtagcatctcccgcgcgctagggctcgagtaggatggctgctatgttgtaccgttggctgtatatatgatttagtgacacctgtgaagcttgccatgtaatctgatagcgctggctccctccctcccctccgatcccctaaagctattgtataattgtatttgcttggctaaagcccgtaggaattgcgtattggtaacaagacgatatgatattatgtc

SEQ ID NO: 4480 - DNA, 456 bp, Zea mays
  unsure (1)..(456): unsure at all n locations; Clone ID: LIB3279-008-P1-K1-G5
ctcaagcaggtcggcgcctacgccgacgccgagaaggccaaggactccgtcggcatccgccccggcaagggtaagatgcgcaaccgccggtacatcaaccgcaagggcccgctcgtcgtctacggcacagagggctccaaggtcgtcaaggccttccgcaacctccccggcgtggacgtcgccaacgtcgagcgcctcaacctgctcgaccttgcccccggtggccacctcgggcgctttgtgatctggaccgagagcgcgttcaagaagctcgaggaggtgtatgggagctttgacgcgccgtcgcagaagaagaagggctttgttctgccgaggcccaagatggccaacgctgacctgggcaggattatcaactctgacgaggtgcagtctgtggttaagccactcaacaaggaggtgaagcgcanggagaagaggaagaacccgctcacgaac

SEQ ID NO: 4481 - DNA, 287 bp, Zea mays
  Clone ID: LIB3279-008-P1-K1-G6
cgtcggtgagggtatggaagagggtgagttctccgaggcccgtgaggacttggctgctcttgagaaggactatgaggaagtcggcgcagagggtgcagatgacgagggtgacgagggcgatgactattgagtagccggataataattagttcgctggtgcttaatggttgagttattttgagtatactctgtatgggtccactccattgcgtgctgctgctgtgtgtttccattttgtattttgtgataaattggtcgtagccccctattggccatgattgttgttc

SEQ ID NO: 4482 - DNA, 440 bp, Zea mays
  Clone ID: LIB3279-008-P1-K1-G7
attaggaatagcaccctgagtactagaatgtactcagctagactgacccgtccaaaactaggaaataagaaagtaaaagactccaacgattatgcaaagctatatcaggagttggctctttactttataagggtaacgagagttaatgaaattgttagcaacttaaagggttaccaagttcattataccatttttagcagatcagtatttgtacctattccgctgcagaactagatttgcatctgattctctaagtactcatcttcagttttactataagcctagttgtagctgtaatgaagaatcaagttaaggaagattgttcataattatcacatcaagattaacccatcccctgaccatagttgggagcaacatcatttcttattcctatcatcaagcttatagaaagtgtagttattaatatgatgagataactc

SEQ ID NO: 4483 - DNA, 443 bp, Zea mays
  Clone ID: LIB3279-008-P1-K1-G8
gacgaaagcttggtggactcagggttctcaactcctactgggtgaatgaggatagcacctacaagtactttgagatcatcctggttgatgtggcccacactgccatccgcaacgacccaagaatcaactggctatgcaatcctgtgcacaagcatcgtgagctccgtggtctcacctctgcaggcaagaagttccgtggcctgcgtggcaagggccacactcaccacaagaacaggccgtcgaggagggccacctggaagcgcaaccagaccctgtccctccgccgctaccgttgagcacacacatcttgaattcttgatgctctgctaccgtggaacccgccccatgcaggctctgatagtatttggtatttttgttgcattgttaaattttgctacccgtgttccttccgagccccttgaactgtgttgtcagtgtaccgt

SEQ ID NO: 4484 - DNA, 372 bp, Zea mays
  Clone ID: LIB3279-008-P1-K1-G9
cggacgcgtgggcggacgcgtgggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgccttctacggcgagatcctcgactccaaggtcatcaccgaccgggagacggggaggtctcgcggcttcggcttcgttaccttctcctccgagaactccatgctcgacgctattgagaacatgaacggcaaggagctcgacgggcgttacatcaccgtttaccaggcccagttccgtggcggtggcggtggcggtggtt

SEQ ID NO: 4485 - DNA, 361 bp, Zea mays
  Clone ID: LIB3279-008-P1-K1-H1
gtggctcttaaaggctgagtacgatgagtcaggaccagcgattgctcaccggaagtgcgtctaagctcaagggcccccttcgtccccattctatgtattcctttgcttgagtgcttttcttataagctactatgtttgagattgccggcctttgagcaggcaatgttgttggatctgtatcttgtggatcactacaatgcatgcgttggtacatcttcttttcatgccaagtttgctgtcatacttgctagtggggaaaacaacaatgactacagtggagagaacagctaccacataattagagaggatggaaattattgaagttcctaggatcgtatttgtaactgtacttgtgcgagta

SEQ ID NO: 4486 - DNA, 442 bp, Zea mays
  Clone ID: LIB3279-008-P1-K1-H10
gggaggtttgccccaatggcgcgcttttgggtatgatggttgaataaagtgcctttagggatgccatcttaaaggccagtgcattgttgaaccatttgaaaaagttaaccagggtcatttggttggtccaccccaatttgaggcaaagtggcagcctaattttttggagactttatcaggtgaaagagaacatcaacacccagacacatcaacttatagatgctcgatcaaaacctagatttgatggtgcagttcccgagccacgaaaggggattagaagtgggcatgtgcctgggagcaaatgtgttccgtttcctcaggttcttgacagctcacaaaagctattgccttcagatgagctccgtaaacggtttgagcaagaaggaatatcacttgatcagcctcttgttacctcttgtggcactggtgtgactgcatgtgt

SEQ ID NO: 4487 - DNA, 326 bp, Zea mays
  Clone ID: LIB3279-008-P1-K1-H11
gcgcaggctgaagaaccagtacagggcaatctctgctgcggccctggggcaagtgggcggccgggatcagagacccctgcaagggcgtccacttctggctcgccacatacaggacggttcattttggacgccgacggccggaggcacacggtcgcggtactcgtgagatgaaagccaacctaagtgctcgacacgatgctgcggcccaaagtgctcaaaatccaccttttgaatctactacatctgatatcaccatcgcatacaggctagctcctccaccttcaccacctaatttccgtgctgacgaggttgtcggtaacatggac

SEQ ID NO: 4488 - DNA, 450 bp, Zea mays
  Clone ID: LIB3279-008-P1-K1-H12
gtgattctggtgaagaaaagggcaccgatcctcgtgtcgtaccagcaaaatgcccattcggctatgactccaacactttcaagctgggtccgcttagctgcattgtctgccaggcactactccatgaaagtagcaaatgcaagccgtgtgcccataaattctgcaaggcatgtatatcacgctttaaagactgcccactatgtggtgctgatatagagggtattgagcctgatgcggaacttcaagctcttgttgaccgcttcattgatggtcatgccagaatcaagcgatcacatgctgcaggggatgtggaagcagcagatggcaagaacaaagtcatatatgaggatgtttccatggagagaggggcttttctggtgcagcaagctatgagggcttttcgtgcccgaaacattgaaagtgcaaagtcaaggctcactatgtgtgcag

SEQ ID NO: 4489 - DNA, 416 bp, Zea mays
  Clone ID: LIB3279-008-P1-K1-H2
cggacgcgtggggcgtcatgaaggccgccgacgcgctcggcttccccgcctgcgtcaggtcctgcctcgactacctggaggccgtcccgtgggccggggaggaggaggagcgccgcgtcgtgtcctcggtccgccgtctacagtgcacggacggcgccggagtcagcccgctgctgaggagggtcgcctcctccgactccggctgtctgagaccgcccgccgacacgttcgcgcacataacggagatggtgctggcgagcaccgacgagcggggccggcgcgagacgaaagccctggtcttgagcctcctgaaagacagcactcgcggccacgtctgcggcggcggcggcgccgacggatcaccaccaacaccgggcatcttctcttacgagacgctgtacagctcgtgccggggc

SEQ ID NO: 4490 - DNA, 230 bp, Zea mays
  Clone ID: LIB3279-008-P1-K1-H4
cacacgttcgcagatgttgccatggcaatcaacccagcagaccagatcatcgcggtgcatgtgcgaccaatctttgagcaagtctacagccaattggcccaccaacggacactccccaccacgaccgcatcagatggcaccagtatccgtgtgatcatgcatgtaattaactcggttctgcttagctacaagtgattgcagctatgcaactgtgggaagaatgggccctt

SEQ ID NO: 4491 - DNA, 453 bp, Zea mays
  Clone ID: LIB3279-008-P1-K1-H5
gcgcaggcggaagaaccagtacaggggaatccggcggcggccctggggcaagtgggcggccgagatcagagaccccagcaagggcgtccgcgtctggctcggcacatacagcaccgccgaggaggcggccagggcgtacgacgccgaggctcgcaggatacgcgggaagaaagccaaggtcaatttccgggacgaagcggcggcggcaggtgctcagaagccaccagccgcaactactccaactgcttgtgccagcgcagcgaggctagctcctccacctccaccgccgaagttccgtgctgacgaggttttcgggaacatggacggtggcagcaacgatctgttcgcgatgctggcgttcagtgacagtaaggtgaaggtcgttcgtgtggagccaggtgagggcgccgccggtttcctccccgcagtggaagaagtgttggtcgacgagcc

SEQ ID NO: 4492 - DNA, 413 bp, Zea mays
  Clone ID: LIB3279-008-P1-K1-H6
ccagccggagctggggccctggcaggccgcgctgcagggcggcctgctcgaggccggggtcgcgccggacaacggcttcacgttcgaccacttcgacgggaccaaggtcggcgggtccatcttcgacgccgacggccggcggcacacggccgcggacctgctgaggtacgcgcgcgccgaggggctcgacgtgctgctacgggccagagtggccaagatcctgttcttcaatgtcagagggaggagatcagggaggcggacagcggcacgcggcgtggtgttccacgactccgaggggcggatgcacaaggcgttcctcagcgcgggccgccggaacgagatcatcctctcggcaggcgccatgggcagcccgcagctactgatgctcagcggcgtcggcccagccgaccacc

SEQ ID NO: 4493 - DNA, 442 bp, Zea mays
  Clone ID: LIB3279-008-P1-K1-H7
cggacgcgtgggcggacgcgtggggtgtcgacgactccagggtttcgcgtacctccccggcggtgtgtgcgtgtcgagcatggggcggccggtgtcgtacgagcaggccgtggcgtggaaggtcctgagcgacgacgacacgccgcactgcctcgccttcatgttcgtcaactggtccttcgtgtgagtgaggaccggccccctagcagagccagccagtcgcgcgcgcccgcccgcctagcatttgcagctgttatttgttgaactctgtatccaagtactggtcgctcttgcctttgtccaggcaatcctgtgaaacgcacctgccccccagttcatgcggggaacaaacgccttttgtagttgcttgcctgctatgttatgatggatcctggtctgctgcatcttctaaaaattggcttggaacattgagtgcgtcccc

SEQ ID NO: 4494 - DNA, 328 bp, Zea mays
  Clone ID: LIB3279-008-P1-K1-H8
atactgagcactatgctgtgaaacgaaacaagggagagacatgcatattactaacagggacttcagcgataacaccatacatggtgcagaaacaacaggcacgagactgacacacgcacctataacaataagaaacacatcaagaagagtctgggctgtctcaagaggagccttagtaactctaatatgcaactactacccaaaggtgcgatgctttcaacacatgaggagctaaaagaagtgactaataaccactgttatctaataactggacgtacttgatgtaaagcttacagaggaacactccaggaccatacagaggacgcgg

SEQ ID NO: 4495 - DNA, 344 bp, Zea mays
  Clone ID: LIB3279-008-P1-K1-H9
cgccgcctccgcccgcttgcccgccctcccgtcggctgccttccggatgagaagcggcgcaacctgggcggtggaagcgtggtcggactgagccttcgtgggggttagcgccgagaaggatcctggagattaagcgcatgggttccttggaggcccggtacaggccgaccggggcagctgaggacacagctaagagaaggacccagaaaagcaaaagtttcaaagaggttgagaaatttgatgtttttgtgctggagaaaagttctggttgcaaattccggtcgttgcaacttttgctcttcgctatcatgtctgctgcgtttctaacactcctatacacacca

SEQ ID NO: 4496 - DNA, 190 bp, Zea mays
  Clone ID: LIB3279-009-P1-K1-A1
cgttgagcagcaattgaacactgatcatgaagggccattcggatcgcgagtgagtccaaaccggcctgccagttcgaagaaggccattggcccaaagttgaatggcagcgtctcaaacggcactcctccaaacagaaggctctcaatcagtggccaacagaacggtggtggccatggcgtcaggtctgga

SEQ ID NO: 4497 - DNA, 302 bp, Zea mays
  Clone ID: LIB3279-009-P1-K1-A10
atagatccttaatgtatctgttagtcgtttcgtttgataccaaatttataggagggcggttaaatttggtagtttgctgggtattccgtcgcgagaactcaaatctctctctctctctctctctctctctgtatatattgaatattatgagtcatgtgctttcaataactaaagaaagttcaggtcagacagtgtcatccagtcgagccagaccaggtccgggcgtttataaaagaagacccggagtgctagagttcagtttttgacaccccacccctattcacgagccacagcgccaccaa

SEQ ID NO: 4498 - DNA, 307 bp, Zea mays
  Clone ID: LIB3279-009-P1-K1-A11
cccacgcgtccgctatcttatctccttgtaggtttttcattgttttgggcagtactggtgcttgcactttgaggcatttcagcttgggttggcaccagtatacatggctttcctacgatttatgggtgacgaaaatgattctaggaattacagctatagccttgaggttggtgcaaatggcaggaagatgatatgggagggaacgccccgcagcatccgggacagccaccggaaggttagggacaggcatgacggcctaataattcaacgcaacatggctctcttcttcttaagtggagataggaaa

SEQ ID NO: 4499 - DNA, 282 bp, Zea mays
  Clone ID: LIB3279-009-P1-K1-A12
attgcaacacatcgagcatcatcagtcaattcaagctcagtcgacaataacaaggtggcgtctgctaaatgtgagacctcgtgcatttctgaccatgccaatgagagcccagaggatggagaaacgaccagcaaagctaagcagaacaaagcaactcgccgccgagtgaggaagagttctgatggcgacaacgatagcagaagtgggtccgtggtgacatctgactgccaggatgatcaagccaacaaggatgctgggtgtgtgactccgtcgactaagcca

SEQ ID NO: 4500 - DNA, 128 bp, Zea mays
  Clone ID: LIB3279-009-P1-K1-A3
cccacgcgtccgtttcgcgtttagaacctctaaaatttcccccactcgccagtcgcagcagcacctgtagccatggacgccagcggagccggtagcaaggggaagaagggtgcggccgggcgcaaggc

SEQ ID NO: 4501 - DNA, 383 bp, Zea mays
  Clone ID: LIB3279-009-P1-K1-A4
aaagctgggcatgtactcctacaagaggcagtcggctccgtggtcagaagatgagctgggctctctttggatcggggttaggaggtaccgcatgaataactggaatgcaatgctgatggacagtcggctgcggttctcaatctcaaggatgcccgaggaccttgctaagcaatgggacaaggagcagaacaaacttgagggtcctgcgcaagctgactgctatcttggacgagctttttgctgtcgatgctcaaagtctggatgtggcgggggccaagcccaaacgggcctttcattgggcgaatattaccttggtagagcttcatgctcttgatgctacaagatcttagttcttggggcccagacagaccttttattgggcg

SEQ ID NO: 4502 - DNA, 372 bp, Zea mays
  Clone ID: LIB3279-009-P1-K1-A5
gtaaggcatactgaaccgctgttttcgtacgcaagctcgacttgagtattgtaaggagggcggtgttcatgtctgatccagttcaaatgaagtggcaggaaccattccagagatgaatggaggcgatcatcatattacctcgaagctcttttcatgtttagtgaaggtctatgacatgtctgatcgtcaaatgaagctaaatgattctatttcaagccctgttgttgaggaaaaggataatctcaccaaaggcatgaccctatatccttcggtcctgctgaaaggacgctggtttattggctagcaaatgtcttttctatcacacaagcaccctaaaacatattcctaaaagcaaatggattttgaattata

SEQ ID NO: 4503 - DNA, 297 bp, Zea mays
  Clone ID: LIB3279-009-P1-K1-A6
caaaggcccgaccctgcttgaggctcttgaccagatcaccgagcccaagagaccttcggacaagcccctgcgtctccccctgcaggatgtgtacaagattggtggtattggaactgtaccggttggtcgtgtggagactggtgtcatcaagcctggtatggttgtcaccttcggtccaactggcctgactactgaggtgaagtctgttgagatgcaccacgaggctcttcaagaggcccttcctggtgacaatgttggcttcaacgtgaagaacgttgctgggaaagatctcaagcg

SEQ ID NO: 4504 - DNA, 337 bp, Zea mays
  Clone ID: LIB3279-009-P1-K1-A7
aaaccccaagccgcgccgcaatagctcgccccctcgttcgccgcctctcctgctcctaccgcagctctccctcaggtttagtgttcgcaatggcggccttcaacaagcttggtggccttctaaggcacagtgctctggtgagcggtatcactggtggctcttcttctgcagtgttcaatgctgcacggctcatgtctaccaagctatttattggtggtcttgactggggtgttgatgacctgaaacttaaagaagcctttatcagctttggggaggttactgaaacgggggtgatcacagacagggggactgggaggtcaagagggtttttcttttt

SEQ ID NO: 4505 - DNA, 227 bp, Zea mays
  Clone ID: LIB3279-009-P1-K1-A9
caggcactgtcacacagacacagctgacctgccactgccaggaaagtaggtcgaggaggccccgcagcggcttctcggggtccttcaggtcgcccaagatcgacgtcgtcatcgacatgggaaaccccttccttaaccgcgaccgcgacggctttcttaagatcggcgccctcggcgcctgcaagggggctggcgaggagaccttcgagtggcttcacaggggggat

SEQ ID NO: 4506 - DNA, 154 bp, Zea mays
  unsure (1)..(154): unsure at all n locations; Clone ID: LIB3279-009-P1-K1-B1
cccagcgtncgngaaagggattgtcaggaggacttggaagcagtcattacatgaagactttatgtcgacaattccttaaggtagcaagccaacactgttggaccatacacacttggacctcctttgcgcgtctgacgctgtaacaaactatgtt

SEQ ID NO: 4507 - DNA, 302 bp, Zea mays
  Clone ID: LIB3279-009-P1-K1-B10
cccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggcctggtggactccggcgtcaagtccatcccgtccatcttccaccacccgccggaagccctgagcgacataatttctccggcgccggctctgccggcgtcgtcgcccttcggcgccggcatcccgggggtggacctttcggtgacgcggcgcgaggacctagtc

SEQ ID NO: 4508 - DNA, 108 bp, Zea mays
  Clone ID: LIB3279-009-P1-K1-B11
ccaaaatattttactgagaacacatccaaacaaaaaacagtgctggtgtcctttttgcatgcatgccttttgggactggacatgggaccaggttggtgactatgatct

SEQ ID NO: 4509 - DNA, 437 bp, Zea mays
  Clone ID: LIB3279-009-P1-K1-B12
agaagcttccccttccgtctccatatcttcttcttggttcgccgcctccactccgcgttccctgcgttgtgtcttgggggagagagagaagtgggagacccgcgagaggctgccgtgtcgggactagggaccgtagagtaagcgacagcgaaggagggagagggggatggccgggatcgggccgatcaggcaggactgggagccggtggttgtgcggaagaaggcacccaccgccgctgccaagaaggatgagaaggccgtcaacgccgcgcgccgcttcggcgcggagatcgagaccatgaagaagtacaacgcttgtatgaacaaggcggcgttcagcgggacattcctcaacaccaagcgcctcgacgacgacacaaagaaccttgcccatgagcgagtttcaagtggcctggaaaaaaatttcatgccagcca

SEQ ID NO: 4510 - DNA, 231 bp, Zea mays
  unsure (1)..(231): unsure at all n locations; Clone ID: LIB3279-009-P1-K1-B2
acaccgcgtgcgaaccaagcagaccccagcagaagaagcgaagtcgtcgccggagcaggaggaagagcgagcagcaagatgtcntggcaggcgtacgtcgatgaccacctgctgtgcgacatcgaaggccagcacctcagcgccgccgtcatcgtcggccacgacggcagcgtctgggcacaagccgagaacctccccgaggtaaagcctgaggagggtgctgggatgata

SEQ ID NO: 4511 - DNA, 382 bp, Zea mays
  Clone ID: LIB3279-009-P1-K1-B4
caaactgggtgcagcagacagatatggtgtacttgatgatgcctatgccctctgtatgggtggcaaacaaaagctagtctccttgctgcatttgatttctgtgtacaaggatgagactgagtatactgtgcttgcacacataatcacgacaagtctgcacattgccgagatgatggctattgctgctccagaggagttggttcatctgaagaagttcctaattgatttcctggagccatttgcgctgaaacttggctgggatgctaagagtgacgagggccatctgaacgctttgttaagaggtacactcttaaccgctctggcagaacttgggcatgaggctaccataaatgaagctggtcggcgatttaatgtctttctg

SEQ ID NO: 4512 - DNA, 332 bp, Zea mays
  Clone ID: LIB3279-009-P1-K1-B5
ccgcgccaacgagaactactgcctggccgtccgcgacggcgccgtcgtgctggccccggtgaaccccaaggacgaccaccagcactggtacaaggacatgcgcttcagcacccgggtcaaggacgaggaaggcatgccggcgttcgcgctcgtcaacaaggccacggggctcgccatcaagcactccctcggccagtcccacccggtcaagctcgcgcctttcagcccggaccaggaggacgcgtctgtgctgtggacggagagcaaggacgtgggcaagggcttccgctgcatccggatggtcaacaacacccggcttaacttcgacgcct

SEQ ID NO: 4513 - DNA, 351 bp, Zea mays
  unsure (1)..(351): unsure at all n locations; Clone ID: LIB3279-009-P1-K1-B6
cccacgcgtccgaacagataaagcttttttcaacaatgatcagctgtgcctaaagccgcaagcaccacagccggagaaatcctctcgtgtggtctcttcagctctcagacggcaagacgatgctgccgccgaggtccgccgccgccgcgccgtgctcggttgcaggacttctgttccaccgattctcatcctactcgtcctcttctgtctattctgtccgccaccacgcctngtttgctttttcctccaagccttccaccggcccaaccacaacttggtctttttcccccaattccagcagccgaaggatcagggggtttgcggcctgggcttcggcgccggggccggcgg

SEQ ID NO: 4514 - DNA, 113 bp, Zea mays
  Clone ID: LIB3279-009-P1-K1-B7
cttttgtttttatcttcggagatcttttattagcgctatgacaactggacaagtgggggtttgtttgtgctgcagatgctggtgttctaggatgcatttgattaatagacctg

SEQ ID NO: 4515 - DNA, 152 bp, Zea mays
  Clone ID: LIB3279-009-P1-K1-B8
gagggagatcagcgaggcccacgacaccattcgcttcggcatcaacgccggcgtaaagccgacctcgccccgccggacccgctccagtctaccatccaatcggagaccaagttctgggcggacaagaagaagttcgggacagatgccatata

SEQ ID NO: 4516 - DNA, 70 bp, Zea mays
  unsure (1)..(70): unsure at all n locations; Clone ID: LIB3279-009-P1-K1-B9
gcaaacactgcatcagaccctaacagctgtcgctgctaaaccagccttcactggagagngttcacatact

SEQ ID NO: 4517 - DNA, 134 bp, Zea mays
  Clone ID: LIB3279-009-P1-K1-C1
agcaggaccagctagctagctcctcccactgctatcacccgggccccggccagccatctggctgaaagagaaaagcgcagccatgaagactactagctcgggcattgcagtcgtcctcctggggcgatgctgca

SEQ ID NO: 4518 - DNA, 427 bp, Zea mays
  Clone ID: LIB3279-009-P1-K1-C10
cggacgcgtgggcggcgatggcggcgacgatccaatccgtgaaggcgcgccagatctgtgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgggtcaatagctgtttgcaaagctggggcttgcattaagaggatttctttata

SEQ ID NO: 4519 - DNA, 419 bp, Zea mays
  unsure (1)..(419): unsure at all n locations; Clone ID: LIB3279-009-P1-K1-C11
cccacgcgtccgggaggctggcgcgcaggggcggcgtgaagcgcatctccgggctcagctacgaggagacccgcggcgtgctcaagatctttctcgagaacgtcatccgcgacgccgtcacctacacggagcacgcccggcgcaagaccgtcacagccatggacgtcgtctacgcgctcaagcgccagggccgcaccctttacggcttcngcggctagggcgctaggctaggccatgctcgacccgccccccactctccgctctggcgtcgtcactggttccttgacccctgtgcgggtcggtcggtggtgctagggtcagcaagtgtctgggggctgtagcctntcttgctattcggtctttgggggggaaagggaatttcaaatcgggggaatggggagggtcttttttggtttgtc

SEQ ID NO: 4520 - DNA, 159 bp, Zea mays
  Clone ID: LIB3279-009-P1-K1-C12
cggacgcatgggatgaagcacaccctggagatcatccacctgctcactgacgccggtgctatccaggtggtggtggacgccattatcaacagtttaccacgtgagtatgccacccgtattggtacacctggtattgcttgaacgcgaccttttacattt

SEQ ID NO: 4521 - DNA, 259 bp, Zea mays
  Clone ID: LIB3279-009-P1-K1-C2
ccgacgtgagttcccgatctcagctttgagtggacttctttttgaaagtgagcacagggtgttccaaagcccgtgtgtgttcgtgtagatcgcatgtggcgggggaccggaaagaagaagatcctttccacccgtggcgtgcttgagtgcagaaacggcgcacatcctggtggccttatgaagagaagggcgggtcgggagcacattattcttcttagagccaagcccaacatctcaggcgctgtagataaagacatgc

SEQ ID NO: 4522 - DNA, 192 bp, Zea mays
  Clone ID: LIB3279-009-P1-K1-C3
ccatgggatggcgcactggagcttggtaatcatttgcattcctgcaaaagagagtatttcaggaccaatcatacttcatctggactccctagcgatgcatcccagtactaagatcttgaacacagttgagagataccttgaaaaagaatggtgccaattatcatcatgggaggattttaaaaataatataca

SEQ ID NO: 4523 - DNA, 349 bp, Zea mays
  Clone ID: LIB3279-009-P1-K1-C4
tgtatctctgctatgtgtattgcctgcttgttatatttaaccagcgacattgaaatttcttgggaactcttgtaatatttttttgtttctttcatttattttctaatattcttttattgtgcttacatgtgtcacctggaatatgtagttcttctgctcagaaatatttcaggagggcaacacgtttaaattggcctgaaggtgctgtttcaagagaaagcatcagagctgtgaagaaactggatcgactaaaggacttggtatcgaggaacgctggccattcgaaagccgagctggcagacttgctatacagtatcctacggttcgagccatcagaacgtctgacagc

SEQ ID NO: 4524 - DNA, 64 bp, Zea mays
  Clone ID: LIB3279-009-P1-K1-C5
cgaaggggctattgtattactattattatatgttcgtcgatttgattgctataaattgagtgat

SEQ ID NO: 4525 - DNA, 312 bp, Zea mays
  Clone ID: LIB3279-009-P1-K1-C6
cggacgcgtgggtgcgtacggaattgtctgaaaaatttgatcatgccataaagggtgtcagtgccaaacttgaggagcagagagttgagcgcatttctcagctagaagagaacaatacgttgagaagtaaactgaaagaccttgctgatcaatataacattactcagcagaaatatgctcaccaattgaaagagaaaatgctggaacttgagcttgctgatctgagacttcaacaacatcaagagaaggctgctcaggaacatacacaaatgcagttgtatgctgagcaagtttctcagcttatgactactg

SEQ ID NO: 4526 - DNA, 237 bp, Zea mays
  Clone ID: LIB3279-009-P1-K1-C7
tgagcttatgttcctatatgactactagctagaagttagagcctagatgatggctgcttctgttggcgtgcaagctcgagtgctcctaaatggtcgtcgtattagctgatacgacatcgacccgatgcaatagataatattttttacacgcgcgagtccaaaattgttggctttgggtcggagcagttaacgagagaagtgtattttatcacttgtgagtgcaaccttttttatttt

SEQ ID NO: 4527 - DNA, 467 bp, Zea mays
  Clone ID: LIB3279-009-P1-K1-C8
gcaacagatgcttgcttgcctcaggcagcgatggcagaggcaccccttatggctcgagtgctgataaactatgagcttcccacaaagaaggaagcttacttaagacgcatgtcaacatgtttggcggcagacggaattgtgattaacatggtcgttggtggtgaggtggttacactcaaggctttagaagagaacagtggtctgcttattgctgagatgccaatacatgtttcagaaatattatgaccgttccagttgtacaacatttcaaaagttactgttctgattgcacactaactactcatgggttacttctactttaatttttgaattggttttcatggttcagaatgttctcaaattatatcttttaaaccttagaaataagctcaatggttctttttttctctgggtaagaaatggtagaatataggcatgggtcaacattcagcggcatgttttttttt

SEQ ID NO: 4528 - DNA, 414 bp, Zea mays
  Clone ID: LIB3279-009-P1-K1-C9
gctgctcagctttgcgtgcttgcggaggactgtgaccagcctgattatgtcaagctggtgaaggctctttgctctgagcacaacgttcacctggttactgtgcctagcgctaaaactcttggcgaatggtctgggctttgcaagattgattctgagggcaaggcgaggaaagttgtgggttgctcctgtgttggcgtcaaggactattgcgaagaatctgggggccttaacatagttcaagagtacgtcaagtcacactagatacagggcatcggtatctggaacttgtgctctacactagctttaagacctggatttaaaattgtgctggttcttgggcttttctaggagattatctcaattcttgttttaagggatgtcatctggtgttaatacaaatcattaagcgggggt

SEQ ID NO: 4529 - DNA, 51 bp, Zea mays
  Clone ID: LIB3279-009-P1-K1-D10
aacacaacatcaactcctcttaccgttattatcacaccacttctcacaccc

SEQ ID NO: 4530 - DNA, 177 bp, Zea mays
  Clone ID: LIB3279-009-P1-K1-D11
taccgtccgattcccgtcgcccacgcgtcgcccaccgtcgcccaccgtcgcggaccgtggggtctaggttaggctagggtgcgaccagctagcggaaatgggccttcagtccatcagtaccaggtgggggcgcgcgctgcaccccgcatacaccagactaccgatgaagcttgccac

SEQ ID NO: 4531 - DNA, 463 bp, Zea mays
  Clone ID: LIB3279-009-P1-K1-D12
cttccattcacttcttagcggcagcgttcaacgagagcaacgaagtattcaagccgaaaacaatgtattttgtgcggaataacttttcattaccttatctttcagttcacttgttttttattttaattttttttttatttatttattttttcttttttttatattactttttatataaatttttttctttttattttttttattatttttctttttatttcttttttttttatttttttatacttttttattttttttatttatttttttttttatattatttgttattggtgtgtgtttttctattctttttatattttttctttatttttttatttttttatttagtttatttattttttcctttatatttttttttttatctttttatcttattctcttttttttttttttttttatatattattatattttttttattattattttttattcttttttt

SEQ ID NO: 4532 - DNA, 245 bp, Zea mays
  Clone ID: LIB3279-009-P1-K1-D2
cccacgcgtccgtgcacacccaacgttgtctgaagttctggatgaactcttcaaggctgccaaggttaacacagctggttcgcattctatgaatgagccagttgcggtgtagagaggagccatagttgaaacaatctatctgctgcagccccacaccccagttatattgcctttagtacttaactagcctgctactcaaaaaactgattttgtagccatttgcggacattttcgttatgagattc

SEQ ID NO: 4533 - DNA, 370 bp, Zea mays
  Clone ID: LIB3279-009-P1-K1-D3
ggccaccagcccaccacccgacgccggaggcccggaggaggaggcggcgatggcggggaagcacgggcgcaacggcttcgacgacgacaacgtcaaccctttcgcgggaggaagtgttccacctgccaccaattctcgtctctcacctctatcacatgaaccggctgatttctacaatgtggacattcctctcgactcatcaaaggatctgaagaaaaaggagaaagaactccaggctatggaggctgagctaaacaaaagagaacgggaattgaaaaggaaggaagaggcggcatcccgagctggcgttgtgataaaaaagaaaaactgggcttccttttttccccttattcaccacgacattttcaat

SEQ ID NO: 4534 - DNA, 331 bp, Zea mays
  unsure (1)..(331): unsure at all n locations; Clone ID: LIB3279-009-P1-K1-D4
aaaaaaaaagacaccgccctctccttcgctagcggaaccgccctcccctcgccggggtaggggtttcgggggtagacgcccgccatggacgcgttccggaaacagctggacgtgctcatgggcgccaaccgcaacggcgacgtcgaggaggtgagccgcaactactacgaccgcgacgtctgccgcctcttcctcgccggtctctgcccacacgnaccttttcagctcacgaaaatggatctcggtccttgttctaagattcattcttttcaactgcggaaagattatgaagaagccaaagcaaaaggaacagaaaattttgatagagaac

SEQ ID NO: 4535 - DNA, 316 bp, Zea mays
  Clone ID: LIB3279-009-P1-K1-D5
ctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccggaaacttccttacggaccgtccttcgaccaaggtccacgctgctcctggcggtggctcttccctgggatacctgtttgggggcaactgatgccgctcaccaagctatcaccccccacttggcgcggatgctttt

SEQ ID NO: 4536 - DNA, 398 bp, Zea mays
  Clone ID: LIB3279-009-P1-K1-D6
ctcgccttgcgcttcctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaagcgtgggcgaagacctaccccgagaacaagcacgtgaagttcctcgccgacggatctggagcgtacacc

SEQ ID NO: 4537 - DNA, 274 bp, Zea mays
  Clone ID: LIB3279-009-P1-K1-D8
atcattacaacaattactgttgatgagattgcaacaccagggctgaagaccatcttaagctttgctgttcctgatcagagatctggaaaggttgagctccagtatttgcatgattatgctggagttaatgcaagcatcggtctgacagccaatcctgtagtcaacctctctgctgcctttggtactaaggctgttgcagttggtgccgatatctcacttgatactgcaactgggaacttgactaaatacaatgctgcactgaggttcactcatg

SEQ ID NO: 4538 - DNA, 245 bp, Zea mays
  Clone ID: LIB3279-009-P1-K1-D9
gagcagccgcatccacaacctgcctctctcgtcccctggcggcgtccgcggcaggagggcggaatctacggcgaggacggtgaaggatgtcaacccgcacgagttcgtcaaggcctactccgcccaccttaagcgctccggcaagatggagctccctgagtgggttgacattgtgaagactgcgaggttcaaggagcttcctccttatgatcctgactggtactacatcagggctgcattcattg

SEQ ID NO: 4539 - DNA, 329 bp, Zea mays
  Clone ID: LIB3279-009-P1-K1-E1
cgcgccgccgccgccgccgccgtgacggaaggaagaggaggagcaaggagcacgacgcgaggggccactccaacgtgtggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccggtgaagaggccactgtgctgctgtggagaacttcctacatcaaagaaatgggtccttcattagaaggcctaatttatgcgctttagctttttggtcagaactt

SEQ ID NO: 4540 - DNA, 259 bp, Zea mays
  Clone ID: LIB3279-009-P1-K1-E10
ccctacccctagcccacactctctcttctatctttttccctctcacgcacaacgcgcgtgtctcctctgttcagggcgcacactgtttcaagcattgatcctatcttcaagctccaattgcggtccaactcctttcctgctccatgtgcgcatttacctgttcttcctgttcatggcgccacactcccttctcttcacctttacctactgcccttcttcttcactgctttcatttcatacaatcctttattcttattta

SEQ ID NO: 4541 - DNA, 285 bp, Zea mays
  Clone ID: LIB3279-009-P1-K1-E2
ggccaaatcaaatgatgcataatttttaataatgtagagcaagttaggaacatgtgcgcgtgtacagatacgatgggcaaaatcaataatcgaaattcggagatccgtagaacccatcgaatatcacatagataagaacgtttcacataaagaactgcatatagaggggaaaaagcagtgcaaattgcaaaaaatgcaagatatggattctactgcactaaatactattggtggagggctggaggctacaaaggttgagaggatatctattaaagattacaacat

SEQ ID NO: 4542 - DNA, 272 bp, Zea mays
  Clone ID: LIB3279-009-P1-K1-E3
cagcgctcaagttctcgcgcccacagccaaatttttctccactcaatcgcggcataaggtggactgcagccatggacgccagcggagccggtagcaaggcgaagaagggggcggctgggcgcaaggctggcggccccaggaagaagtcggtgtcgcggtccttcaaggccgggctgcagttccccgtcgggcggatcgggcgctaccttaagaaggggcggtacgcgcagggcgtgggcaccggggcccccgtctatcttggcggcgtgctt

SEQ ID NO: 4543 - DNA, 234 bp, Zea mays
  Clone ID: LIB3279-009-P1-K1-E4
cccacacatacacggacgcttgggccagtaactcgcatcttcctccgacatccaagcgcgtggcatcgcaacgcgttggaaaccacaatatgtcggcacacggcacgggcaccaagggtcttgacaaggtcatatccaagcgccaccgcaaggtcctgcgcgacaatatccagagcatcaccaaacctgcgatccggaagctgcctaagaggggctgcaaaaagcgcatctcct

SEQ ID NO: 4544 - DNA, 354 bp, Zea mays
  Clone ID: LIB3279-009-P1-K1-E5
ctcgtcggagcaactaggactagcgcggccaggccgccataggccaccgcggtgatgaagtgcagcactctcgctaccttacgagctagtcgggcacgtgcagttgcagcgaaaatgggcgaggtccgcgtgctaaggcagggggtgtctgcatggagctccggcgaggttgcgccgaacggtgatgagttcacgaaccgatagaggccggtgatgagttcgctcgggctccggcgacctgcaatggggaggtcggaaatgtggtcttccggcgctcgagcaggagtggtgggaccgtggtatcagatattcgagaaaatggtacattggctcaaaaatatcttggataggaac

SEQ ID NO: 4545 - DNA, 269 bp, Zea mays
  Clone ID: LIB3279-009-P1-K1-E6
cccacgcgtccgggacgcgtgggctccctggcagctactgggcagagcccctgaacgctgctacacatctcctcaaccgcctcccctcgaaggcggcgagccatctcaccgccacttcgccctgtatggcacaaccctctcctatgaccacatttgtgtgtttggttgggcgtactatcccaacacttgcgccaccgctccccataagccatctcctcgttccgcccggctcctcttaatcgggtactcccctgaccacaaggggtatc

SEQ ID NO: 4546 - DNA, 292 bp, Zea mays
  Clone ID: LIB3279-009-P1-K1-E7
gtgccaggggtgcttcagcataaccactgttttcagccactcccagactgttgggtgtgccctggctggcagactgtcctctgccaacccacaggaggaaaggcaaggctcactgagggctgttctttccgcaggaagggagactagagcggatgtggtcttcaagttttgctctatgccagatactagcgtcatgaactgcctttagctaagattttccataagttggtctcgagcaactatgtgttgcatggtggctacttccaaacttatatcttgtttggtttggatt

SEQ ID NO: 4547 - DNA, 302 bp, Zea mays
  Clone ID: LIB3279-009-P1-K1-E8
gttcacacacattcaagatggttcaacgatatagtgaatgtgatattctcgtccgaggcgtttgttgctggctgcgtggcatatttgctggacaacactattgacaggcatgaagcttcagtcaggagagaccgaggctaccattggtgggacaaattccggtcgtacaggaccgatacaagaagcgaggagttctattccctgccattcaatctgaataagttcttcccatcgggctgagcttttgctgtgggtaatgtgagatgctcttgtactctggattctgggactgcccaccccct

SEQ ID NO: 4548 - DNA, 290 bp, Zea mays
  Clone ID: LIB3279-009-P1-K1-E9
gaagaactgaatggagctcctagtggtgatgctacggctgatggcagtgtcgggagagatgtctaaaccatgcacctgtacttgaagatgccttttaagtctgggagtgtgggtttctactaccaaagtacaagggttggtgcatgcagagtttatctgtagctacatttagtaggctggggggggagtattaccgttgcaaggtgcaacccatgggtggaggttaggtaacaggacacttcatattggtgggtgggtgggtcaattctgggaggttgggcgtattactt

SEQ ID NO: 4549 - DNA, 250 bp, Zea mays
  Clone ID: LIB3279-009-P1-K1-F1
gtccggctttttggtggttacatagctgatgttgtggcagctattgatcaggctgttcaggatggtgttgacattctcaacctttctgttgggcccaatagcccaccaacagctacacggactacttttttgaatccttttgacgctgcacttttttctgctgtgaaagctggggtatttgttgcccaagctgcaggaaatggtggaccatttccaaaaacactggtgtctttcagcccatggataacta

SEQ ID NO: 4550 - DNA, 437 bp, Zea mays
  Clone ID: LIB3279-009-P1-K1-F10
cccacgcgtccgcggacgcgtgggacaaagactaagatctacttcgtcatggagctgggccgcggcggcgagctcttctcccgcgtctccaagggccgactcagggaggacaccgcgcgccgctacttccagcagctcgtctccgccgtggggttctgccacgcccgcggcgtcttccaccgcgacctgaagcccgagaatctactcgtcgacgagcaggggaacctcaaggtatcggattttgggctctccggcggcgccgagcagttccgtcccgacggcctgctccacaccttctgggggacgccgggctatgtggcccccgaagtgctcggccggcgcgggtaccaccgcgccaaggcaaacgtgtgggcgtgcggtgtcattctctttgggctcaagggcggatatctcccttttcatgacaaaaacatcat

SEQ ID NO: 4551 - DNA, 288 bp, Zea mays
  Clone ID: LIB3279-009-P1-K1-F11
cggacgcgtgggctttccccaactccccagcgcctctccgcgccgcgatccagatccaggttgttcagcatgggtctggtgaaggaaggcgtcgacatggaggagggaaccctagagatcggcatggagtacaggactgtatctggtgtggccgggcctctggttatcttggataaagtaaagggcccaaagtaccaagaaattgtaaacatccgacttggagatggcaccactcgccgtggtcaagtccttgaagttgatggagaaaaaggctgtgtacaagttttt

SEQ ID NO: 4552 - DNA, 265 bp, Zea mays
  Clone ID: LIB3279-009-P1-K1-F12
cccacgcgtccggcaggctataagtttgacgagcatgatcgcaattcacccaatgtgcggctgcagtttgctcgtttcgcaggtccaaaggggaattcaggacctggtggtcgtggtaggcgataagttattggcgttcctttttgccaggccagttccttggtgaatacccatgtcgatatgatctccgaccataagaatatgattggtagttatggccttccgcgttcagcgtttggaccctggtttctcttgaagtttttta

SEQ ID NO: 4553 - DNA, 287 bp, Zea mays
  Clone ID: LIB3279-009-P1-K1-F2
gtgacctatgcaacattacactgaacaaaaatgctgtctttggtgacagcagtgcatgatgacctggcggtgtgcgcattggtacacctgctatgacctcaagggttttggttgagaaggacttcgtgcagattgccgagtaccttcaccgagctgtgaccatctggttgagcatccaggcggagcatggcaagattctcaaggacttcaagaagggcttggtgcaaaacaaggacatagagaacctgatggcggaggtcgagaagttcgccacttcatttgacatg

SEQ ID NO: 4554 - DNA, 278 bp, Zea mays
  Clone ID: LIB3279-009-P1-K1-F3
cccacgcgtccgcggacgcgtgggttagcctagcactgctgcagcttgcttgctttggtggggcttctccagtatgcttcttggccaggcctcagagcagagctttggcttggctagtcgtcgtccgcggatagtctccgctgcaccgtgtgcgtgcaagcaaggcaaggcaaccagccagccgcggcgacgaccgatcgtcaacaagctcgatcgccttggccggcggccgggcgggccaccgcaagccgcgagcgatggaagagcagctgggcccg

SEQ ID NO: 4555 - DNA, 342 bp, Zea mays
  unsure (1)..(342): unsure at all n locations; Clone ID: LIB3279-009-P1-K1-F4
agagaaagttctcgagctagacgagcgccgtgcgaggagagaagcgagatgagcggggaggcggcggccgtgggcggaggcgaaggagaggcgaatggcatcccgccgaacgtcaccatctatatcaacaacctcaacgagaagatcaagctcgaagaacttaagaagtccctaacagccgttttttcccagtttgggaaaattcttgatgtgcttgctttcaagactntgaagcataaaggtcaagcttgggttgtcttcgaagatgtcgcatcaactactgaggctcttgagaggatgcagggctttcccttctatgacaaaactatgagaattcaatat

SEQ ID NO: 4556 - DNA, 353 bp, Zea mays
  Clone ID: LIB3279-009-P1-K1-F5
gcagccaactaagaagctacaagtgaatgccgaggagagcagcgatgacttggctaacccaccgaaggtagaggagaagcttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgctggataagattaagttcctttcccttactgaataagaaggtctgggtggaggggacactgcaaagctt

SEQ ID NO: 4557 - DNA, 359 bp, Zea mays
  unsure (1)..(359): unsure at all n locations; Clone ID: LIB3279-009-P1-K1-F6
ccttgaaagatccgccacgccatcgtcctcaatccgacggggacgagcgcacgtcccgcgggctcatcctctcgcgtgcggccgtgccatcatcgcctttctgttcgtgttcggggcttcgggccgcccgtcgctatcgcccgccgcccggaccggggaacaccacgctccacgcacacagaagccgtacaggaaaatccggatttccggcttctgcatcgcgtgtgcgccacgacggcgtgcgggtgcggcggcggtaggcaagccggccgtgggcggatcggatgcgtgctgcactggtgttgttgttgnncgcgcggcgccgccggttgtcgacgtggggggcagggggcgacttg

SEQ ID NO: 4558 - DNA, 256 bp, Zea mays
  Clone ID: LIB3279-009-P1-K1-F7
gaagccgccgccgcagcaatcacagcagcccggagaaagcccaggtccgacaagagggagatcttcgtgaagacgctgacagggaagaccatcaccctcgaggtcgagagcagcgacaccatcgacaatgtcaaggccaagatccaggacaaggaagggatcccgccggaccagcaacggctgatctttgccgggaagcagctggaggatgggcggacccttgcggactataacatccaaaagggggctacgcttc

SEQ ID NO: 4559 - DNA, 253 bp, Zea mays
  unsure (1)..(253): unsure at all n locations; Clone ID: LIB3279-009-P1-K1-F8
cccacgcgtccgcagcactctccccgaccttgccgtccagtcgtccaccccaccgccgcagcctcgccccgaggagacaggagaacagcangatgccggcgacgccgacgatcatcggcgccctcctgggactgggcactcagatgtactccaacgccctccgcaagcttccctacatgcgccatccttgggagcatgtggtggggatgggtctcggtgcaatatttgtgaaccagctggtaaaatttgacga

SEQ ID NO: 4560 - DNA, 281 bp, Zea mays
  Clone ID: LIB3279-009-P1-K1-F9
tatgaacccctattgcatgaaaaaaattccgggatctagcttgttactgacaaggctggttttttacctacactaacttgaaagtaaagcatgcacggatccacgttctagatttttatgtgattccactatcacaattagcgttcttaagggcacccgcaaccgtgagatagtgtttggtcccagagctaggtgagatggagcgagctgactctatgtcaggagtagctctatccataagattttagggagctggataagacataattttcctttttaaa

SEQ ID NO: 4561 - DNA, 338 bp, Zea mays
  Clone ID: LIB3279-009-P1-K1-G1
agctgctggtggaacaggacagttcgcagttcagctggcgagattagcaggcaacaaggttgttgccacatgtggaggtgaaagtaaagctgaacttctggcttccttaggagttgatcgtgttatcaattacagaaatgaacgagtcaaagatgttctgaagaaagagtttccaagaggtgtagatatcatatatgaatctgtaggtggggaaatgtttgacttgtgcttgaatgcacttgcagtccatgggcatctcattggaattggtatgatctcccagtatcaaggagaggatggctggaaagccaaaaactacactggactatgtgagaaga

SEQ ID NO: 4562 - DNA, 282 bp, Zea mays
  Clone ID: LIB3279-009-P1-K1-G10
ccccaactcgatctcgcacctagggtttcgtctcgccgctctcgtcctccgcgaaggtgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggaca

SEQ ID NO: 4563 - DNA, 449 bp, Zea mays
  Clone ID: LIB3279-009-P1-K1-G11
cgccgcagtccgcaccccctccccaatcacgccacccgacaccgcgctccgcagattcgtagtcgccgctaggcttccggcgagatggacgtggtgaaggcggcgcagttgtcggggcggacgctggaacgggtagtggtgcatcccttggtgctgctcagcatcgtcgaccactacaaccgcgtcgcccgcgacacccgcaagcgcgtcgtcggcgtcctcctcggcacctcatcccgcgggtccgtcgatgtcaccaactcctacgccgtgccgtttgaggaggatgacaaggatcctaggatctggttccttgaccacaattaccacgagtcaatgttctccatgttcaagaggattaatgccaaggagcatgttgttggctggtacagcactggcccaaaactaagggagaacgacttggatggtcatgcattattcaacagtta

SEQ ID NO: 4564 - DNA, 100 bp, Zea mays
  Clone ID: LIB3279-009-P1-K1-G12
cacgcgtccgtttttcttgctgaacattcatttcccgccagactaccctttcaagggtgggaaatgtatcttttaagaccaaggtcttccatccaaacat

SEQ ID NO: 4565 - DNA, 296 bp, Zea mays
  Clone ID: LIB3279-009-P1-K1-G2
cagctgctcgtgaggccgctcctgggcggcgcccccgacgcggcggtggtggacaagcacgcggagcagctcgccaaggtgctcgacgtgtacgaggcgcacctcgcccgcaacaagtacctcgccggggacgagttcacgctcgccgacgccaaccacgcgttctacctgctctacctcaacaagacccccaaggccgggctcggcgccgcccgcccccacgtcaaggcctggtgggaggccatcgtcgcccgccccgcgttccagaagaccgtgcgcggcattcccttggcccc

SEQ ID NO: 4566 - DNA, 314 bp, Zea mays
  Clone ID: LIB3279-009-P1-K1-G3
cccacgcgtccggatcccatcccgcggcagccggtcagtccgatccatctccagtacccagcccgtcacccgccttccccgttcgctctcgtcggcgcgcgatggagggtctcatcaaggggttggtccacgtggccatcgacgccgtggaggacgccgtgagggagagggaccacggccgcgccgacgacgacgaggtgccgaggaggagggcggcccaaagctccgatccagatgacgacggggaggaggaacgcgacgaacgatcgcggtcgacgtgggccgaggtcgtctccgagcagaagggcagcgat

SEQ ID NO: 4567 - DNA, 322 bp, Zea mays
  Clone ID: LIB3279-009-P1-K1-G4
gtgctcagcgccgtcaacgacctcgccatcttcaatggatgcacaacgaaggcaattgagcatgctgctgacaaccctgctgttgtggaagcaattggagtgcctatagtcagaggaccgtggtatgatgcttctcttgaggtgggccatcgacggcggtctgtgtcatgcacattccctgtatctgggccacatgggtcaggatttctccagattaaggcaacccgagatggaggtttgttttcagttttctcctttgctgtgccctgaatagtcacattatacaaaaacgatggtgttgtgtagaggatgggctgctttc

SEQ ID NO: 4568 - DNA, 57 bp, Zea mays
  Clone ID: LIB3279-009-P1-K1-G5
gtttgcttaattcgattcatatgagccagcatttactgtctcataattatcccacca

SEQ ID NO: 4569 - DNA, 467 bp, Zea mays
  unsure (1)..(467): unsure at all n locations; Clone ID: LIB3279-009-P1-K1-G6
cccacgcgtccgcccacgcgtccggcaagctccaattcatgttgagaatcaagaacctgagaatgttaatctatcggagaatgcaaagatggatattctggtaccagatatccagcctgacgtggaagttgcttcagatctagtcacaatcacaaatgaagaaaaagttgatgagacaccgtctgttgttgctccagcggctgaaattatgccactgcaagacatcaacagcgaagaaaatgctttggtgaatgatgtggaagagagatccaaagaagaacattcatctactgataacctgaaaggcagcaagaggaggtcttcattctcagctaaacctgaatatccagaaaatggctccaaaaattctccagccctgccaagctacatggctgctacacaatctgcaaaggcgaaactgcggnggaatagttcaccaagacttagctctgattcagcagagaaaa

SEQ ID NO: 4570 - DNA, 262 bp, Zea mays
  unsure (1)..(262): unsure at all n locations; Clone ID: LIB3279-009-P1-K1-G8
cccaggcggagtcgacggngccgcgtatggtggggtgcctggatcgccccccgtgtggggagaggccccagccgaagaatcattggtggaagatcaaaatcatactcaaggggtgagttcagatcaagaggcaaggtggaaccagcaagaagaaaaacgtttttgtcgagaatgacattacgagagaccattacacgatgagagaggaggtcaaggcagtggtaccccttttggttcggggagttacccaaggaaagggcac

SEQ ID NO: 4571 - DNA, 255 bp, Zea mays
  Clone ID: LIB3279-009-P1-K1-G9
ggttatcgagtttttggtgttcttgcaatgtcgcgatcaattggtgacagatatgtgaagccatggataattccagtcccggaggtaacaatagttccgcggtctaaggatgatgagtgccttattcttgctagcgacggcctttgggacgtaatctcaaatgaagaggtatgtgaagttgctcgcaagcggatacttctgtggcacaaaaagaatggcacaagctcatcatcagccccacgggttggtgattac

SEQ ID NO: 4572 - DNA, 325 bp, Zea mays
  Clone ID: LIB3279-009-P1-K1-H1
ggccccaactacccccagtctcggaagagaactatccagaagcgcaagactccaaagcgcgggccttcctatccatcccttcctcgccacgggggtcgcctgagatcacataaacaatggtgaaggctgttgctgtgcttggtagcagcgatggtgtcaagggcaccatctttttcacccaagtgggagatggccctaccactgtcaccggaagtgtctctggcctcaagcctggcctccatgggtttcatgtgcatgcgcttggtgacaccaccaatggctgcatgtcaactggaccacacttcaatcctgcgagcaagggaca

SEQ ID NO: 4573 - DNA, 409 bp, Zea mays
  Clone ID: LIB3279-009-P1-K1-H10
cggacgcgtgggcgcgccgccaccgccaccgcgaggatgccgttcaagaggttcgtggagatcgggcgcgtggccctggtgaactacggggaggactatggccgtctcgttgtcatcgtcgatgtggtcgaccagaacagggcacttgtggatgcccctgatatggtcaggtgccaggtgaacttcaagcggctctcacttactgacatcaagattgacatcaaacgtgtccccaagaagacagccctgatcaaggcgatggaggaagctgatgtgaagaccaagtgggagaacagctcatggggcaagaagctgattgtccagaagaggagagcatcgctcaatgactttgataggttcaaagtcatgctggcgaagattaagaggggcggtgctatcaggcaagagc

SEQ ID NO: 4574 - DNA, 456 bp, Zea mays
  Clone ID: LIB3279-009-P1-K1-H11
cccacgcgtccgtgcacacccaacgttgtctgaagttctggatgaactcttcaaggctgccaaggttaacacagctggttcgcattctatgaatgagccagttgcggtgtagagaggagccatagttgaaacaatctatctgctgcagccccacaccccagttatattgcctttagtacttaactagcctgctactcagaaaactgattttgtagccatttgcggacattttcgttatgagattcaggattagtgccagcactatctatttcatgagaaaatagaaatccaatgatctgtcccatgtatggaaaaatgtaaattttgtagtccttgtagagtaaatgtagtgcctttacgtggcaaaactcgctcttatgaatctatgattacttcaattcataagatgggcttgtttggtcagcattaaaaaaaaaaaaaaaaaaaaaagggcgg

SEQ ID NO: 4575 - DNA, 120 bp, Zea mays
  Clone ID: LIB3279-009-P1-K1-H12
tgctaaggcagttggttaccttaatctttatggacagatgctatgtgttgcttgtgtggcacttttgtttaagctaagttttgcggagacaagatacttatatatgttcccgatggaaaa

SEQ ID NO: 4576 - DNA, 473 bp, Zea mays
  Clone ID: LIB3279-009-P1-K1-H2
cgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgggggagcagactgaagcatgatatagctctttatattattggggtttcctgtagttgctcttgtcaagcatgttgggggggccttatctaggggaaatgtggaatcactgtactggctgttttgccgagacaatgcttcttatatt

SEQ ID NO: 4577 - DNA, 328 bp, Zea mays
  Clone ID: LIB3279-009-P1-K1-H3
cccacgcgtccggttttcttggtgaacattcatttcccgccagactaccccttcaagcctgcaaaggtatcttttaagacgaaggtcttccatccaaacatcaatagtaatggaagcatatgtcttgacattcttaaggagcagtggagccctgctttgacaatctctaaggttttgctttctatctgctccctgcttactgatcccaacccagacgaccctcttgtccctgagattgctcacatgtacaagacggatcggcctaagtacgaggcgacagcccgcagctggacccagaagtacgccatgggatgaaatgttcggcgtt

SEQ ID NO: 4578 - DNA, 444 bp, Zea mays
  Clone ID: LIB3279-009-P1-K1-H4
cccacgcgtccggttttcttggtgaacattcatttcccgccagactaccccttcaagcctgcaaaggtatcttttaagacgaaggtcttccatccaaacatcaatagtaatggaagcatatgtcttgacattcttaaggagcagtggagccctgctttgacaatctctaaggttttgctttctatctgctccctgcttactgatcccaacccagacgaccctcttgtccctgagattgctcacatgtacaagacggatcggcctaagtacgaggcgacagcccgcagctggacccagaagtacgccatgggatgaaatgttcggcgttactggctaaatgcagacgattgtggtgttgcccatgaaactgttatcggggacgtatgttcttcttgttcttgtgcaatctccgattcatctttaggatccgagttctagtccaac

SEQ ID NO: 4579 - DNA, 432 bp, Zea mays
  Clone ID: LIB3279-009-P1-K1-H5
cggacgcgtgggcggacgcgtgggcagacgcgtgggcggacgcgtgggcttccatgcgtgggttcacgacgggcctgaagcttgaacagtttatattcgacgccttcacatactccccgtccacgtcacttttcgaggtcatgcgggaggaggaattcgcgccgttaaagaacgccagcggcgcaacgtatgacacccctgatagcgcgaagctcatgctgctccgactgcacagcagatgagacgtccccgatcgcggcttcttgacacactctgtgccacactatatgacaggacatgtagtgtgtccagtctcctactacgccggagagaacctggaagcgatctgccgtgggcgaacgttacatgcgccgagcgagatcttgttttaggaggagcacttgtgtctggagtagcacttgggtcatctgt

SEQ ID NO: 4580 - DNA, 327 bp, Zea mays
  Clone ID: LIB3279-009-P1-K1-H6
ttttttttttggggggttttttttttttttttttttttttttttttttttttttttttttttttttttttttttttttttttggaaaaaaaacattcttttttttttcaacccttttttttgtgccctcccccaacccagttttttaaaaaaaaaagcgtttttgggggcccccccctaaaaataaaaaataatattttttttccaggggaataaagggggtgggggtcccccttccaaacccgggggggggtttatttttttgtcccaaatttatattcccccccgtaatagggggaaaacgggcccccccctggttttgtttgcc

SEQ ID NO: 4581 - DNA, 293 bp, Zea mays
  Clone ID: LIB3279-009-P1-K1-H7
cactcgtagagagaaggaaaaatatccccaaaccctagctcccgatctcgatggcgagaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccgg

SEQ ID NO: 4582 - DNA, 164 bp, Zea mays
  Clone ID: LIB3279-009-P1-K1-H8
atcgtaatgatgtaagaggtagaagtgctacctgcttaatgtacctcaaaagccctgagggctttacttgttttagccgtggctacggagaagctaattctgggttatggcttttaaaatgctggttctatatttggatttgattatggctgaagtagctcccc

SEQ ID NO: 4583 - DNA, 324 bp, Zea mays
  unsure (1)..(324): unsure at all n locations; Clone ID: LIB3279-009-P1-K1-H9
gcggaagatgcatgacacgtacttaccatgtggtccctcggcttcttcttgtagtacgcgagcacgccgttgtcgaggacgaagtagcgcgtgtggaagaaggacctcccgatcttcctccggccgtggcgcaccatccatccctcgcaccgcaccgcgtcaggggccgtcgcggagggggcgcccttcggcagctccccgctccgcgccattcctgccaccgngtgtggccgagggagctccgggccgctccttgcggtgtgccttctggaccccgacgagctgagcatcttccagcttgggagacgcaagttcgaccgggcg

SEQ ID NO: 4584 - DNA, 368 bp, Zea mays
  Clone ID: LIB3279-010-P1-K1-A10
cccacgcgtccgcgctccagcctttcgctagggtttatccaccggcggcgcgcgcgacggcggcaagatggtgcagcgtctgacctaccgcaagcggcacagctatgccacgaagtccaaccagacgcgggtcgtcaagacccctggtggcaagctcgtgtaccagtacaccaagaagagagccagcgggcccaagtgtcccgtgaccgggaagaagatccagggcattccccatctgaggccagctgagtacaaaaggtccaggttgtctaggaaccgcagaactgtgaaccgtccctatgggggagtactatctggaactgcagttagagaaaggatcatccgtgctttccttggttgagagcaaa

SEQ ID NO: 4585 - DNA, 338 bp, Zea mays
  Clone ID: LIB3279-010-P1-K1-A11
ggctgaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcg

SEQ ID NO: 4586 - DNA, 371 bp, Zea mays
  Clone ID: LIB3279-010-P1-K1-A12
ccttacgccttcgctcgcgccgccgccgccgccgccgctacgccccgcacctcgctggatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccagccgctgagggagcatactgaagcatggatatagcttctttatatt

SEQ ID NO: 4587 - DNA, 321 bp, Zea mays
  Clone ID: LIB3279-010-P1-K1-A2
ccacgcgtccgtggaaccgcgcgtccgtcgcccgcagcctgctgctggagtgcgagtgcgggaaccaccgccccggcgccggtgagaacacgctgctccgggccgggtacggcggctgggtgctctacgcggcggcggcggccggggacgccgcgttcgtgcgggagctgctggagagggacccgctgctcgtgttcggcgagggcgagtacggcgtcacggacatgttctacgcggcagccaggggcgggagcgcggacgtgttcaggctgctgctcgaccacgccatgtcgccggggtgctcggcgaggtgccggaacg

SEQ ID NO: 4588 - DNA, 481 bp, Zea mays
  Clone ID: LIB3279-010-P1-K1-A3
gaccaacctggtaccctacccgaggatccacttcatgctttcttcgtacgctccagtcatctctgctgagaaggcctaccacgagcagctctctgtggctgagatcaccaacagtgccttcgagccatcttccatgatggccaagtgcgacccacgccatggcaagtacatggcctgctgcctcatgtaccgtggtgatgtggtccccaaggatgtgaatgctgctgtggccaccatcaagaccaaacgcaccatccagttcgtggattggtgcccgactggcttcaagtgcggcatcaactaccagcctcctagcgttgtgcctggtggcgacctggccaaggtgcagcgtgccgtgtgcatgatctccaactccaccagtgttggggaggtgttctcccgcatcgaccacaagttcgacctcatgtacgccaagcgtgccttcgtgcactggtacgtcggtgaggtatggaggaaggtg

SEQ ID NO: 4589 - DNA, 93 bp, Zea mays
  Clone ID: LIB3279-010-P1-K1-A5
ctcgagttctcctcaaccaaattcaaagtcacagcggcgaaactctcggcgatgtctggccgcggcaagggcgggaagggtctgggcaagggc

SEQ ID NO: 4590 - DNA, 357 bp, Zea mays
  Clone ID: LIB3279-010-P1-K1-A6
gcgagatcccggccaggacgcgggtgttggtgaacgccaaggccatcgggcaggaccccgacgcgtggggcgccgacgcggcgcggttcgtgccggagcggcacgaggagatcgcggacctcagcgaccacaagccgtggcacgacagcttctcgctggtgccgttcggggtcggccggaggagctgccccggcgtgcacttcgccacctccgtggtcgagctgctgctggccaacctgctgttttgcttcgactggcgcgcgccgcacggcggggtcgttgatctggagcaggagaccgggctcaccgtgcacaggaagcatcccctcgtgctcgtagctcgaagggtacgcgtgc

SEQ ID NO: 4591 - DNA, 349 bp, Zea mays
  unsure (1)..(349): unsure at all n locations; Clone ID: LIB3279-010-P1-K1-A7
cggacgcgtgggcggacgcgtgggcggacgcgtggggcgcgattgggggctcgggggtgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtgnaaaaaaaaaaaaattataataataataaaaaaataaatattaaataatattataaata

SEQ ID NO: 4592 - DNA, 230 bp, Zea mays
  Clone ID: LIB3279-010-P1-K1-A8
cggactcgtgggcggacgcttgggcgtactcgtggggcgcgattagttgctcggggtggaagtaaagtgtatagaaatgatactggtcacccatttactatacctataggatgatatggcatttgtctatctgtgttgcgcttcactatatttgattgtatcagtagttccttttgtgttttttgttccactatagttcaccttgatgttagttcaaatatatttttaac

SEQ ID NO: 4593 - DNA, 272 bp, Zea mays
  Clone ID: LIB3279-010-P1-K1-A9
cctaagggtgcggccacgcgtgcgattgcagtccgacattcaagatcagttgtggggagccggcaatggcgacgaatctaaccgaactagccaccatgcgtggagtccgtacgcaagatacgctaacaagaccctgagtcacgggactgataagtacctccttcgtatgacccgtcaattccacacgaacacgaaagtgctgatagaggagtggcttctgccatatgagcgactgcatatcaaggatggcaggtataccacacatatgatgc

SEQ ID NO: 4594 - DNA, 384 bp, Zea mays
  Clone ID: LIB3279-010-P1-K1-B1
gacgcatcgaggagagcatgcgaggaagcgaccatgagggccaagtggaagaagaagcgcatgaggaggctcaagaggaagcgcagaaagatgaggcagagatccaagtaggcagatcgagatggattgtggacctgatgacatgcgtgggtacatacatttcttcggatgcgttggtgtgcctgtggagagatgtcaacctgccatggtgtcacggtccgccatcagttgaacgtcttgcctgcacttcagtaggccatttttcatggttctagttgtatttgaatccagcgtttgccactaagataaatcagacattcgttttgtgaacctattatgatggagctttatttgctgataatatctacctacctatttgagctg

SEQ ID NO: 4595 - DNA, 400 bp, Zea mays
  Clone ID: LIB3279-010-P1-K1-B10
taaagtctaccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggcgcgcaggggcggcgtgaagcgcatctccgggctcatctacgaggagacccgcggcgtgctcaagatctttctcgagaacgtcatccgcgacgccgtcacctacacggagcacgcccggcgcatgaccgtcacagccatggacgtcgtctacgcgctcaagcgccagggccgcaccctttacagcttcggcggctagggcgcttagctaggccatgctcgacccgccccc

SEQ ID NO: 4596 - DNA, 326 bp, Zea mays
  Clone ID: LIB3279-010-P1-K1-B11
cggacgcgtgggggcaggagttgttttgaatccagcgactccactcactgcaattgattacgttcttgatgttgttgacctggtgctgattatgtctgtgaatcctgggtttggtggccagagctttatcgagagtcaagtaaagaaaattgcagaactgagaaggttatgtgctgagaagggagtgaacccctggattgaggttgatggtggtgttggtccgaaaaatgcctacaaggttattgaagctggcgcaaatgccattgtcgcaagttctgcagtttttggggctccagactacgctgaagctatcaaaggaataaaga

SEQ ID NO: 4597 - DNA, 301 bp, Zea mays
  Clone ID: LIB3279-010-P1-K1-B12
caaaaaggtcaaggctaagtcattccagctaggagacctgatatggaagaccatcttgccagttgccactgaggagcagagaccgaaaaatttaggaaatggccaccaaactggaaaggtccttacaagatcacgcagatacatgttgcaaacattacaaggtgatgacttgcccaaggcactgaacatgtgtttcctgaagcaatatcatcctagtatgtggtaagatgctaaaaactgatatggtcacactaagttgattctagcctacgccaatttgtcgtctctgtgcacgcacgga

SEQ ID NO: 4598 - DNA, 351 bp, Zea mays
  Clone ID: LIB3279-010-P1-K1-B2
cgaatccctcgcatcgcattcgcagcctttgctgcatcacaccaccgcgaaaccccagcagccgcatcgatggcgcccaaggcggagaagaagccggctgcgaagaagccagcggaggaggagcccgctgccgcgaaggccccggcggggaagaagcccaaggccgagaagcgcctcccggcggccaagtcgtccggcaaagaaggcggcgacaagaagggtaagaagaaggcgaagaagtcggtggagacctacaagatctacatcttcaaggtgctgaagcaggtccaccccgacatcggcatctcttccaaggccatgtccatcatgaactccttcatcaacgacatc

SEQ ID NO: 4599 - DNA, 264 bp, Zea mays
  Clone ID: LIB3279-010-P1-K1-B3
ggcgggcgtcctcaggaagatgaggtcggctggtacgcacactgacaagaagaaatagagagcatttcaagttcatggagcctgccagagattatgttccagtgtctgattttccatacatgtagaacctaatagacatgtcaaagtattatgtatcgaaccagctcatgggattttgctccttccaatgcatccagggtttatgtatcgaaccagtttatgggatcttgctcctattccaatgcatccatggtttgtgaaaaa

SEQ ID NO: 4600 - DNA, 335 bp, Zea mays
  Clone ID: LIB3279-010-P1-K1-B4
gccccctaactgcaccggccgccacaccaccccgaccggaccctccacaacaatggccaccgtcctgggcagcccccgcgcgccggccttcttcttttcgtcgtcctccctccgcgccgcgccggcgcctaccgccgtggcgctgcctgcggccaaggtgggcatcatgggccgtagcgccagcagcaggcgcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggt

SEQ ID NO: 4601 - DNA, 449 bp, Zea mays
  unsure (1)..(449): unsure at all n locations; Clone ID: LIB3279-010-P1-K1-B5
gctcattgtaggaaacaacagcaaggcatcacgattctgttgatcaacctgagcaacactactggatacaacgtcactctccagaacgacatcaacgtcagcttgggcaaaagacctgaccttgagaagcgcagctctttcacgcacaggctcaggaaagcagtctcatggctggggaggaaaccagcaagcaacaccaggaggcgggaggagtaccatctgaccgccaaggacggcgatctccagagcaaaacgatgctgctcaacggggccccgttggaacttggagacgccggcagcattccagctatggatccagtgctcgtcgccgttgattcggcggtgcagatagcaccaacatncatcgncttcgtagtcctacccaaagttgaggccaagggcttgtcttgacacatgagctcttgaaataggttttttttttttttttg

SEQ ID NO: 4602 - DNA, 314 bp, Zea mays
  Clone ID: LIB3279-010-P1-K1-B6
aatgacgccgtcgaaaccccctggcaagcgccgccgttcggctccacctccgcgcttgccctcacccgctccacccgtggcgctctcgccgccgggcttcgtcgccgaccgcgccgaggccgcggcgcgcgtggagcgcctcctgcggtaccagttctgcgaccgcgcccttctagaggaggccctgacccaccaatccttctcggatggcgctctctcttaccagcggctcgagttcgtcggcgacgccgctctcggcctagccttctctaacttcctatacctcaccaaccccaccctcgggcccggcgcgc

SEQ ID NO: 4603 - DNA, 306 bp, Zea mays
  Clone ID: LIB3279-010-P1-K1-B7
gcagaacgacttcaggaggaattcaaggcgttggcttcacatgtatatcttgcttgcagggcaaacgaacaacagcttgtgcatgcaagaaaagaggctgcggagctgcatctgcataagagccagatagaagagttacttcagaaggcccaaggagatctcggatcagtgcaggatcagcacctggtgaaggtccagcagctaataaccctagaggatttcaagtcaaaggagatagacagtgctactgaaggagctcaaatgcatgagtgatgagtgccataaccaaaaaagatgtggtgaggc

SEQ ID NO: 4604 - DNA, 270 bp, Zea mays
  Clone ID: LIB3279-010-P1-K1-B8
tggatctgttggagcgtaatattaacacggatacggccaagactcgcaaggaacaggatcgtaaggagtaggtgggggcttcctcgcggtagtagaaaacccatgagccacctcagcacggcctgttcctgagtctctcactcggcaacggcagtggcaggtctggaatgttacccatgtcaaacatgtcatctaatccttcacagcttacaattttctatggcggatcattatgttgtgatgaactcaggccaccggaaaaggctcaag

SEQ ID NO: 4605 - DNA, 238 bp, Zea mays
  Clone ID: LIB3279-010-P1-K1-B9
agcgagccgcgcgcattccccgtcccgggccaccggaccaggggaaggaggacacacatgtcatactatctatctccagcggcggcagccgaacccgtggatctggacggcatctacatcacgcccctcaccatgtgaatgattggcgccgacggctatatcggatcacacctctatcagaagctcatggacgagacgcgccatgtcaccctagccgtcgacagtgtactgcgataag

SEQ ID NO: 4606 - DNA, 334 bp, Zea mays
  Clone ID: LIB3279-010-P1-K1-C1
gcgttcgccctggtcaacaaggccactgggctcgccatcaagcactccctcggccagtggcgacccggtgaagctggtgccgttcaacccggagtaccaggacgagtcggtgctgtggacggagagcggcgacgtgggcaagggcttccgctgcatccgcatggtgaacaacatccgcctcaacttcgacgccttccacggcgacaagggccactgcggcgtgcacgacggcaccaccgtggtgctgtgggagtggtccaaggtcgacaaccagagctgtgagatcctgccctggggcgacgtgggctatgcttttttatggatctttttccta

SEQ ID NO: 4607 - DNA, 350 bp, Zea mays
  Clone ID: LIB3279-010-P1-K1-C10
ccgccacctctccttcggcatcgacgaggcgaaaccctagcgccggagtcccgctccctcctcccacgacccatggcgtcggatatggcgtacgcgccgccgatgaaggcgggcaaggccgggttcgaagctggcatgatggatccgcagcacaggatccgcatcacgctctcctccaagagcgtcaagaacctcgagaaagtctgcggggatctggtgaagggcgccaagggtaaggagctcaaggtcaagggccccgtgcggatgcctaccaaggtgctccacattaccaccaggaagtctccctgtggcgaatgtaccaacacctgggatcgctttgagaagaggat

SEQ ID NO: 4608 - DNA, 306 bp, Zea mays
  Clone ID: LIB3279-010-P1-K1-C11
gcatgtatggtttgtggcacttctgtaagtggagttaagtcatcccctgcagtggatgcgacatacagatacatgggactcaccgagcgtgttttagatctgagatgccagttgatggtggtctgccgtggagctgaggcaatagtcagatgctcaccatgtatgcacaccatcgcttgccggggttgcttccttgcctcagtgacactactgaaatcctgcaccacctgtggctgcatggttgaacacttcaagatcgtttgacaagacttatctcccaatacacagtagtattactaaacaatc

SEQ ID NO: 4609 - DNA, 370 bp, Zea mays
  unsure (1)..(370): unsure at all n locations; Clone ID: LIB3279-010-P1-K1-C12
cggacgcgtgggcgctctctaccgtccgagaccccaagcaccagcgcggcggcgggggcgggggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagnctacaggaaaatcaggctccgtgctgaaatgtgcaggcaggatgtgccacaacttt

SEQ ID NO: 4610 - DNA, 385 bp, Zea mays
  Clone ID: LIB3279-010-P1-K1-C3
cccacgcgtccggatatcagaaaggatctgtacggtaatgttgtcctcagtggtggctccactatgttccctggtattggtgaccgcatgagcaaggagattactgcacttgcccccagcagcatgaaggtgaaggtggttgctccgccggagaggaagtacagtgtttggattggtggttccattctggcctccctcagtacctttcagcagatgtggatctccaaggaagagtatgacgaatctggtccgggcatagtccacatgaaatgcttctgaatttctggagcagtatatctgttgcttgcattttcagttagttgggatgcaagtttgtcccgtggtctcgctagcattcttcgttctttcttgatattgaagagct

SEQ ID NO: 4611 - DNA, 318 bp, Zea mays
  Clone ID: LIB3279-010-P1-K1-C4
ggaggaggtcaatttcgaggggccattccctttcgcggagggcaggctctatggcctgactctcagtgctactctgaaggcttaccatgtgagcgtcgatgggcgacatgtcactctacttgcttaccgcactgcgtacgggtcggaggacgctacaggcctctctccgaatggggacctagatgtgcacccagagattgcaggatctttggccactacacacccaagttctgcgccacataatgatccgcagtattataatgagtggcatgctgctttgctggctgatgagccagctgagatgctcattgacattct

SEQ ID NO: 4612 - DNA, 212 bp, Zea mays
  Clone ID: LIB3279-010-P1-K1-C5
gatttgcagcctgtaaatatctgagactaagtttcatcatttctttttctccttgcgggtttataagtgaagaccacaatctgagatatgaacgcagcactgctatgtaatattgtactgcactcagcagaatgttggaagaatacttttcattaccgcctcgtttggatcattggaattgaattccattctaataatagtaatttaggcat

SEQ ID NO: 4613 - DNA, 270 bp, Zea mays
  Clone ID: LIB3279-010-P1-K1-C6
gatgaaagctgcttccataccacaagttaatggcgaatcgcatactcagaattttgagaaatttgaggagactgcatctcaaattcaaagttcatgcaagtctggcccatggagaaagatgcttccatccaaagatgcaaactttgctgtgtatacgtacatgatctttgaaatcgcaaatgatgatgaagtggcacgaattgcggagttgtagaaaatgagttccaaatcaaagcgaccaaccatcaagacatcgtgtgagagtatgga

SEQ ID NO: 4614 - DNA, 404 bp, Zea mays
  Clone ID: LIB3279-010-P1-K1-C7
cgcagccgcagccgcagccgctgcttttcgttcgtcttcatcctacgcgagggcgaaacccacaaaccctctccctcccgtactccggcctacacatccaggggcgatgacgctgggtagctccggcgccggatcgagcgtcgtcgttccccgaaacttcaggctattagaggagctcgagcgtggagagaagggcattggtgatggaacagtgagctatggaatggatgatgccgatgacatctacatgcggtcatggactggtaccatcattggccctcacaatactgtacatgagggtcgcatctaccagctgaagttggtttgtgacaaggactatccggagaagccaccatctgtcagattccactcaagaataacatgacatgcgttaatcacgagac

SEQ ID NO: 4615 - DNA, 339 bp, Zea mays
  Clone ID: LIB3279-010-P1-K1-C8
cccacgcgtccgaacgctgaaggatattactgtagctgtgatcgagaatcgcctttggtgatgattgaatagctgagctgggcatgggaacgctgaaagatactgtttagcattgcgcaataggagccatcgtttataccatgcactaaattctggtacttttgtagttataccttctatctactgggattaacaaaaggtgggtttagaaaaaaaaaaaaaaaaaaaaaaaaaaaaaaaaaaataaaaacaaaaataaaaagggtccatatattagctattacaaaactatacaatattgtttggggcggccgttttaatggatccatagtttactga

SEQ ID NO: 4616 - DNA, 429 bp, Zea mays
  unsure (1)..(429): unsure at all n locations; Clone ID: LIB3279-010-P1-K1-C9
cccacgcgtccgcggacgcgtgggcagcagtccacaagcaaaatacaatagtggcatgtgagaatgaaaatccacctttaatgccggcaatcatgactcctggtggtgcgcttgatctcgcaactgtactactgggaaatcgtataatcttcattggccaatatattaactcccaggtggcccaacgtgtgatatcacagcttgtaacacttgctgccatcgatgaagaggctgatattctgatatatcttaactgccctggtggaagtctctattcgatcttagcgatttatgatngcatgtcctggataaagcccaaagttgggacagtgtgctttggtgttgttgctagtcaagcagcaattatccttgcaggtggcgagaagggaatgcgctatgcaatgccaaatgctagaggtatgattcatc

SEQ ID NO: 4617 - DNA, 389 bp, Zea mays
  Clone ID: LIB3279-010-P1-K1-D1
cttgcacatcccccgcttccttcttggttgtttctccccttctgatccgtgctagccaggttgcgttgttgtggctgcttgtcgccagatctacctatccaccgtaccacagtcgtccacagcgcgcgctaacgatggcggtcgccgccgccgctcgccttcttcttcttcgcctcgtcgtcctcgcgctcctcgcagccgcacagcaggtcgtcgggaagagcgccgtgctgtctctgcgggagttggatggacgacgacggagtgccgcgacgacggatacccggagcagccgctactacgtcgacgcaatgcttgctgaaacgctaggggagcacaagaaagctggggcagcaacaagcgtgctagagctcaagcgccactccctc

SEQ ID NO: 4618 - DNA, 276 bp, Zea mays
  Clone ID: LIB3279-010-P1-K1-D10
cccacgcgtccgcttcctccgatcgactagcctgcggcggcgccggcgccggcgaccagcggccatgcgggtggcacccagggtgctcttcctcgtccgcgacgccgcgggctacggcgctgccctcgccgacgcgctccgcccgccgcccggtctaacgagggagtcctcgcccttcgagctcccccttggaaagtacggcctcgacggagagaaggcgtgcgccgagctcctgatgcttttcgattccagtggctctccacaggtgaccatttt

SEQ ID NO: 4619 - DNA, 312 bp, Zea mays
  Clone ID: LIB3279-010-P1-K1-D11
gcgagcagccaaggaaacgagtcaagcaatggagaaggccgtcgacaggcagcgggtcctgctgcggcacctcaaccccgccgcggcggggagccccgccccgcccgccatctccgcaagcgcgtgcgcggcgggggacagcgcggcgtaccaccggaggccggccttcgccgacgacgtcgtcatcgtcgctgcttacaggacggcaatctgcaaggccaagagagggggtttcaaggatacctttgctgaggacctctagggtcctgtcttcagggctttggtagacaagacgaagctggcccaaggtga

SEQ ID NO: 4620 - DNA, 308 bp, Zea mays
  Clone ID: LIB3279-010-P1-K1-D12
cggacgcgtgggcaggaacaaaggattcgtaatgcgctcggctacagggcgtcatgacagcagctccccaagcgatgcaagccgcctattcgacgaaatgtgtgagaagcaaaatgaacatgcccgcgtgttaggtcctttatgtgacccaaataactgaatttcagctaagcaccagatctaatatctctaattcttcgagcttccatgggtgaggcaattaacacttactccaatttgttcttccttcatggtgctacttaattcaacatgttcttcgttgcaatgattataggtacactttggtt

SEQ ID NO: 4621 - DNA, 390 bp, Zea mays
  Clone ID: LIB3279-010-P1-K1-D2
gtctggatgaagtgcttcatgaaaaatctgaacagttggattgggatgcacgtattaacattatacttggagctgcaaaaggcttgtcttacttgcatcatgactgttcgcctcgaataatacatcgtgatattaagtcgagcaacatcttgcttgatggcagtttcgaggcccgtgtatcagactttggacttgcaaagcttttagaggatgaagaatcacatattactacaatagttgcaggaacatttggctaccttgcaccagagtatatgcaatttggcagagccaccgagaagactgatgtctacagttttggggttttggtactcgaaatactcagtggaaagcggcctactgatgcattcttcattgagaagggactaaaca

SEQ ID NO: 4622 - DNA, 418 bp, Zea mays
  Clone ID: LIB3279-010-P1-K1-D3
cgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcgttccctgggttattcttggacactctgaaaggagagctctgctgggagaatcaaatgagtttggtggaaacaaggttgcttttgctctgtctcaaggact

SEQ ID NO: 4623 - DNA, 303 bp, Zea mays
  Clone ID: LIB3279-010-P1-K1-D5
cagacctgttgctgcaccttattctgcaacaataaatttcagggtagaaggttttaacctactcagtacttcctcaaggctaatttgttcttttgaaggacactgcatattccatgaagacacggattctggagcagagaatgttgagtacaaggatagggacatcgaatgcctcagtttttgttgttctgttcctggtccaagaggaagaggatttatagaggtcgaagatagtggttttagcaatggcttcttccccttcataattgctgagaaggatgtatgcgctgaggtttctgagct

SEQ ID NO: 4624 - DNA, 235 bp, Zea mays
  Clone ID: LIB3279-010-P1-K1-D6
tcttcctgaagagcgtctagtctcataagagagcccaaagctacatgtgctcgatggtagaaaacatggataataactagccgaccgtgtgcgccaagtacagggagggcgtggacaaagccaggctcatgctccgagccctaattgacaaggagagcagcgccccgataatgctgcgactgatgtagatctccaagatatcggtcgtcgtagaggaaaggaccggcatgacatt

SEQ ID NO: 4625 - DNA, 428 bp, Zea mays
  Clone ID: LIB3279-010-P1-K1-D7
cggacgcgtgggtttccatgctctacatattgtatcaaattgttgcatggatgaggtttccatgctctctagattgatgtaaagatgaaagttaccttacctggagtacatgatgcctctggatttttctagctacttatcagtagcacattgtataccgagatgtgtttgtgatgttattttagtagtgtgataagtgttgtctgttatgctcttaaatggaggcatttgaccatccaatttagcttttctatgtgaagtcaatgaagcagaacctcttttttttgtgtgtgcacgtaatgtacctgggccttgtaaagtacggagcgtttgggattatgtcggtttacattttgttttgctctttacattacagaaccacggcaatcctacgagccataaaccagagctagtactgaacaattcac

SEQ ID NO: 4626 - DNA, 368 bp, Zea mays
  Clone ID: LIB3279-010-P1-K1-D8
cccacgcgtccggccaattactaactaaactttgttatcccttccaaaggtttagaatattaggtcagatcatacgcttatatgtataataagtcaatagcacgtgcaaggagcagctgtaaggtatgcgcttgtggacactacttgtttgcgtcactccaaagtaaattatgtgagatagtaatctagggaagtttgttatcatctgtgatatgctagagcttggacatcttcatgtcagctggccagcgagcttataattccattctgttgaattgagtgaatagctagctggttgcaccatctatttattggcaccaatttaatggccaccttatagtccacttgcatagacaggttgggctttc

SEQ ID NO: 4627 - DNA, 292 bp, Zea mays
  Clone ID: LIB3279-010-P1-K1-D9
caatgtggaggactggatgggttggaccatgcaacttaatcagtagcggatcacagatattgccttggcagatcccggattattacagctactgggtgcgatagtttttttttttggcagatccatcttgagcatatttgactgtaccggtttcccttgagactaagacgaaagtgatcttactgatcttttgtttcaaatctaaaacgataaaataaaatgtggtttgcaccttgccatgtactgtaagaatggaccccaaaaaatttcatgctgctgttgcttgatatct

SEQ ID NO: 4628 - DNA, 291 bp, Zea mays
  Clone ID: LIB3279-010-P1-K1-E1
gccacttggtgtttgcgctgggatatgcccatttaattttcctgctatgattcccctatggatgtttcccatagcagttacgtgtggcaatacttttgttcttaagccatcggaaaaggacccaggggctgctatgatgcttgcggagctagcaatggaagctggtttgcctaagggtgttttgaacatcgttcatggcaccaatgatgttgtcaataatatttgtgacgatgaggatattaaggctgtatcttttggtggttccaatacagctggtatgcatatttattc

SEQ ID NO: 4629 - DNA, 443 bp, Zea mays
  Clone ID: LIB3279-010-P1-K1-E11
cgagccgcgaccccgggcaggtttccccatggacggggcatccgaccgcgacgacctcccgccgccaccgcgacgaatctctggcctcccactgccgccgcgacgtccagctttgctctactccaaggtccagctctggcttgccgtcctccgcccgtactccacgctactggatctctagcttgctcgtacgggatctctacgggatctttgtactccacgctactggcttgaggtattcaaactttgcgacactacagagattaaagtggcagtatctctgttttatctttccggaagcctgcatgcggtcaatcaagtcagttcttgcaaatcaaactttgcgacacttcaggcactcctcaagcatttctatgttgttgcaaatgaaaaccagcataagtagtcaaatgatatgttgcttctgttctgtgatttacacc

SEQ ID NO: 4630 - DNA, 340 bp, Zea mays
  Clone ID: LIB3279-010-P1-K1-E12
cacgcccctccgtgttgctcgccgcacccccacgccccgccgtgttgctcgccgccaccgccccgccggcagccaaaatgccgttcaagaggttcgtggagatcgggctagtggcccttgtgaactacggcatggtgtatggccgcctcgtcgtcatcgttgacgtcttctaccagaacagttctctagttgatgccccctacttgattcgttgcctaatgaactttaagctgctttttctgactgacttgaagatttacattataacgtgtgctagtgatgactacactgatctaggctagggtagatgctgacatttattgcatgtggttgaatatat

SEQ ID NO: 4631 - DNA, 265 bp, Zea mays
  Clone ID: LIB3279-010-P1-K1-E2
tcgacgtcacagacaccaccgcggaaggcagcacagcacaaaagcaagaacctcagcagcaggagccgcggctccgtctccaaccatccacacatgggcatggcgatggcgttaacggacggcgaggtcggtgctctcatcaaggtctccgcggctgtttgggtggcgatgtcctacgcccgcctcgccgcggcgcgtctccgcccaggcgcgcttcgcctcctggcgctgcttgccggtcgcgcgctcctctgcgcgatcccct

SEQ ID NO: 4632 - DNA, 305 bp, Zea mays
  Clone ID: LIB3279-010-P1-K1-E3
gttgcaagttcttttagtacactatttactatcactttgttgatttgctaggtgataacaaagttctgctctgaaagaattgccaagtatgcttttgagtatgcataccttaacaatcgaaagaaagtgacagcagtgcataaagccaacatcatgaagcttgctgatggtttgttcttggagtcttgccgtgaggttgcaaagaagtaccctggaattcaatataatgaaatcattggggacaactgttgcatgcagcttgttgcaaagcctgaacaatttgatgttatggtcaccccaaatct

SEQ ID NO: 4633 - DNA, 116 bp, Zea mays
  Clone ID: LIB3279-010-P1-K1-E4
ctagcttatattgccaaatttacttatctgcagaatatttgagccctcaatagaaacatctctgtgtaatttactgctactgttttttccatgtgatgcgcatctgtcatgaactc

SEQ ID NO: 4634 - DNA, 350 bp, Zea mays
  Clone ID: LIB3279-010-P1-K1-E5
gcgaattatcaggcacacaagctgtactttgtcatgtccctttgagtacgcatcagtgtcatgcaggtggtaatgtcttgtagtggtccgtttaggcggtgtagtcatgggaacgcgacatcagatacctggtttcttttgattgtgatgttatcttgcattattgcacctgtaggatttgttgaagctcatattttccagggttttggatcttttgtgctagtcttaagtctttgtgtatgcaggcgtggagctaggattatgatataaggggtcaactaattcatcaatactatatgatgttatcaagcttaagtacttataatatgtaataagaattctagttcttt

SEQ ID NO: 4635 - DNA, 443 bp, Zea mays
  Clone ID: LIB3279-010-P1-K1-E6
cgccgccactcaccagcaaattcccgagccgccccttccccatctctttcgcgacccatttgatcgattcctgatggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtccaaggccatgtccatcatgaactccttcatcaacgacatcttcgagaagctcgccgccgaggccgccaagctcgcccgctacaacaagaagcccaccatcacctcccgggagatccagacctcggtgcgcctcgtcctccccggcgagctcgccaagcacgccg

SEQ ID NO: 4636 - DNA, 300 bp, Zea mays
  Clone ID: LIB3279-010-P1-K1-E7
gcatcacccccgcaccaggagggggtagcagccaagcagcaacgtccccaacacgcccgtgtcttccccatgccgagtaggtcgcccctgcctcattgtccttcatgatgaggcaggcggtgaagagcctgctgctgttggggagcttcaagtcgtgtgccgtgaagagctacgagtcctccatctcgaagttgttcggggccactaaagtggtggccaggacaccgtcgcttccattggacgatgctatggtcctcgcattacaacctggtagcaatactcatcgttcacttacagaac

SEQ ID NO: 4637 - DNA, 289 bp, Zea mays
  Clone ID: LIB3279-010-P1-K1-E8
cgcgacccgcgtctcctttccgcgctcctcctctcttccctctgcctcgtgcctgactcgcagcaaaccagtgaccacgccgccgcgctcctccgtcgtgtatacccctctgtatacctcatggacgtcgcgcgcctcccgccgcatctcctccgcaggagcctcctcggccagctccactccctgctcctccgcaccggccacgtggcctccgacgctcacgttttctccagccttgttcaactgtactgcacctgcggacatgtcggcgacgcgcgcaacgtgttcg

SEQ ID NO: 4638 - DNA, 183 bp, Zea mays
  Clone ID: LIB3279-010-P1-K1-E9
cccacgcgtccgcggacgcgtgggccggcgtccagtggttacgtcgagggagcctaggctagcttggaacaagcagccaccagcccgccacgatgctcgtgaggagcgcctccacgcctgtcctcggcgcgctgcacccttccggctgccactcgccggcggtctccttcccggccgggcact

SEQ ID NO: 4639 - DNA, 359 bp, Zea mays
  Clone ID: LIB3279-010-P1-K1-F1
cctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgtttcccttctgaagaagaactggcagaatgtgagatgcctctacgtcaagagcaccatggggaagccatacagggtgttctaagtatgctcttttgtgaagtctgctaggttctggcaccgaggttttatggaaataaactctttgttaaggatatggttttt

SEQ ID NO: 4640 - DNA, 267 bp, Zea mays
  Clone ID: LIB3279-010-P1-K1-F10
accggatgcccgaccctagccttacttacctactgtggaagcgacatctcagaggggggttcgtgcaagcggtatcatgaaccacccaagtacaagcacaaatgagtccaagactattcagaccattttgccggagaagcaagtagtgctctagtcagacatgtttgtcgtgctgagcgctcatatactcatagagttgcgccaaaagggaattagatcgtattcgagcgtgcggtagctgagaccatatacccacattacgaacta

SEQ ID NO: 4641 - DNA, 263 bp, Zea mays
  Clone ID: LIB3279-010-P1-K1-F11
cccacgcgtccgctcagacatacagaattacagagtcgaagtgcgctgtggcctgtggactctcccctccccaactccggcgaagggagcagaaacgttggcgtgttggttgggtggcgtcggcatggacgaggcaacgaagaagaatgtggaggctacggtgctggagatcctccggggctccgatatggagtccgtgacggagtacaaggtccgcgccgctgccagcgaccgcctcggcatcgacctctccatacccgacc

SEQ ID NO: 4642 - DNA, 385 bp, Zea mays
  Clone ID: LIB3279-010-P1-K1-F12
ctcagaaaaggagtacttcaagaaccactctgcagccattaaatcatacatatgagagatggatatagatttgacagtggacatggttcctcccaaggatccttacattcaggttcgggtgctggaggacattggtgaagtatcgctcggtgaccattctgtgtcattgaccaagaactcactccatttcctaaggcgcacagacgctgaacagtttatatcacagggtcttatggaagaatttctggagtaggtatcacatgtatgaatgtatgatggtacaataggatggtgcactgccctcgttctccccagcgctgctgcctgatgccctatttgcaacaatgaaaaggtacatcatttcatgagacgcgttctgtaccaa

SEQ ID NO: 4643 - DNA, 229 bp, Zea mays
  Clone ID: LIB3279-010-P1-K1-F2
gctcgccccgctcccagatagggtttcctcttcccatcaacagccgccggagcgccgtggaccaggacagtgccaccacgatgttggagctgcgtatggtgcacgagagcctcctcaagaaggtcttggaggcgatccaagagctggtcacggacgcgaacttcgactgctacgctaccgacttctcgctgcaggccatggactcgagccacgtcgcgctcgtcgcgct

SEQ ID NO: 4644 - DNA, 435 bp, Zea mays
  Clone ID: LIB3279-010-P1-K1-F4
cagcgcctccgccgccgctgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgttctttccgcaggaagggagactagagcggatgtggtcttcaagttttgctctatgccagatactagcgtcatgaactgcctttagctaagattttccataagttgttctcgagcagctatgtgttgcatgttggcta

SEQ ID NO: 4645 - DNA, 378 bp, Zea mays
  Clone ID: LIB3279-010-P1-K1-F5
cgtcctcgtcctttgtccctgtccttcggggacaaaaacaaccaaggcgcaagcggtaatcttccgtggtgggggcgtgctctgctgcaagcagtggtgacgccgcttggagggagggcgggcgggaaaggatggaggcggtgatggacctcaagtacctgccggttttcccgaacggcggcgtggccgcggccaagaagaagacgaggctcgtgaccactgcggttgccggcggccagacgggggtgtactaccgggaatgcctcaagaaccacgcggcgagcctgggtggccacgcgctggacgggtgcggcgagttcatgccgtcgccggaggccgacccggcggacccgagttcgctcaggtgcgccgcgtgcg

SEQ ID NO: 4646 - DNA, 84 bp, Zea mays
  Clone ID: LIB3279-010-P1-K1-F6
cggaaacccgggacgaccgacgcgaccgcaaccccgaaccaagaccaagcacacagaagacaaaaacaaccaaagcgcaagcag

SEQ ID NO: 4647 - DNA, 234 bp, Zea mays
  unsure (1)..(234): unsure at all n locations; Clone ID: LIB3279-010-P1-K1-F7
gtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaagaaccctgaggagatcccatggggttccgttggcgctgaatatngttgtgagtctactggtgttttcact

SEQ ID NO: 4648 - DNA, 251 bp, Zea mays
  Clone ID: LIB3279-010-P1-K1-F8
cccacgcgtccggcctgcgctcgcctcagctcctttcttccccgccccttggcttttgcttggttgcatcgggccggtcgagccggagaggaaaagctagctagcagctaccagctctcggccggcggtggtagtctgcctgcagctggggttagctgcaagggttgggagctagccatggggaggggtcgggtggagctgaagcggatcgagaacaagatcaaccgccaggtcaccttcgccaagcgccg

SEQ ID NO: 4649 - DNA, 372 bp, Zea mays
  Clone ID: LIB3279-010-P1-K1-F9
aaaggttgtctgtgatccttcttacttgcctagcaaggtaaggaagattggaaaagttgcacgtgcaatcgctattatgagccacccaattccaaacacaaatgagtcccactcgattcagattattttgccgcagaagcaacttgggcgcaagtcagacatgtatgttttctgttgctcatatacacataatgttgcgccaaaagggaagttcattgcatttgtgtctgcggaagctgagaccgataatccacagtccgaactaaagcctggaattgatctacttggtcaagtagatgaactgttttttgatatgtatgacagatacaaacctgtcaatgaaccatctcttgataatggctttgttcaatg

SEQ ID NO: 4650 - DNA, 260 bp, Zea mays
  unsure (1)..(260): unsure at all n locations; Clone ID: LIB3279-010-P1-K1-G1
cggacgcgtgggctccctgtgaatctgcgatactgactctgccttcttcgttcagccagcgccgaaagagagggagagccaagtcgccttccgccgcgacgcacgatggatcgcgcgcagttgcttctcgtcggactcccggccttgctcttcttctccgacctcactcacatattcgcgccgtcgcctccccaccttcgccacccccatcaccaccctgctcaccaccaccatccgcatccgctgcatcatccncactc

SEQ ID NO: 4651 - DNA, 208 bp, Zea mays
  Clone ID: LIB3279-010-P1-K1-G10
acgcgggctccatcatccactctctctgcttctcacccaaccgctactggctcggcgctgcgacgcaggactctgtcaagatctgggacctcgagtcgaagcacgttgtgcaggacctcaatcccgacatccaggtctccaagaaccatatcctgtactgtacaagctagagcttcagtgcggtctggatgcaccctttacactcggc

SEQ ID NO: 4652 - DNA, 350 bp, Zea mays
  Clone ID: LIB3279-010-P1-K1-G11
cgcccaagcttcggcccgcaccagaacccggtggccacactgcagctctgcgtcggacacagctgcctcatcttccagctcctctacgccgactacgtccccggcgcgctggcggagttcctcggcgaccgcgggatccgcttcgtcggcgtcggcgtggaggcggacgcggagcggctcagcgacgaccacggtctggtggtggccaacgcggaggacctgcggggccgcgccgcggagcggatgaaccgcccggacctccgccaggcggtgctgcgtgcgctcgtgcaagtcgtcatgggcgtcaacctcgtgaagccgcagagggtcaccatgagccgctgggacgc

SEQ ID NO: 4653 - DNA, 400 bp, Zea mays
  Clone ID: LIB3279-010-P1-K1-G12
ctcagaaaaggagtacttcaagaaccactctgcagccattaaatcatacatatcagagatggatatagatttgacagtggacatggttcctcccaaggatccttacattcaggttcgggtgctggaggacattggtgaagtatcgctcggtgaccattctgtgtcattgaccaagaactcactccatttcctaaggcgcacagacgctgaacagtttatatcacagggtcttatggaagaatttctggagtagggatcacatgtatgaatgtatgatggtacaataggatggtgcacttgcctcgttctccccagcgctgctgcctgatgccctatttgcaacaatgaaaaggtacatcaagacatgaaacgcgttctgaaccaaagagcttcttaacta

SEQ ID NO: 4654 - DNA, 395 bp, Zea mays
  unsure (1)..(395): unsure at all n locations; Clone ID: LIB3279-010-P1-K1-G2
ggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgctaagtttgtgttctgtcagggggcatgttggtgctcgtagtcccagcttatatttatctatgttccaacagttgagacttggtagaactgagcanaccatgtaaagatgctgctgngtgcatccctaaaaaaatgcctgacttgtgatac

SEQ ID NO: 4655 - DNA, 315 bp, Zea mays
  Clone ID: LIB3279-010-P1-K1-G3
agcccccagaatcatttgtcagccgtgttaaggcagctcctagggctgatgatgatgagtttgctgatacagctgaaacagggtattcggagtccccatcccagggagttgatggggcgtcgccttcctctagtgctggtacttcttctaatgtacccgtgaaacagccggcggcagcatccccacctggtccagtggcaatgccagaccttttaggtgatttaatgggtatggataatgctattgtccctgttgatgaacctgcagcaccttctggccctccgctacctgtcttactgccttcgtatacaggtc

SEQ ID NO: 4656 - DNA, 262 bp, Zea mays
  Clone ID: LIB3279-010-P1-K1-G4
cgctggtacggaactgcctcaaggagcccttcaagtccgaggccgcgtcccgcgagaaggtccatttctccatctccaagtggacggatggcaaacaggagaagcccactgtccgcacagaatccgatgaataaagctctggtgccatagtggcatagtccttgctacagatgatttgaagtgttgttgcaagtttccggaacatgctatttagctggcttgattttatagtcaatgctgaataataaatactttttacgac

SEQ ID NO: 4657 - DNA, 416 bp, Zea mays
  Clone ID: LIB3279-010-P1-K1-G5
cggcttgcttgattgttccaggtattcgcagtcgaccgtgtcctcggagcacgatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcagtcccatgtggcggcggcggtgtggctgttgcggcaggtgcacctgctgctggcggagctgctcctgcagctgaggcaaagaaagaagagaaggtggaagagaaggaagaaagcgatgatgatatgggcttcagcctcttcgactaggttgcacagtcatcacagtattgt

SEQ ID NO: 4658 - DNA, 389 bp, Zea mays
  Clone ID: LIB3279-010-P1-K1-G6
cgtcagtccgtcacccctcgcgcccatagtccccttccccataccatgtccgacctccacccgccggagcaccaagtcgccggccaccgcgcctccgccagcaagctgggcccgctcatcgacggctccggcctcttctacaagccgctccaggccggcgaccgtggggagcacgaggtcgccttctatgaggcgttctccgcccacgccgccgtcccggcccgcatccgagacaccttcttcccccggttccacggcacgcgactcctccccaccgaggcgcagcccggggagccgcatcctcacctcgtcctcgacgacctcctcgcggtgtttcaggcgccctgcgtcgcagacatcaagatcggcgccatcacgtggccaccgag

SEQ ID NO: 4659 - DNA, 372 bp, Zea mays
  Clone ID: LIB3279-010-P1-K1-G7
gcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctctaagtgccacaaggagatgataacgaagcaggatcaggccaagctggctgcctcctctatcgacagcatcgtgaacggcagcgacgccgtcatggagcccgttgttgctggcagcaacacggtagtagctgttgcccaagtcgagttgcaaacaatgaacgtg

SEQ ID NO: 4660 - DNA, 212 bp, Zea mays
  Clone ID: LIB3279-010-P1-K1-G8
cgccactcaatcccctgctattcctatactctcgcctcctattctacctctaaggtgtacgcttagaagaatcataaagcaccccacctcatccaagttaacagaacccacccatcacattgagactttctgccaggcccacaagcctacccatcctctgcaataataactatcactttgttcatcagctctgaaaccatttacatctactc

SEQ ID NO: 4661 - DNA, 295 bp, Zea mays
  Clone ID: LIB3279-010-P1-K1-G9
cttccaccgcctccttgggaggctcagccagcgtcaaacaatgaattgccaaatggccaattgggaagcttgcaacctctcccaggttcagctggccagatcggtggcatgcagcagccactgcaaccacaagttaaccacatgggagttccacaaagccagccaatgtatagtaaccaaccaatgcgacccggtcaggttgccgccacaacacagatgcagcctggcttcggaaaccagcagttcggttcgctaccaccaacatccatgctgggcatgcaattcggtggcatgc

SEQ ID NO: 4662 - DNA, 288 bp, Zea mays
  Clone ID: LIB3279-010-P1-K1-H1
agacacgcgtgcgtgatcaagcctggatgggacggtgttgacacagcacgtcctgtgtgcggcgatctcgaactgggtcagttcgtggagatgttcttctaggattctttcgtcattttgttttctgcttcgttgaaactgatcgagggtagcgcgtctttctgatggtcagagactcaagaccagttcatcaagtactccttagttgtttccgcttttgcttccttcgaactcatcgagcttagctgcgttcctgctcttttgttaggacttcagagctgagtccac

SEQ ID NO: 4663 - DNA, 129 bp, Zea mays
  Clone ID: LIB3279-010-P1-K1-H10
cccacacttcctatcaacttttcccaacaccttcaaagacatattttcttcaagagatctctctcacttatgggagattttttttttgaatattatctttttaaacattatttataacaattatattta

SEQ ID NO: 4664 - DNA, 441 bp, Zea mays
  Clone ID: LIB3279-010-P1-K1-H11
tggatctgttggagcggaatattaagacggagacgggggagacgcgcaaggaacaggagcgtaaggaggaggtggaggcggaggcgggggagaggaagacccaggagccgccgcagcaaggccagggcctcagcctctcactcgccaacggcagtggcaggtctggaatgttgccgatgtcaaacatgtcagctaatccttcacagcttacaattttctatggcggatcagtatgtgtgtatgactcagtgccaccggaaaaggctcaagcaatcatgcttatagctgcagctgcagcggcagcggcagctaccaaaagcagtgctgcccctactgttaagcctccaatggtgcctgcagccactgttgccccagcagctgtcgtttctcctgtgcttacacggtctccatcactgcagagcacttctgtagcaactgggc

SEQ ID NO: 4665 - DNA, 265 bp, Zea mays
  Clone ID: LIB3279-010-P1-K1-H12
ctcagaaaaggagtacttcaagaaccactctgcagccattaaatcatacatatcagagatggatatagatatgacagtggacatggttcctaccaaggatccttacattcaggttcgggtgctggaggacattggtgaagtatcgctcggtgaccattctgtgtgattgaccaagaactcactccatgtcctaaggcgcacaaacgctgaacaggttatatcacaggggctgatggatgaatttctcgatggcggttcacaatgt

SEQ ID NO: 4666 - DNA, 403 bp, Zea mays
  Clone ID: LIB3279-010-P1-K1-H2
agcccgcccgcccgcccgcccgtgtgccgtttaccggagcacaacacaacgcggcccgctcacggcgtggagtggattgggccgacgccgatcgagagcagaggagaggagcgcggtcggatagggtttgtctgggtgaggttttgagcgagagcgcatggcgagggaaggaggaggaggaggactggctcctggaggaggaggccggccggtgcttggatggtcgcggagcgctcccgtaggtggtgtccatggtaaggtcgttcagggactcgctcaaggtgctcgaggccgacattcagcatgccaactccattgcttcttgatttcggagggaatatgatggcgccttccttcaaaagaggttggcatattgcccttgtggcctattttttcttttttt

SEQ ID NO: 4667 - DNA, 346 bp, Zea mays
  Clone ID: LIB3279-010-P1-K1-H3
gggctggccgtgtggcacgccatcgagcagtgggtgacggagtacctggccatctactaccccaacgacggcgtgctgcaggccgacgtggagctgcaggcgtggtggaaggaggcgcgcgaggtcgggcacgccgacctcaaggacgagcactggtggcccaagatgcagacggtgccggagctcgtgaaggcctgcaccaccatcatctggatcgcgtcggcgctacacgctgccgtcaacttcgggcagtacccgtactgcgggtaccacccgaaccggccgtccgtgagccggcggcccatgccggtgccgggctccgacgcgtacaatgagctggagaaga

SEQ ID NO: 4668 - DNA, 439 bp, Zea mays
  unsure (1)..(439): unsure at all n locations; Clone ID: LIB3279-010-P1-K1-H4
cccacgcgtccgaagagatcaagatccaggcttgggaggaccatcagaaagcccagatagaagctgagatgaggaaaatcgaggtcgaggtggagcggatgcgtgcccgcgcgcaagacaagctgatgaccaagctcgcgtcggcgaggcacagcgcagacgagaagcgtgccgcggcggatctgaaacggaaccgcgcagccgcgaggaccgctgagcaggcagagcacatcatgaggaccggccgggtgccgccgtcgtttggctgctggaactggtgctcatgaagtgcccatggaagatgagtcgcccgttgagaatgagtcgcttgtaagctgctgtaactatatatatatatacacacgtatgtaagatgtgagatccatgcgtnctgtgctgtggtggttactgtgtaagtgtcacagatgtaccgaattca

SEQ ID NO: 4669 - DNA, 452 bp, Zea mays
  Clone ID: LIB3279-010-P1-K1-H5
cccacgcgtccggtttgcaagtttagatataagcaaaggcttgattttgttgttatcagccttttcacttggctttaattcgtaccggtttctactgcttctacagtcctgtctctatgaattgcagctgcggcgagagatcttatgaactcgtcagtgacttgatcttttgtaggcacaaaatcaacatcaagtaattttctggtcactcattctctctcataaagtgggaatcaacttcaatgtgcttttttcagcatgaaaaaactagattaaatgctagcaatccatgttatcaacatatagctttgcacatggacttcacgttgtgtcccttgttgtcgtgttgcgccaatttttagtggtctgtccttagccgggtgctagggtatcaagcacattctgtcgctgctagctctcgtatgattagcctactttcgctaactgatgct

SEQ ID NO: 4670 - DNA, 296 bp, Zea mays
  Clone ID: LIB3279-010-P1-K1-H6
gccgcaacagcacctatcgaagccgcagcagcagggggaggcaggggaatcccaagcggaggggtctcctcgctctcctatctccgttatatcagctgcggcgggcggcgatgggtgcgcggaggaggctgctggcggacacgccgccggagcatcgccataggcagggcgcgccggcgtcggactggagcgcggtgtaccttaacgggtggctgtcgcatacgacgcctctcttcgggcgccgtctctgggttctcgccggaatcgccgagggcgcctgcttatagctcgagctg

SEQ ID NO: 4671 - DNA, 330 bp, Zea mays
  Clone ID: LIB3279-010-P1-K1-H7
ctgtgagaaagtgtcatccctgtttggcagtggacttggtccggacatgtgcaaacaattcaatgatgtggtgcgtcgacatggtgtgcatcactctgtgactgtgagtgattctgaggataccgctgcgccgtcccagctggttcaatcccctcgtaacgccttgcctttgaaggaacccagtgggaaggctagaccaagtaaatatgaatcaccaaatgccagcaacttcatcgtcaggcatgtggcaactggcaaagagggcaacaatgatgagtatgctaactcaaactactactattcgttgtctgccaatcgactaggagacga

SEQ ID NO: 4672 - DNA, 272 bp, Zea mays
  Clone ID: LIB3279-010-P1-K1-H8
agcaccaccaaaccaaaccaaaccaataggcaattagctcgagcaaagaggcaggagaaacaagccaaaaggcaacacccgcggcgacgcaagagggagaagcgagcgtgcagcggtcctcctctcgatccacatggccatggcggcagcggacggcatgagccggaggttcgcgctggcctgcggggtgctgagccagtacgtcaaggccgagcagcatcagcagcagcagatggcggccccgcgcgccccggccaccacgaccctgagcc

SEQ ID NO: 4673 - DNA, 339 bp, Zea mays
  Clone ID: LIB3279-010-P1-K1-H9
cgaagagtgtctgcaaggttgctccaatacctggagagacaaaagtgtggcagtacatcactctcactaaaaagatatttttgattgattgtcccggtgttgtatatcaaaacaatgattcagaaactgatatagttctgaagggtgtggtccgggtgacaaatttggcggatgctgctgagcacattggtgaagttcttaggcgtgttaaaaaggagcatctccaaagagcgtacaaaattcaagattggtctgatgataacgattttcttgtccagctgtgcaggaccactggaaaacttctcaagggcggggagcctgatctgacaacagcagcca

SEQ ID NO: 4674 - DNA, 350 bp, Zea mays
  Clone ID: LIB3279-011-P1-K1-A1
cggacgcgtgggcagtcttcgagtcctcgttgtgcctctcttgatctcctcgcgtccatggctcctgtgcgaggtgccaagaagaggaagcggccggagaagcccgccccggcgcctactccagggttgccgctgccgccgctgccggacggtagcgattggtggggcgtcttctaccgaagggttgcaggacattccccttttccaagagaacaccagaacatggagtctgtcctgaagatgtcaagaagaaccttcgactacatctgctcacttgttaagaaggacctgacaacaaagacatacggtttcagaaacttcaggtttggtgacaagaaagttcttggggt

SEQ ID NO: 4675 - DNA, 441 bp, Zea mays
  Clone ID: LIB3279-011-P1-K1-A10
agcaccctagtcgtcgtagcggcctacgggctcttgggcagagagagaagctgcatagcctgcatatgctccagctgctgcgcgcaatgatggcactgacggagcggcagccgcagctggagaagaagccgacgcgcgggagggcgccgctgtccgggaaggccgtcgcggcgctgtgcgtgacgagcttcgttgtggggctgctgcttagcggcaacgtgtcgctcatgtcggcctcggcgtcaccgtcgtcctcgagcacggacagcgagaagagcattcgtgtttccggttgcgacaatgagcgtaaactcggagagaaccaccccaaggatctcctgaacgaggtgtcgagaactcatcaagcaatccagtcgctggacaaggcggtgtccaccctggagatggagatggccgtggaacgcgctaagggcgggggcg

SEQ ID NO: 4676 - DNA, 419 bp, Zea mays
  Clone ID: LIB3279-011-P1-K1-A11
tcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaaattacgtgtggcggtggcggtcgtgttg

SEQ ID NO: 4677 - DNA, 331 bp, Zea mays
  Clone ID: LIB3279-011-P1-K1-A12
cgcatgcgccctgctagtccgttattctgtttcttataacccaccccttccttaaatgtttttaatcaaaggacaaagaagtgtatcggacatctaatgagttaagcccttaagggcacttcagggagatgaagctatgctacttattgaaaccctaacacctttctattttagaacatcaaataaagttgccctttaggccaaccaagattcccctataactgagctggaacgcaacccagctggtaaccggttacgtgtcgtagactcgtagtcttccagccaattatattcatctttacaatcttcaatgacaactttggaatttttt

SEQ ID NO: 4678 - DNA, 497 bp, Zea mays
  Clone ID: LIB3279-011-P1-K1-A2
gtcggattccaggtcgacgccacgcgtacgcgcacgcgtacgacttggtcctgaggactactgccagatcctccgggggctcggcgacagggataaatctgcacttcgtgcattcgaggtgttctatgccgcactacccttagttgggggtggtgctgttgacaagggaaaacttctgactgccgccattggtgcacttggcaagatgggccggccagacctcgcgaggagggcttttgatactggcattgcagggagctatggcaatacggtgtttgcgcattctgcgcttatctcagcttatgccaggagtgggcttgcaactgaggccatgggggtgcttgagtcgatgaaaggtgcaggattgcggcctaccacggtatcatacaatgcagtgattgatgcatgtggaaaagggggtgttgaccttaggttcacacttgggtatttccgtcaaatgctagcagatgggctctgtccggaccgtaaaacattta

SEQ ID NO: 4679 - DNA, 388 bp, Zea mays
  Clone ID: LIB3279-011-P1-K1-A4
gatgaatacactgatttggcttcactgaagtttttaagtatcgaaagtggtggatctttatttctttatgcaagtacagatgattcaacagttccccaagacatataccgattgctaagtcgaccctatgcatttggttgtgttctaaggctgagaacatcttcagattttgagccgggcaattcttatgggcatttcttccctgaccctcaatatgaaaatgtgcaacacatcatctgctgtgattcatttgccacttatgcatatgactttgagtttgcccataacgacggtttctccaggcacacagatcctgctgttgtacagattgcttttcagtacagcgtgattgaacctgtcaaggaaacatcaggcaatggatcacaac

SEQ ID NO: 4680 - DNA, 277 bp, Zea mays
  Clone ID: LIB3279-011-P1-K1-A5
ggagattatgctgaagcttgtctagggtcgatatatagatcaggtgctcttggaattgaaagagtatgctacagaggtggatgttgactatgtgcggaaagcctttcctgctagtggaatatgtgctattaaattggatagagctgctgaaaggtgccttatcgttttgcttgagctgattaagataaaagtcaattattgttgtcacgaagctataatagttatcaaagacatcattagacgctaccctaacacgtatgatgtatattatcgttta

SEQ ID NO: 4681 - DNA, 409 bp, Zea mays
  Clone ID: LIB3279-011-P1-K1-A6
cgacgctccgacaaccaccacacgcctcaggtttggctagtagacagcatcgacgacgaggaacagaagatggcaccgaaaggagccgtattcgtctcaatctcacagttccccatcaagaaaatccgcaaggattgcacctacctgagcactccagcaatgaagatccctgaaaccatgcaaaatatccatgcctgcgagaactggctgccaagacgggtgatgagcgcctggcgcatcggcgggatacttcacgccctggaagggtggaccgtgcacgagtgtggggacgccatggtgcatgctgagaaagcatggtcagctgctattaggcacggattcgttcctttgacgaaagcctgaaagcctgtacgcaactctagacgccattcgacgatggctggaaaac

SEQ ID NO: 4682 - DNA, 364 bp, Zea mays
  Clone ID: LIB3279-011-P1-K1-A7
cgcgtccgaccaaaccagcggcaccacccatggcttcggcggcggcgagatccggtctccggtcgctggcggtgcgcgccgccccgttgaggcgcctcatgtcctcctccgtccacgacgacgcctatgagacggccaagggggagaagatcacctacgccgggatcgtgacctgcaccctcctggcggcgtacaacctgtccaagggccacccctacttcgatgagccgtcggcgtacccctatcttgacagccgactcaaggcttttctaaggttacctgatggcttgtttgagacgaaagaccaccattgagccctgattagcacacctttaagagctggtgcacgctcaaaagagttata

SEQ ID NO: 4683 - DNA, 372 bp, Zea mays
  Clone ID: LIB3279-011-P1-K1-A8
gcttgtccatcggatcgttcctgaacacatgaggaagtgaagcggtggtggacgtgctggagagatccctgtttcgtgagggcatgctatggaggagcgatgtagctagcgaacgccttgctagatgtaaagagggctgaaagttccttgattgggcgtgtcaccaaggtgaccctagagggcaggcaaaccttacgtttgcttgttgcccatggtggaaatcggcttgtacctttcgcaatcgcatcttgtgtatcgacgatgacttaagggctgctgttgtattgtcaggttcatgctgaacaagagaattcagagtgctgtgctgtgcttggttcgttagctgggcaaaaaaataaattgagattttat

SEQ ID NO: 4684 - DNA, 205 bp, Zea mays
  unsure (1)..(205): unsure at all n locations; Clone ID: LIB3279-011-P1-K1-A9
gtaaaaaggagatataacatcatacacacacataccttaatcccactatcacggagagaggcccantatgggggggctccttcatctcctccttcccatcccttgttcccgacggacataatcgttacgtgaactacttctacgacccgaatgtgatcaactactacttacttcagtgtcaaccaatgtaacctgacagtattcg

SEQ ID NO: 4685 - DNA, 350 bp, Zea mays
  Clone ID: LIB3279-011-P1-K1-B1
cccacgcgtccgaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaagtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagca

SEQ ID NO: 4686 - DNA, 340 bp, Zea mays
  Clone ID: LIB3279-011-P1-K1-B10
gagagaaggaaaaatatccccaaaccctagctcccgatctcgatggcgaaccctcgcgtcttcttcgacatgaccgtcggcggcgccccggcggaccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcaca

SEQ ID NO: 4687 - DNA, 397 bp, Zea mays
  Clone ID: LIB3279-011-P1-K1-B11
cctcacccgcctccactcccccctcccaggtgctgcccaggtaagtcggcggcggcgatgacaacgcgcttcaagaagaaccgcaagaagcgcggccacgtgtccgccgggcacggccgcatcggcaagcacaggaagcacccgggaggtcgcggtaacgccggtggcatgcaccaccaccgtatcctcttcgacaagtaccatccgggctacttcggcaaggttggcatgcgttacttccataagctccgcaacaagttctactgccccgcggtcaacatcgagcgcctctggtcgatggtgcccgccgacaaggcggcggaggccggcggcgacaaggccccgcagatcgacgtcacgcagttcggctacttcaaggtgctcgggaagggggtgc

SEQ ID NO: 4688 - DNA, 428 bp, Zea mays
  Clone ID: LIB3279-011-P1-K1-B12
gcagagagcttgttccgtccaggcaaccaaaaagcaagttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccgattccagagccacgccgtgctggcgctccaggaggccgccgaggcctacctcgtcggtctcttcgaggacaccaacctctgcgccatccacgctaagcgcg

SEQ ID NO: 4689 - DNA, 390 bp, Zea mays
  Clone ID: LIB3279-011-P1-K1-B2
cagctgccaaggcgaagcccaagaccgccggcgctaagccgaagccacttgctaagaaggccggccgccccgccaaggcggcgaagacgtcggccaaggacacgccagggaagaaggcccctgccaagaaggccgctccctcgaagaaggcggcgaccccggtgcggaaagcgccgttccgtaaggccaagaagtaaagcggccaagaaggggggcgcgatgctgtaaatttgatatcggagaggctcgggtacactggtcattcagtatccgagaccgatagctgaggctagtggcgatggaggactgtgttattactactataaactggtggttgtgtttctgtaactggtgaatgatcaagttggaagcttttagtctatcttagat

SEQ ID NO: 4690 - DNA, 356 bp, Zea mays
  Clone ID: LIB3279-011-P1-K1-B3
caaagtagaataaaagagatgacctacaaaccatgcaacatacattgcgtggtcacagcgaagacaaggggcgcttgggttgcagatccttatctggggactgccgctacttcagatacatgactactagggtgatactctcattcacttgtctaggatttgtattagcttctgttctttaattgttgcatgaaggtgtctgatttgagcgcatatttgaggatctgcggattgtgctggtgtatttagtgcggtactgttcatgttcaggtttaggatcgcagttttattgtcactttgttgtgagcccgaacgcatctaccaacaatctattctcataagtcgtgccttatgtg

SEQ ID NO: 4691 - DNA, 447 bp, Zea mays
  Clone ID: LIB3279-011-P1-K1-B4
gctgcgcctcgactcgtagcccgaaccctagccaccaagccggaggcgagagagcagccatggcgcggtgcctcgcgctcgtcgccctcctcgtactcggcctcgccgccgccgcctccgcggccgacgcgcccttcgtcgtcgcgcacaagaagatttcgctctcccgccccaagccgggcgtcgagcgcgtcgtcgtctccctcgacctctacaaccagggatccgcgactgcctatgatgtgtccattaatgacgactcttggccaacagaagtgtttgagctagtcactggagagaaatcgaagacattggaaaggctagaccctggtgccactgcttcgcacacatatgtcctggagaccaaaacacagggcaggttccagggttcaccagctattattacataccgtgttccacaaagacagctcttcaagaggcatactc

SEQ ID NO: 4692 - DNA, 246 bp, Zea mays
  Clone ID: LIB3279-011-P1-K1-B5
cttcccaaatctcagttgtcgcctgtcgtcgctttcttctagcctggacggttacaaaacctgcgtagccgccgacgccaccccggcgaccgaagatgatctccctggacgcagcccgcaacgtagtcggcatcatcggcaatgtcatctacttcggcctcttcctgtccccagagctgacgttctggcggatctacaaggccaaggacgtggaggagttcaagtcggacccttacctggcgacgc

SEQ ID NO: 4693 - DNA, 209 bp, Zea mays
  unsure (1)..(209): unsure at all n locations; Clone ID: LIB3279-011-P1-K1-B6
ccgacgcgttcgntttcaaatctcatttttcccctccccttgccattatctagcccgtccctttccagagccaagatagtcgctctctttacccaactctcccaaaatcatcctcccggacgcagcccgcaatgtagtcgccatcataggaaatgtcaactaggtggggctgttcttgtcgccagtgccgaccgtctggcggatctaca

SEQ ID NO: 4694 - DNA, 369 bp, Zea mays
  unsure (1)..(369): unsure at all n locations; Clone ID: LIB3279-011-P1-K1-B7
cggacttactttatagatctgagtgcaaattttttactaccttgagaatttacacagacatcaaatgcttttgtgtagttagacaatatactctcaccaaggcacgtcagatgatggtgaaaactaaagatcatcgccatattgactgattggattgctccaatatcattattgcacgacaaaataggtggcgatcatcggggcctctaacatagaggagccgatactactactgctgctatcaactgccatttgacgcgttgctctaactactccaggcaatcaattgtgtagtcgactatcaatatgaaagagtcaagtacatcggcgtttcgggtgtnaaaaagctaaaagtacgctgatgtgggc

SEQ ID NO: 4695 - DNA, 419 bp, Zea mays
  Clone ID: LIB3279-011-P1-K1-B8
gcaaacactgcatcagaccctaacagctgtcgctgctaaaccagccttcactgcagaaggttcacatactttgactaatccttcaaagtttcttaataaaccacaatacaacgaatcatctttggtaggcaagacgagcacggattccgatcctaagaggtggccttctgcttctggcacaactgtatctcatgtgtctgatattgtagggccggatggtctggtctacgctgttgagttctctcacaggagtggaagagaccttgtcaacatggcaaagaagaggaccaatgtgatccctattattgaggatgccaggcatccggcaaggtaccggatgttggttggcatggttgatgttatcttctctgatgttgcacagccagaccaggctaggatcttagcacttaatgcttcat

SEQ ID NO: 4696 - DNA, 396 bp, Zea mays
  Clone ID: LIB3279-011-P1-K1-B9
ggcaacgtccaaaatccagaccgctggtaggagtatctcgtcgacattgaacaacgggtgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggtgcggcgaaaatgatggcctcctttggctgccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacggacccggccgggcagcttccgtgccctctggtgtc

SEQ ID NO: 4697 - DNA, 454 bp, Zea mays
  Clone ID: LIB3279-011-P1-K1-C1
cggacgcgtgggaaagacaccatatcaaactgctccttcagatgccgcaccagtcaagaaggagcctgagagccagccatggctcggattaggaccgaatgccgtgaattccagcctgaacctcagctagtacacaacaacacagccataataagacggcacagcaacggcacccaccatgacctggagtttgctttgccactagatcgtgttcagaaaccataaatattcttagttatcgtgttttagtgttcgcttatgtcgaggttctacgccctcttgtcgcatagttctggatgtaaagaaaagtagccagtcatatgaccatcaccgggagtcgaagagaagtttttggggggtgttaacacacggcgactctgaattggccatgctaaagaaaacgatagtgcgatgtgaagtatatgtattttctgaaagccagatcgtttgggtc

SEQ ID NO: 4698 - DNA, 389 bp, Zea mays
  Clone ID: LIB3279-011-P1-K1-C10
tacaaaggaatgcttcgaagtgccaccgaaagcaacccgtgtagtttctagagagaaaggcgtttccattgtcgttgatgcattcccatgattatgttccaaaagggtagcattagttggagaatctgctcatactgtccaccccttaacccggcaaggtgtaaacttgggctttggtgatgctgctgctttaacaaaagttattgctgagggagtttcagtgggctcggatgttggggatctgactttgctacagcggtattagaaggagaggaaggcttcctatgtggcgatggcagcagtgctagatggttttcagaagatgtactctagtgatttggggccccttaatgtagtgagagctgctgcgtttcacggtgcccagttca

SEQ ID NO: 4699 - DNA, 439 bp, Zea mays
  Clone ID: LIB3279-011-P1-K1-C11
ccagattttgtggcaattgctaaagggttcaacattccagcagtccgtgtgacaaagaagagcgaagtccatgcagcaatcaagaagatgcttgaggctccagggccgtacctcttggatataatcgtcccgcaccaggagcatgtgttgcctatgatccctagtggtggggctttcaaggatatgatcctggatggtgatggcaggactgtgtattgatctaaagttcagcaagcactgcctacctgcctatctttgacatgcatgagctagtacaagtgtgatatgtttttatcgatgtgatggtactctgttatggtaatcttaagtagcatccaaccctgtgtgtagtatgttggttccgtgttggcatatgtttcagaagccatcatgtaagtgccttttactacataatataaataaggtaataagcattggt

SEQ ID NO: 4700 - DNA, 440 bp, Zea mays
  Clone ID: LIB3279-011-P1-K1-C12
cgctacgcgcagtggaagtcgctcatccccgtcctctacgactggtttgccaaccacaacctcgtctggccatccctctcatgccggtgggggccacagtttgagaaagctacctacaagaatcgtcagcgcctttacctatctgaacagacggatgggagtgtgcctaatactctggttatcgcaaattgtgaagttgtgaaacctagggttgcagctgctgaacatatctcacagttcaatgaggaagcacggtcaccttttgtaaagaagtacaaaactatagttcatcctggtgaggttaacagaatcagggaacttccacagaacagtaagatcatagccactcacactgacagtccagatgtactttattgggatgttgaagcacaaccaaatagacatgcttgtcctagagcaagcgagtctcgccctgatct

SEQ ID NO: 4701 - DNA, 306 bp, Zea mays
  Clone ID: LIB3279-011-P1-K1-C2
taaggatagaacacgaaaacaaaattaagctcaggagccaggaccacatcaactcagtaacagaggtaccaatataataagacagaaactactgctgcatttatgttccaacctcaaacagatctaaatgatattcaaatcgagtaaccaacaggtgaatgcttgataggtaggcgggtgaagcaaagcggcgcatgggattacgccttctgattgtagacgtaggtgaggccgcacttgccgcagtagtggcggtcgaagtggttggccatgaaaacacccgcaccgcactcggtgttggggcac

SEQ ID NO: 4702 - DNA, 391 bp, Zea mays
  Clone ID: LIB3279-011-P1-K1-C3
actagtgctagaccgctcgcctgctctcaccgaccagcgccgcgccactcctccgacggatctgcagcatgcagccctactcctcgtactcctccgctcacccgcccgaccatcccaactccaagcccccggccccgccggcccccgccatgggctaccccgccaaccccgcccccaacgggaaccccagcgcctactttggcgccgcgccgcccgccagcgtcgccgacaacggctccgctccggcgaccttcggcgtagcgtacccctaccccgcccctgctcaccaccattacccggcgtcggaccagcactacccgtaccccccgcccccgccgacgcaccatcactacgtgtgccacccggcggcgccggccacctgcctgggccg

SEQ ID NO: 4703 - DNA, 107 bp, Zea mays
  Clone ID: LIB3279-011-P1-K1-C4
gttcctctctgttttcttcttgctctgtaacctggacctggtacgagtcagcagccagcagcaaactcgcgttttgcctgtaaaatctaaaatctgatatgagatgc

SEQ ID NO: 4704 - DNA, 162 bp, Zea mays
  Clone ID: LIB3279-011-P1-K1-C5
gtttagtagcataacagtagcagactattttatttctagggtctttgcctttaagcctatacccattatttctagtgtttagctgaagtgctgaactgctgaatctgaatgctggaattctgagcctggaactttgggtgggttttcaaagcctggaccaac

SEQ ID NO: 4705 - DNA, 51 bp, Zea mays
  unsure (1)..(51): unsure at all n locations; Clone ID: LIB3279-011-P1-K1-C6
agatattttcctacctncttcntaccatattatttctacgctctttgcctt

SEQ ID NO: 4706 - DNA, 449 bp, Zea mays
  Clone ID: LIB3279-011-P1-K1-C7
cccacgcgtccgccgtgaggcagtagatgtgacagacaccaagggcttcagcttgaaaggcactggtgttacgaccgacgtgcagaccagctacgcggcacggatcatggggctatctgtcatccccttcatcatcgctcagttccccaagatgttgaagacgcaccacgggcagcgcctcgctatgctgctggcccttgtcgtgtcgttcgcgctcgtgcttgcctactgcctgtaccaggttttccagccttggattcagaggaggaagctcgcgtacgcgaagcacaagcacgtgatctccgggatactgaggcacgcccagatgcagtcgctcggccgcctgctgaacgacgacggcacgcccaatgaacaagtcatcagaaagctgttccgcaagatcgacatggacgagagccggtccctgtcccgcgccgagctccacgccc

SEQ ID NO: 4707 - DNA, 392 bp, Zea mays
  Clone ID: LIB3279-011-P1-K1-C8
ggaggattggaggaatggaagcaaccggcgcagcctcgcagccctcggcgccgcagacaactcacccggcggtggcgccgctggccttcctgctggggaagtggcgcggggaaggcgagggcagcttccccaccatatcctccttccggtacggcgaggagctcctcttctcgcatcatccctccaagccagtgatctcgtacacgcagaagacgtggaagacggcgtctggcgagccgatgcacgccgagagcgggtactggcggccctgccctgacggctccgtagacgtggtcatcgctcagagcactggcctcgccgaggtccagaagggttcatttgatgctgaaaagaaaacagtgacactccaaagcgaactcgtagggaatgca

SEQ ID NO: 4708 - DNA, 249 bp, Zea mays
  Clone ID: LIB3279-011-P1-K1-C9
tgctggactctagcggtcttagccttactgagacactgacgataagataagttgtgtgtgtaacagcctaacaggggatacaatagtgctgtctagggcagcgggcgaacaggcacactatcgctattacgtttctagcagccattactaggcgatatgcttgtttaaaaaaaaaaaaaaaaaaaaaaaaaaaaaaaaaaaaaaaaaaaaaaaaaaaaaaaaaaaaaaaaaagataaaaactatataat

SEQ ID NO: 4709 - DNA, 358 bp, Zea mays
  unsure (1)..(358): unsure at all n locations; Clone ID: LIB3279-011-P1-K1-D1
cgaggggaacacatatcgatttaacattcctgtacatatacaagacttccttgactcgcattatggaaaaacttcgatgaactagatagttgtgcctaaggctattaagaatccatctactaaaaatccagccgaggaagagctccttttaaaatgtatataatgcactactaggcacaaggccgagaagcgccttccggcggccaagtcgttcggcaaagaaggcggcgacaagaagggtaagaagaaagcgaagaagtcggtggagacctacaagatctnnggggggggccgttctaaaggatccaagcttacttacgggtgcatgcaacataataatttttttatggggtccctt

SEQ ID NO: 4710 - DNA, 371 bp, Zea mays
  unsure (1)..(371): unsure at all n locations; Clone ID: LIB3279-011-P1-K1-D10
cccgtccccgcccctccatctagccaccgcttccacacgtccacgtccgcatgcccccgccacctgcgcccctcccctgctacacgcctccgcgctgcccggcgtcggcatcccgacgccgtcgttgtcgtcccagatgcccgcccctgggtcggcgatctatcgggcgccgccgcgtcctaccgggacggaagtgaggaggacgaagacgacgcagatgaagatgaggacgaagacgaggaccgcagcctggacctactggcccggttcctgcactccgtattcaggaaggcctnacgccgcgcgcgccgtgctgtcaggtgaagttttcggtcaatggcgtgcttgtcctgacgttcttatggatcctg

SEQ ID NO: 4711 - DNA, 432 bp, Zea mays
  unsure (1)..(432): unsure at all n locations; Clone ID: LIB3279-011-P1-K1-D11
cccacgcgtccgcccacgcgtccggagagacgccactaccaccaccgcaagcgacgacggggagatgtttctgcgacggatcctgaccggcggaggtggcctggcggcgctgagggcggcgcgcgccgtgaaggagacgacggggatcgtcggccttgaggtggcgcccaacgcgcgggaggttctcatcgggctctacacgcgtacgctcaaggagatcgaggccgtccccaaagacgagggctaccgcaaggccgttgagtccttcaccaatcaccgcctccagatctgccaggaggaggacgactggaagcgcatcgaggaccgaatcggatgcgggcaagtcgaggagctcatcgaggaggccgaggacgagctcaagctcatcgccaaaatgatngaatgggatccgtggggtgtccctgatgacta

SEQ ID NO: 4712 - DNA, 269 bp, Zea mays
  Clone ID: LIB3279-011-P1-K1-D12
cctcgaaggagtagactctggtcagcggtgataatcgtgattccatatattgtagaactataatccctgctagtaatccatttgtgctgtttatgtatcgaaggcagcaaagatgtgtgaagcggcaatgggatgcttgctgtaaggtaatatgtttggcttgctaggcatgctacacgctatttggatgtagcaacgttatcaccagctgtatacgctttttaatcgacaacatttgaataatatgtacataacattatgttgtgctc

SEQ ID NO: 4713 - DNA, 432 bp, Zea mays
  Clone ID: LIB3279-011-P1-K1-D2
accgcaccggcaccaccaccaaccgagcggctgcaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgctatcaaaaatcctggagaagtaccagaccaactctggaaagatactgtggggtgagaagcacaagagccttagtgcagagattgaccgtataaagaaagagaacgacaccatgcagatcgagctcaggcacctg

SEQ ID NO: 4714 - DNA, 176 bp, Zea mays
  Clone ID: LIB3279-011-P1-K1-D3
cccacactttcaccactaccaacctagcgtctccaggctcctgctcaagaaggttagaagaggggagccttccttgtgaagtcgctggttgtttataatgtgcacatagatggctccctggaagatcgatatcaagcggatcgagaacttcaccaaccgccaggtgacctttttca

SEQ ID NO: 4715 - DNA, 372 bp, Zea mays
  Clone ID: LIB3279-011-P1-K1-D4
gcaagtctcgctacgtagcagtgcaataaaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccggcggcggcgtccgggagcccgtggtacggccccgaccgcgtgctgtacctgggcccactgtccggcgagccgccgagctacctgacgggcgagttcccgggcgactacggctgggacaccgcggtgctgtcggcggacccggagacgttcgccaagaaccgggagctggaggtgatccactcccgctgagccatgctgggcg

SEQ ID NO: 4716 - DNA, 389 bp, Zea mays
  Clone ID: LIB3279-011-P1-K1-D5
cccacgcgtccgcttttctcgcactcgtactccctcctccgctccggctaggaggctgctccctccgccgctccgccttcgtcgcgcggccatcgtttccggctctgtccccggatatctcttcgccaccgcttcctgcgccgcggcgccgccacaaccgaaggcgacccagtcgcagtcgccttcaacactatggtgactcctcccactgtcgagcaagaggacgaggagatgctccgggccccgccaggaggcggtcgcaaccgacccacgccacccaatggaaggggtcgcacagactgaggtggtgagcacggcggagagccagcctgtggaagatccgcagacatcacggttcacttggacaattgagaacttcaccaggttca

SEQ ID NO: 4717 - DNA, 189 bp, Zea mays
  unsure (1)..(189): unsure at all n locations; Clone ID: LIB3279-011-P1-K1-D6
agaaatttgaccgcatacttgttgtcatatcacactcccaagattttctaaatggagggtgggctaacattatccatatgcaaaacaagaagctcaagttatacaccggtaactacgatcagtatgttcaaactcgctccgatcttgaagagaatcaaatgaagcagtacanatgggagcaggaacaga

SEQ ID NO: 4718 - DNA, 413 bp, Zea mays
  Clone ID: LIB3279-011-P1-K1-D7
cccacgcgtccgagcgaatccctcgcatcgcattcgcagcctttgctgcatcacaccaccgcgaaaccccagcagccgcatcgatggcgcccaaggcggagaagaagccggctgcgaagaagccagcggaggaggagcccgctgccgcgaaggccccggcggggaagaagcccaaggccgagaagcgcctcccggcggccaagtcgtccggcaaagaaggcggcgacaagaagggtaagaagaaggcgaagaagtcggtggagacctacaagatctacatcttcaaggtgctgaagcaggtccaccccgacatcggcatctcttccaaggccatgtccatcatgaactccttcatcaacgacatcttcgagaagctcgccggcgaggctgccaagcttgcgcgctacaacaag

SEQ ID NO: 4719 - DNA, 409 bp, Zea mays
  Clone ID: LIB3279-011-P1-K1-D8
ctcagccaccgcaaaatccccaaatccgcggcggagaggagagagccggatagaggggcgcatccagagagatcggagaaggggaagaagatggtgcgggtggcgacctacttcgcgatgaccttcggggcgttcctcttctggcagtccatggacagggtccacgtctggatcgcccttcaccaggacgagaagaaagaaaggatgcaaagggagctggagataaagagaatgcaagcagagttactggcccaagctaaagagaatgaatcatgattgtcatttgtccaatggtttcaggcagttcctttatcgtatttcctctgctgtattttccatgcaatatcttgactgatgtatgctcatgctcaacaccttcaaataagcgagacatgctatagcattgttg

SEQ ID NO: 4720 - DNA, 468 bp, Zea mays
  Clone ID: LIB3279-011-P1-K1-D9
aacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgtggccaaccctaggcagttcaaggtgccggactggttcctcaacaggaagaaggattacaaggacggaaggttctcacaggtcgtttccaacgccctcgacatgaagctcagggacgacctcgagaggctcaagaagatcaagaaccaccgtggtctgcgtcactactggggcctccgtgtccgtggccagcacaccaagaccactggcaggcgtggaaaaactgttggtgtcttcaagaagcgataagctacatatctatcgacaaatctcagatgtactagtg

SEQ ID NO: 4721 - DNA, 447 bp, Zea mays
  Clone ID: LIB3279-011-P1-K1-E1
aattacggcaataccagtgcggcatccatcccattagcattggatgaggctgttcgcagtggcaaggtgaagactggtgatattattgccgcatcaggttttggcgctggacttacctggggttcagctattgtcaaatggggctaattattctacgtgagccataacaacatcaatgagatcttcataggccttggggacctacatctatttggtcttccccccctccacccattttctgtgcaacatttttctatcgcatgtgtcggtcttccttgcacatgaaaatctagtgccattttaccgtattcctttggctcattacacaactgagagtagattggtggatgaaaatggttgaattttgcatcgaggatgattgtggtggtactaaagatgagattacactgtaaagttaatgagcctttttgtcagggaattttactg

SEQ ID NO: 4722 - DNA, 412 bp, Zea mays
  Clone ID: LIB3279-011-P1-K1-E10
gccgcgggctcaagccggggggctcccgcgcctgcgccctcatcctcttgctcttcacatgggtggcattcctcatcgcggaggcgtgcctgctggcaggatcagtgcgcaacgcgtaccacacccggtacaggggcatattctacggcgactcgctctcatgtgagacggtgcggaagggcgtcttcgcggctggtgcggtcttcaccttcttcacggccatcctgggcgaggtgtactacctcagcttctccaagtcccgggacgccgccggtggtgccccctacggcggctccagcattggcatgggcccttacaactaactaatggccgcccccggtcgcttcatgctggaggaatgcagcagcagtgttctttttgacgttaccttagtagggacacggtgtaattg

SEQ ID NO: 4723 - DNA, 396 bp, Zea mays
  Clone ID: LIB3279-011-P1-K1-E11
caccacctgcaggctactgttacagtgctactgtcattacgccaccacacgagcttgcgcggcgactcggctgagggggacgaagcgttacgccatggactaccaccagggacagcagcccaactacaagatctatattaagatgatgaaaacaggtctgcttgacgtgaagtccactgataccatacatcagattaagtctaatattgttgctttagaggggattgacaatagccagcaagagcttttttttgctggaagtcatcaggagaaggacaacagacttagtgattacaacatcaagacaaactcttgtgtcgacccttatgtaactgatgggatacagatctctgtcaatatcccctctgtttggaagaccatcaaggtcaatgtgat

SEQ ID NO: 4724 - DNA, 429 bp, Zea mays
  Clone ID: LIB3279-011-P1-K1-E12
cccacgcgtccgtgcacacccaacgttgtctgaagttctggatgaactcttcaaggctgccaaggttaacacagctggttcgcattctatgaatgagccagttgcggtgtagagaggagccatagttgaaacaatctatctgctgcagccccacaccccagttatattgcctttagtacttaactagcctgctactcagaaaactgattttgtagccatttgcggacattttcgttatgagattcaggattagtgccagcactatctatttcatgagaaaatagaaatccaatgatctgtcccatgtatggaaaaatgtaaattttgtagtccttgtagagtaaatgtagtgcctttacgtggcaaaactcgctcttatggatctatgattacttcaaattataaagagggcttggtttgttcagcttt

SEQ ID NO: 4725 - DNA, 375 bp, Zea mays
  Clone ID: LIB3279-011-P1-K1-E2
gcgacgacaccttcgcgctgccgttctggaactgggatacgccggccggcatggtggtgccgccactcttcaaggactccatgggcaacccgctgtacgaccccaacaggaacccgtcgaacgtcgacgcgctggtggacttagactacctcaacgacaggaatgcggagcccatccctttcaagggcccacgggacgaaaagtacaaggaacttgtgaacaagaacctgtgcaccgtatacacccagcaaatacgtaacggcaagggcgccgagtcgttcctgggcgagaagtactgcaccgacatcgggtcaagcacgagcagcatgggttcgctggagcggatggcgcacactgtcgtgcacgtctgggtcg

SEQ ID NO: 4726 - DNA, 470 bp, Zea mays
  Clone ID: LIB3279-011-P1-K1-E3
gccgccgccgcctccgctgcgagatccttcctccggtccagcggctcatcgtctctccgcagcgcggcggccagagccgcctcgcgtgcgggaccgggaccggctccgctgccgaggcggatgcccacctctgccccccgtgtactcctaaggtcgccggtggaaatgagcagcgtgtgtctggagtccttgatgcccatgcacagcgccacggcttcggcgctcatgacgtcgcttctcgccgccccggcttgcaagggattcggttggctatcagaaggtcaagctgaaactagatgaacttcatgggacccaaaaggcctgtgattagtgcgatggacgtcaacttggatgaagactagactgctatttattttgccatctctgttgccttgggtttgcccattataaatggaacatagagcaatgtagctttcgtcgctggtaaattatatgatgtattctagagc

SEQ ID NO: 4727 - DNA, 420 bp, Zea mays
  Clone ID: LIB3279-011-P1-K1-E4
ggagaaggcggctctggtgcgagatcgttactcgggtccagcgggtcatcatctattgggcagggcggcggccagagtcgactcgcgtgcgggaccgggaccggctccggtgccgaggcggatgcccacctctgccccccgtgtactcctaaggtcgccggtggaaatgagcagcgtgtgtctggagtccttgatgcccatgcacagcgccacgggtgcagcgctcatgacgtcgcttctcgccgccccgaattgcaagggattcggttggctatcagaaagtcaagctgaagctagatgatcttatgggacccaaaaggtctgtgattagtgcgatggacggcaacttggatgaagactagaactgtaattaatttgccatctctgttgcctgggtttggccatataaatggacataga

SEQ ID NO: 4728 - DNA, 470 bp, Zea mays
  Clone ID: LIB3279-011-P1-K1-E6
cggacgcgtgggttccggcagaaatcaaggcagtattaggatggtgaccccgcgcctgttcgcgcgactctaccggcattgcgtcggcgcagcggctgcgtcatcagccgcggggcggcaccggggggccctggcagcggcggccgtggagcagttcgccggttcctccctgcctgtcggggttccaaaatgtttgaatcatcatttcagatactcaaccagcatttttcaaaagattggtttctcgtctgtttcaccacaacaaagtgatgatgatgttaatgagctgaaagaccacgaaagggccttagatggatcaagtgaagattgtccatctggaagtattgaaggcctagatctgtcgagagatgatttggtgaagctagttcgtgagaaggatggatagttgaagtccaaagatggtgaaatcaaagatatgaaggataaggttttgcgcagctatgcagaaa

SEQ ID NO: 4729 - DNA, 451 bp, Zea mays
  Clone ID: LIB3279-011-P1-K1-E7
gaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccgaaaactgcggctgcaagatccactagagactcatccaattccaccatggccgcgcgccacagcggcacagccgatggatcctttcatgttcctccgtccgttcgccttgctacaagcaggcaggcacaccaataagcta

SEQ ID NO: 4730 - DNA, 424 bp, Zea mays
  Clone ID: LIB3279-011-P1-K1-E8
gcaaaatctgcacgagagacagacgacgagatggccgatgcggaggacgccgccgccgcgcgccgacgggccgccataaccgactaccgcaagaagctgctcaactgcagggagctcgagtcgcgcgtcggcaccgtgagagaaagccttaaaaatgcaaagagggattttaccaagactgaagacgacttgaaatctctgcagagcgtggggcaaataattggagaggttctccgacctcttgataatgaacgctttattgtgaaggccagcagtggtccccgatatgtggtcggttgccgaagtaaagtagacaaggagaagttgacatctggaactcgtgttgtacttgacatgacgaccttgacaataatgcgcactctttcacgggaggtggatccagtggtatataacatgcttcatg

SEQ ID NO: 4731 - DNA, 317 bp, Zea mays
  Clone ID: LIB3279-011-P1-K1-E9
gttctccaggcccttctggtctctgcggccgtggccaaaggacctgcaggtacgtgtgcttgccgagatttcatctagctggctgctagcttgattggacgctgctagctcgtgtgtatacagttaatctgcgcgtatatatgtgcggggtgcatgtgacgaaataaagcgagtacgcatgatgctgccgcgcagggccgacgacgaaaaagcagtgctggtgcggcgagtgcaccaactggtcggacgtgtggaccttcgacgaccttcttaccaagtgcgccgtcacctgcaagaactgcgtccccgtgttcacg

SEQ ID NO: 4732 - DNA, 350 bp, Zea mays
  Clone ID: LIB3279-011-P1-K1-F1
gccttccaccactcgtgagacaaagggtatttacaggcgtggtctgttgaattagggggtattgggtcggcttgcccacaggaaaaagttttgagacatggtgagggctaaggagctttacgcggtgtctcagttccattacatgcatgtcgcagagatggattctatgtatgacagctgcaagactcatcgctcgtacatcaacaacaatgcctgcggcatagcataacggtatttgtaacatggtgcacggacagactatgatcatagggtacggctttatcagcatgactagaacggtaggagaagacacctattggttcaccgaccagaatatcgatgatctgcat

SEQ ID NO: 4733 - DNA, 340 bp, Zea mays
  unsure (1)..(340): unsure at all n locations; Clone ID: LIB3279-011-P1-K1-F11
gggtcgaaactgctcacactgtctggaagaggtggaactggagatcagagggggacctcctgctgaacggcgcctacttcaccccctccggcgcgggcgcctcagccagctactcgcgcgcgtccagccttggcgccaagtcatcatctatggtcggcaccatcaccctggatgccggtgccctgtcgtgccacaagggcgcggcctgctagcgcagccgccgcataaggaaacaaacccacccccacgccaccttttcaacaacagaaaagaaacaagacaacagaaaactaagctacctcaacaccatggttacagtntccccccgtctctctctctc

SEQ ID NO: 4734 - DNA, 228 bp, Zea mays
  Clone ID: LIB3279-011-P1-K1-F12
atggtcttcaaggtcaccgtaattacccgccagcacaatggagtcaaggtcactactgaagatggcacaagctacttggccgacgcctgcataatctcagtgccactcgaggtgctcaaggcgaacgtaataaagttcgagcctgagctgccccaatggaagagctccgccatcgccgacctcggcgtgagcaccgagaacaagatcgccatgcactccgacagggtc

SEQ ID NO: 4735 - DNA, 343 bp, Zea mays
  Clone ID: LIB3279-011-P1-K1-F2
cagaacttaatttcttgcgcccacagccaatgttttttcaactcaatcgtggtttaagcgtggtgctgcacacatggacgccagcgtagcaggtagaacggcaaataaaggggcgcctgcgcgcaaggttgtcgcccccaggaagaaatcggtgtcgagaatcattaaggccgcactgcaatgtctcatacgacggatcgggcgctacctcaagaagggtgaggcactcacagctcagttggcactcaggcctatgtgtatcttggcaacgtgctagaatacctggccactcatgtgcttgagctcgccgggaacgcggtgaaagacaacaagaagacgcgca

SEQ ID NO: 4736 - DNA, 366 bp, Zea mays
  unsure (1)..(366): unsure at all n locations; Clone ID: LIB3279-011-P1-K1-F3
ctcttcgagtggatagaattggaaccattgcacttttggcattccttactgttcatggatcagtataactatggcggaattcaagctaaaacacaaaacgtagactcttcagatggtgataatgatattgatattgtctcaagctggaacatggcagaagatttgcccaaagatacacaggatcattttgtcttaatcgtatcagaattcctatatattccgtggaaattcatgaaggaacaagtagctgctcaagctaccataagggatgatacctcatgcactccatctgtaacaatcatggctgctgagaatcttgagggccaggtgatagaacacctncgtgacaagattaagcattacttt

SEQ ID NO: 4737 - DNA, 416 bp, Zea mays
  Clone ID: LIB3279-011-P1-K1-F5
cccacgcgtccgcggacgcgtgggtttgactggacaatattgaagtaccaacaagctgaaattgccactgctccaccccgtgcgggccatggcgctgggccttctgggttggcacctgcattacagaatgataggcaaccaggccctgaggaagcaaggactagtggttggtcatcaatggatcggcgtcgtgccccactaccaattacaagtgtggggacattatctaagcagaaagcaccggtagggaatgatgctattgtttctagagacgctgtgatatctggaccaaatttcttgggaaggtcaagtggatcttcaaggaggcctgttatctcgagtagccgcgatgcggtggtcaccgatagttccgagccttcacgagcgcgcacaactgatgcaagccctagggtgtt

SEQ ID NO: 4738 - DNA, 424 bp, Zea mays
  Clone ID: LIB3279-011-P1-K1-F6
agaaatttgaccgcatacttgttgtcatatcacactcccaagattttctaaatggagtgtgtactaacattatccatatgcaaaacaagaagctcaagttatacaccggtaactacgatcagtatgttcaaactcgctccgatcttgaagagaatcaaatgaagcagtacaaatgggagcaggaacagattgcttcaatgaaggagtacattgctcgcttcggtcatggttctgcaaagcttgctcgtcaggctcagagcaaagagaaaactcttgcaaagatggagcgaggtggtctcaccgagaaggttgttagggacagagttctagtgttcaagtttacagatgttggcaaacttcctccacctgtgctgcagtttggtgaagtcaagtttgggtatacaccagataatctcatatacaa

SEQ ID NO: 4739 - DNA, 438 bp, Zea mays
  unsure (1)..(438): unsure at all n locations; Clone ID: LIB3279-011-P1-K1-F7
ggaatagtgagccgccccgccgctcctcagccatcctctccatctcggtgtcacacactccgcatacgcacctacgagagtcgagtgacagcgagcgagcgagcgagcgaagccatggctctccgcaccctggcatcgaagaacgccctatccttcgcgctcggcggcgcggcccggccgtcggcggcgtccgcgaggggggtgacgacggtcgcgctccccgacctctcctacgacttcggcgcgctggagccggccatctcgggggagatcatgcgcctgcaccaccagaagcaccacgccacctacgtcgtcaactacaacaaggcgctggagcagctcgacgctgccgtcgccaagggcgacgcctncgctgtcgtccagctccagggcgccatcaagttcaacggcggcggtcatgtgaaccattcaatcttt

SEQ ID NO: 4740 - DNA, 380 bp, Zea mays
  Clone ID: LIB3279-011-P1-K1-F8
cccacgcgtccgcccacgcgtccggatttgttcttccatccatggatgattttagcagtacagatcattctgtacacggacctaaagctttctttgcaaatatgccactgtcaaaaacacttacaatgaacatagatgttccagaaccatggcttgttgaaccagttattgccatccatgatttagacaacattcttttagagaatcttggcgatgtcagaactttgcaggcagtatttgaacttgaagctctcctcttgacaggtcattgcatggaaaaggaccgggaccctccccgtggtctgcagtttatccttggtactaaacaaagaccacacttagtagacacacttgtcatggccaacttgggttactggcag

SEQ ID NO: 4741 - DNA, 432 bp, Zea mays
  Clone ID: LIB3279-011-P1-K1-F9
cgtatgccttctgcgcctccatttcggtctctgtcccttgcaagttcaatctcacctgcaaccatgggtaaagagaagtcccacatcaacattgtggttattggccacgttgactctggcaagtcgaccaccacaggacacctgatctacaagcttggaggcattgacaagcgtgtgatcgagaggtttgagaaggaggctgctaaaatgaacaagcggtccttcaagtacgcatgggtgctcgacaaagctaaggctgagcgtgagagaggtatcaccattgatatcgctctgtggaagtttgagaccaccaagtactactgcacggtcatagatgcccctagacaccgtgacttcatcaagaacatgatcactggtaccttcgcagctgactgtgctgtccttatcattgacttcaccactggtgggttt

SEQ ID NO: 4742 - DNA, 464 bp, Zea mays
  Clone ID: LIB3279-011-P1-K1-G1
gcattccagggtaatcattggttcgacgggctagggtgctttctcacccggggaacggaagcgaatccagacgatggagaagaagaaggtggcgataccgctggtgtgccacggccactcgcggccggtggtggacctcttctacagccccgtcacacccgatggctacttcctcatcagcgccagcaaggatacaaatccaatgcttcgtaatggtgagactggcgactggattgggacttttcaaggtcataaaggagctgtttggagctgttgccttgacaggaatgctctgagggctgcatctgcttctgctgacttttcagctaaagtatgggatgcacttactggggatgagctacattcatttgaacacaagcatatagttcgggcatgtgccttctttgaggatacacaccttttactcactggaggcatgggaaagatttgcgtgtgtatgatat

SEQ ID NO: 4743 - DNA, 425 bp, Zea mays
  Clone ID: LIB3279-011-P1-K1-G10
ggacttcagaatatgcctcagatgaacttcaaccctggcgtggcagccgatagcgggaccaacaactctggctccatgaacatcgagcagtgagcttctgtatagctccggaattgttctgtgaatcatgaatcgtcgaaaagcgctcacggtgtggagtcttttttgtatagctggaggcctaaccattcatgccggtttccttctggtgcttccatactgtgcgacacattgtttatggtccggcacatgaggatcatgtacagctggagctgaaaaactgatgccactgtaaatttctgctgagttttggcctgaggaaattgggatggaaacctattaccatccatgaaatccaatggcagaagcttgttggaactagggaccaggtgctgaatgctgatgggccaacatactagaatgga

SEQ ID NO: 4744 - DNA, 480 bp, Zea mays
  Clone ID: LIB3279-011-P1-K1-G11
ggcgcagttttgaactgtggaaatagttttcgtccatcggttttgcaccatgaaaatctaaggccctcactcctatgctccataatagccatgtttatgattgagcaagcaatatccacaactatcttgctacctttctcatagatagtttgtgcaacccatcatcccaaattaccaaaaatattgaataacaaaattcaatcaagaaaaaactttacatattcatccaatagagcggccttagtagcatgcatcacacctcactattgatgcatccaatcttcctgatgacatagtacactttaattgtatcaccacttaaacatatttatgcggacttgaataattgtgggttaacgggagagggcgttgagagataacgtgactcccaactttgaccttgtcattgtggctttttatatctttttaaatgtcaagatagtgaatcagaaaccttctactagtctagttcattcttga

SEQ ID NO: 4745 - DNA, 232 bp, Zea mays
  Clone ID: LIB3279-011-P1-K1-G12
ggggacgcgcgctcactagcaaaaagcaggcctcttccctccggcgagccctgcttgtgcggggaccgagaggcgcccagctcttccccattcccgtaggcaacaagcgccgtgccttctcctacgcgttccccggtgcagcgcgctctctcaaagacgcttataatgcgccgtcgccgattatgccgacgctgccgtgaggtgatgcgcttgcagtcacgcagagcacctt

SEQ ID NO: 4746 - DNA, 305 bp, Zea mays
  Clone ID: LIB3279-011-P1-K1-G2
cccacgcgtccgcatggccgtcgccgtgaaggtggtgaaccctgacgtggccgtgcacgaggcccggttcgcccgagcggtggaacgcatcggccgggcgagacacccgaacctggtgacgctcgtgggcgcgtgcccggcggcgcgcgccgtcgtgtacgagctggtgccgggcgggagcctggaggagcgcctggacccgggaggcgggagcgggtcggcgccgccgccgttgccgcggcacgcagcggagcggcgtcgcctacggagcgtgctccgcgctagcgttcctgcactccacgctg

SEQ ID NO: 4747 - DNA, 428 bp, Zea mays
  Clone ID: LIB3279-011-P1-K1-G3
ctgtgctggacaagattgaccaggaactgttggcccgccgacctgatggatttgtgcctggtggatggactaacctactgaacacaactgagaaagggaaacccttcacggttgagcgcgtgcaagatctccgcccaggtcctggtgtggacagattaaagaaactcgtcacaggattgctcacccaagaaggttttgatgacaagcattgcctgtgaaactcccagtaagatgattctggggcagtaggttacacgctcaaatttgagggcatcgggccatttgctaggaatgcccctactagctgaggcagcagcacattagcgtcatgtacgcgaggatgcaacgataaggaaggtgctcttacagacaactgcttgaggtgagttaccgtacagcaagagaccacggttgtagcagtcggagat

SEQ ID NO: 4748 - DNA, 298 bp, Zea mays
  Clone ID: LIB3279-011-P1-K1-G4
gcggcaagggcttccgccgcgacgccaacctcaggatgcacatgcgcgcccacggcgaccgcttcaagaccctagacgcgctctcccgccctggtcacggccagccgaagccgcccgttggcagcaacgtgcgcttctcctgcccctttgcgggctgcaacaggaaccgcacacaccgtcgcttccggccgctcaagtcggcggtgtgcgcgcggaaccacttccggcgcagccactgccccaagctctacgcctgcgagcgatgtggcggcaagaagcgcttcgctgtcctggcgga

SEQ ID NO: 4749 - DNA, 346 bp, Zea mays
  Clone ID: LIB3279-011-P1-K1-G5
cgtcgccgctcttgttgtttccgatcccaaaccccaaacacgctccaccggcacctccgctcccacaccacaccgatggcccgcacgaagcagacggcgcgcaagtccaccggaggcaaggcgccgcggaagcagctggcgaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctcccctttcagcgcctggtccgcgagatcgcgcaggacttcaagaccgacctccgtttccagtcctccgccgtcg

SEQ ID NO: 4750 - DNA, 305 bp, Zea mays
  Clone ID: LIB3279-011-P1-K1-G6
cccacgcgtgcgtccagaccatcaaacaagtgccagcgcgctttggcagacgccgagagggagagcaccttcatcatgatcaagcctgacgagatccagaggcgcctcattggtgagatcatcagccgttgtgagaagaaggtcttgtacctaaaggactcgaaccttgctaacgtggagaggtcgttcgctgagaagcactactccgatctcgagtgcaagcccttcttccagggggtggtggactacatcatctctgaccctgtggaggtcatggtctgtgagggtaagagcaggatcacaac

SEQ ID NO: 4751 - DNA, 367 bp, Zea mays
  Clone ID: LIB3279-011-P1-K1-G7
tctactttactgtcctctaggctctagtcctctcgcatccgcagcttccccagccagctagggtttgcagatgacgaccgcagcgcgccccacctgggcgccggccaagggcggcaactagcaggggggcacccgcatattctgcccctcccagaagttctgatcccgcgacctcggcgcgcacacctcccttaagccaagaaaagacagtcaacagacccaagaggagttacagaagaggaatctcagggaggaacttgaggaacgtgagcgcaagcactactcttccaaggataagtcctattccgaaaaaagaaaccccgcggaaagctctagccctctactcttagaaggttcaaaagagaga

SEQ ID NO: 4752 - DNA, 299 bp, Zea mays
  Clone ID: LIB3279-011-P1-K1-G8
gctcccctccagcagcgagcgctcctccagctccgctcgcaacaacctcacggaaggaggggcggtgagcgacgaggagatacggcgggtgccggagatgggcggcgcgtcggcgtcggcctcgtcgggcgccggcgcggacgagcgtcccaagggggaggacggcaagcaggggcaggtggcggcgggggcgcaacctccggcgggcgggaagaagcgcgggcgcacggcgggggacaaggagcagaaccggctgaagcgggctgtgcggaaccgcgtgttcgcgcaacaagcgcggg

SEQ ID NO: 4753 - DNA, 362 bp, Zea mays
  Clone ID: LIB3279-011-P1-K1-G9
ggtagtgtcaggaagaaccaacccgagtggacagactgatgtaatcgtcttctgcagcggcgggttcgagaagttaggcaccacggaatcggaaggggagctgctctcccagcttgtcgacttgctgaagctgtctggggctagacacacgattctctacgcttcccagccatctggttatctactggagaacccttccggctcgccagtggctaggcaccttgcggagaggactaacggtacaaaaactggcctactgagcaaatgtgacggagagtgcctagtcaaatcaactcttcttgaaagaacctttgtcggaatagtgctccttatcatcttgatatcacggctcatgtgtatga

SEQ ID NO: 4754 - DNA, 471 bp, Zea mays
  Clone ID: LIB3279-011-P1-K1-H1
aggatatatcactcgtcaagaagttctatatgctctatagcttcttctttgtgaggagagttgtagcgccgacggctgcctgtattctctacaatgtcatcatccccatctcagtcacaatcccggagctttacctaccagtgtggggtgttgcctatattcccatggtgcttaccgtggtcacagctataagacatccaaaaaatctacacatactgccattttggattttgtttgagagtgtgatgacattgcatcggatgagggctgcgatgactggactgctggagctagaaggattcaaccagtggattgtgacaaagaaggtggggaatgatctcgaggacactgaagttcctttgcttcagaaaacctcgaaaaggctgagagacagagtcaatctccccgaggatggatttttggtgtttctctttctttgagcattatacaacatgtgttccatgggaaaac

SEQ ID NO: 4755 - DNA, 378 bp, Zea mays
  Clone ID: LIB3279-011-P1-K1-H10
cccacgcgtacgcccacgcgtccgattccactccgacattcacgtgcagctgtcggggagcaggcaatggcgccggatctaagcgaactcgccggcgtcgttgcagcccgtggcgcctacctcgccggcgtcggtgtcgcggacctcctcgctgcctgcttcctcccagtagccgagtcgtgctgcgtgcgagataactcattggtgagagacataagccaaatgccgcaaagcagctatgggattgaaggattgtgacatataacagttgctggtgcgctcaatcatgggatgaaggaggtggaagtgtggcttcagacaataagtccaggtcaaaagacgccgatccacatgcatttctgtgaagaaggtttcact

SEQ ID NO: 4756 - DNA, 293 bp, Zea mays
  Clone ID: LIB3279-011-P1-K1-H11
cgcacgcgtgcgcgcacgcgtgcgcgccagcatcagaatgtgaaattcaatgaagcgcgaatggaaagaggacacgattcttgtacaaagttacagttgactaccctcacgacacacgcacgcacgagttcatatataattctctcttcaacaagtgaagagtacgcctagcaccatagctaaaccttgtgtagcatctcatccacaacagaggtaagcatctgcgtcagattcattgcttgagctgtaactagactccctggggctgcagcctgccgttcctagatgagatg

SEQ ID NO: 4757 - DNA, 316 bp, Zea mays
  Clone ID: LIB3279-011-P1-K1-H12
ccgtccggaatcagggtggagcacgcgtacgcgacgcgtacggttttgttcttttttgagggcaattgaggactcagccactctgaagctgtatgggtggagagaaaggacccaacaacatagcagtctgaacactatgaagaagaagctgatccgcatagctcttgacatgattaggaaacttgctgaagaagaccctgatgagtacagcagcaaggataagactgatgaagagaaatacgagatggaggagaagaagggccagcacgccatagtctagaatgagtttggcaacataatcaagctgggtatcatt

SEQ ID NO: 4758 - DNA, 354 bp, Zea mays
  Clone ID: LIB3279-011-P1-K1-H2
tctcgaattacgattcccaatccagcaaaccctaccagccttttgcaaactcagagagggacccgatggcacccaaggcggagaagaagccggcggcgaagaagcccgcagaggaggagcccgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaaagtgctgaagcaggtgcacccggacatcggcatctcctccaaggccatgtccatcatgaactccttcatcaacgaca

SEQ ID NO: 4759 - DNA, 439 bp, Zea mays
  Clone ID: LIB3279-011-P1-K1-H3
tgagcttgttagcacccacgggtactcccagaaccagataattgtttggagatatccaacaatgtcgaagcttgccactttgacagggcacacgtaccgagtattgtatttagctatttcccctgacggccagaccatagttactggtgccggtgacgaaacactccgtttttggaacgtgttcccctctccaaagtcccagagctctgatagtctaagttgcatcgggggtacatcgtttgttagaagctacatccggtgacccgcagaaacgtagtttgaactgagctcataaggtaattgcagcatatgtggatgatcatcagcatcatcccattcatgacaaccatgccatcaggtcgtcaaccatccaaggtagctgaatttttgagatgccacggcgcactccgatggaagaagtggcttgcgaatccgggca

SEQ ID NO: 4760 - DNA, 357 bp, Zea mays
  Clone ID: LIB3279-011-P1-K1-H4
gagagaggagagagtctgcaggatccagcaggccgaggaaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccaggaaccccagccgattgattgggagtactacagaaaaggaattggatcaaaagtggtggatatgtacaaagaggcttttgaaagcatcgagatcccgaagtacgtcgacacagttac

SEQ ID NO: 4761 - DNA, 333 bp, Zea mays
  unsure (1)..(333): unsure at all n locations; Clone ID: LIB3279-011-P1-K1-H6
tcgaattcgagcacgcgtacgcgtacgcgtacgcggacgcgtgggccgtaccacagttcagctcccacccactcccaaaccctctcgccggagccccagcaacccgccagcaagcaagatggacggcagcaaggcgaagaaggtggcggcgaataagttcggcgggccgaggaagaagtcggtgaccaagtccatcaaggccgggctccagttccccgtcggccgcatcgggcgctacctcaagaagggccgctacgcccagcgcgtcggctccggcgcccccgtctacctcgccgncgtcctcgagtacctcgcagcagaagtgctggagct

SEQ ID NO: 4762 - DNA, 399 bp, Zea mays
  Clone ID: LIB3279-011-P1-K1-H7
cggacgcgtgggtttttatccgtcccgtccgaagccgaggaggacagggtagcagcgagatcgtgcgcgcctgcgagatctacacgaagttggggttacatggggctcaccttcacgaagctcttgagccggctcttctccaagaaagagatgaggatccttatgggtggtctcgatgcagctggtaagaccaccatgctctacaagctcaagctcgaagaaatggtgaccaccattcctacaatcgggtttaatgtggagactgttgaatacaataacattagcttcactgactgggatgttggaggtcaggacaagatcaggccatggtggaggcactatttccagaacacccaaggccttatctgtggtgttgatagcactgacagacatcgtgtt

SEQ ID NO: 4763 - DNA, 343 bp, Zea mays
  Clone ID: LIB3279-011-P1-K1-H8
cgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgcctaagttgtgttctgt

SEQ ID NO: 4764 - DNA, 411 bp, Zea mays
  Clone ID: LIB3279-011-P1-K1-H9
ctcgatctgaattacctcgaagacagtgctgggggttccgatgtcactgttggcattcttgcaaagatggacaaagtgactttgcttcagatggatgcaaaattaccaattgatacatttgaaaatgtaatgggacttgcaatagaagggtgcaaagcaattgcaacttatatccgagaggtgctattggagaatacaaagaagcttgagtgtcagcgtggttaaccttaggaggtgaatcccacttgcctagtctgttctacgcttgaagtctgactggcggggtaaaactaacggtttatctgcgtactcggcagtgcaagcaggttgatgacctgaacctacacagccattaaaaggcttactggttgtggttgtgggtggctggctctggtgcaatgcacaggaact

SEQ ID NO: 4765 - DNA, 276 bp, Zea mays
  Clone ID: LIB3279-012-P1-K1-A1
ggttgttttgctttttgtgacctacatacagggctcagaatcaattgcttcttggcaggccaaccttttgttcgaacctgtcaaatttgaggaggtggacgtgctcgttcacaggggcatatacgaagccgccaaggggatgtatcaccagatgctaccctacgtgaaggcgcacctgaagagctggggcagatccgcgcggctgcggttcacggggcactccctcggcgggagcctggcgctgctcgtgaacctgatgctgctggtgcaagggga

SEQ ID NO: 4766 - DNA, 378 bp, Zea mays
  Clone ID: LIB3279-012-P1-K1-A10
cccacgcgtacgatcacatctatacgtatgagatggcttactaaccatggcaagacgagtggattctgcatataggatgagcaccgactccttgtttacgaattcatgccccggggggacattcgaaaacatctggttaggagaggttaatacttccaacctgtgtcttggaaccttaaaaagaaggttgcagtgggggccgcaaaaaggctaggttacctttttagggcggaggcaaaagatatttaccgagatgttaagaatttgaacatactgcctgacacatattatttttcgaagcatttataattttggattggctgaggatggttctttccgcgagaagagccatgttttcacaaaatttatgggaacata

SEQ ID NO: 4767 - DNA, 312 bp, Zea mays
  Clone ID: LIB3279-012-P1-K1-A11
gatgttcagaagaagataacctacgacgagatcgaggttgtcaagatgaaagctaaaggcgacaagaaggctaagtactacaatgttccgatccccttgtatgatgagatggagtttgtcttcacggggaaacacgctactggagagttcagtgttattgaagcaccgtttgatcgctcaggaaggcaagaggatgatgccgttgggaatgtcaacctaaatcaagagccagcagatctgaatggtgactcttcttaacacgatttcgacaccctcccacagtctgataggctgaacccaataggctcgaaa

SEQ ID NO: 4768 - DNA, 312 bp, Zea mays
  Clone ID: LIB3279-012-P1-K1-A12
cagagcctcattcatctccattcgaaacaccctcgcacccacactctgccttcgtccccagcctaaatccccgcaacgatggctcgcacgaagcagacggcgcgcaagtccacgggcggcaaggccccgaggaagcagctggcgaccaaggcggcgcgcaagtcggcccctgcgaccggcggcgtgaagaagccgcaccgcttccgcccgggcaccgtggcgctgcgcgagatccgcaagtaccagaagagcacggagcttctcattcggaagctgtccttccaacgcctggtccgcgagatcgcgcaagac

SEQ ID NO: 4769 - DNA, 402 bp, Zea mays
  unsure (1)..(402): unsure at all n locations; Clone ID: LIB3279-012-P1-K1-A2
atgatctccgtcgggttcaacgccgcggcgagcgtgcgggtcgggaacgagctcggcgcgggcaacccgagggcggcggcgttctcggtgctcatggtgacgtcgctgtcgttcatcgcggcgacggtgtgtgccgtcgtcgtgctgtgcctccgcgaccagctgagctacttcttcactggcggcgaggccgtggcgcgcgccgtgtccgacctatgcccgctcctcggcgccacgctcgtnctcaacggcatacagccagtcctctccggcgtcgccgtgggctgcgggtggcaagccgttctggcgtaccttaacgtgggttggtactaccttgtcggcgtgccgcttcgcgtctttctcggcttctacctcgacctcggcgccaagggcgtttggagc

SEQ ID NO: 4770 - DNA, 328 bp, Zea mays
  Clone ID: LIB3279-012-P1-K1-A3
ccacgcgtacgatcacatctatcaatatttgaaagtgcactataaattgtgtaaatggtttatgtgatacgtttgtgcggaagataacctaggagagtgaagtttaaaatataagatgtgaacggacaagccgtgaaagatagtcttacaatagccactgcgcacgtgtagcaaatgagtaattgcattgagttgctgaggcaattacgtccttgttatattgccttacggagacatgtaatgagtatggcatatttgccatgaaaaaattaatttgtaggatacttctcttgactttgaaaaaaaaaaaaaaaaaaaaggggccggc

SEQ ID NO: 4771 - DNA, 379 bp, Zea mays
  Clone ID: LIB3279-012-P1-K1-A4
gcggaagttaattacctaggtcagttctgtcatcccaaccttgtcaagctgattggatactgcttagaggatgagcaccgactgctagtatacgagttcatgccccgtgggaacatggaaaaccatctgtttaggagaggctcatacttccaacctctgtcatggaaccttagaatgaaggttgcactgggagcagcaaaaggactagcttaccttcatagtgcagaggcaaaagttatttaccgagattttaagacttcgaacatcctccttgacacagattattctgcgaagctttctgattttggattggctaaggatggtcctgtcggtgagaagagccatgtgtccacaagagttatgggaacatatggttatg

SEQ ID NO: 4772 - DNA, 274 bp, Zea mays
  Clone ID: LIB3279-012-P1-K1-A5
ttcctccacagctgcaccgagctccccgatccctccgccccaaataccacacacccgggtggccaccgcctcgctatggatttggatctgtggatctccaaagtcaaggagggtcagcacctcgcggagcacgagcttcagtccctctgcgaatatgtgaaggagatccttatcgaaaagtcgaacgtgcaaccagtgaacaaccccgtgacggtttgcggtgatatacatgggcaggtccatgacctaatgaaacttttcgcgacggggggcc

SEQ ID NO: 4773 - DNA, 409 bp, Zea mays
  Clone ID: LIB3279-012-P1-K1-A6
cgccatcgcatccaccatggtagggctcgtggagggcatggtgtacgcgcacaaggccgggctggacgtggccaagtggctggaggccatctccaccggcgcagcggggtccaagtcgctggagctgtacgggaagcggatcctggagagggatatggcggctggcttctatgtccggcacttcgtgaaggacctcggcatctgcctgtcggaatgccaggccatggggctgtcgctgccggggctcgccctcgcgcaacagctgtacgtgtccctgatcgcgcacggggagggcgggctcggtacacaagcgcttatactggccgtcgagcggctgaacaacaccagcctcgagaagaaggacgaatgaaaggccccatgctctagctttgatgaacttgtgggaagc

SEQ ID NO: 4774 - DNA, 364 bp, Zea mays
  unsure (1)..(364): unsure at all n locations; Clone ID: LIB3279-012-P1-K1-A7
ccggcttcggctccggcgccgagtccgacgccgacgccgacctccccgaggagctcgcgggcgcgtgctacctcgacggcgcggaccacgagggccacccggtgtgctacaacgcgctgggcgtgttcgcggacgacgccgtgtacaagaaggcgctgggcaccgaggaaggcaatgccaggttcctccggtggcgggtgcgcgccatggagcgccacgtcgccgagctggacctgaggcccggcggcgtcncgtctctgctgcaggtgatcgacctcaggaactcgccggggccggccaagaaggacttccgagtcgccgacaagcaggtgcttggacctgttccaggacaactaccccgagc

SEQ ID NO: 4775 - DNA, 373 bp, Zea mays
  Clone ID: LIB3279-012-P1-K1-A8
atgatctccgtcgggttcaacgccgcggcgagcgtgcgggtcgggaacgagctcggcgcgggcaacccgagggcggcggcgttctcggtgctcatggtgacgtctctgtcgttcatcgcggcgacggtgtgtgccgttgtcgtgctgtgcctccgcgaccagctgaactacttcttcactggcggcgaggccgtggcgcgcgccgtgtcctacctatggccgcttctcgccgacacgctcgttcttaacggcatacagccagtcctttctcgggtcgccgtgggctgcgggtggcaggccttcgaggcgtacgttaacgtggggttgtactacttatttggagtgccgcttggggtttttctctggttttacc

SEQ ID NO: 4776 - DNA, 283 bp, Zea mays
  Clone ID: LIB3279-012-P1-K1-A9
atcacatctctccctatttgaaagttcactataaattgtgtaaatcctttattttatacgtttttgctgaagataacctaggagagtgaagtttaaaatataagatgtgaacggacaagccgtgaaagatagtcttacaatagccactgtgcagctgtagcaaatgagtaattgcattgagtttctgaggcaattacgtcctgctattattgccttacggagacatgtaatgagatggcatatttgccatgacaaatttatttgttgcatactttcttacttc

SEQ ID NO: 4777 - DNA, 261 bp, Zea mays
  Clone ID: LIB3279-012-P1-K1-B1
gcggacttccggccaaacatgagcattgttgtcaaggcgctacagcccctgctgaatgcgcatgcgcgggcgaccaacccttgagaaaaatgctagctcaaaagcttcgcattgctcctctccgccctcttgtatgatagataagtaagataccagtcgccgatgtcgttcttgcggacacatggatggcagcgtgtgacatttgtgattatttgtcccctgaattgtaaacaagattcttgtatccccacaacacttgat

SEQ ID NO: 4778 - DNA, 408 bp, Zea mays
  Clone ID: LIB3279-012-P1-K1-B10
cccacgcgtgcgcccacgcgtacgattctggtgaaacttgatgaaacacatttgggcaaaatgaaaagcatgacatgaagatccaacagagaacctgggcattttcaaatgtggcgaaccacaccccagaaacaaggtatggctgggggaggaagttggatgctgccacactgagatgctgcatgttggagttggagagggaggagcggagagagttgccacatgagcgcaaaggggcgaccacaccgagaagggccacaaccgcagtggcgcacgccatacaggagcaggagattggagaaggcggagctcagtgtcagagctggcgagccgcgagcacaggctgcggatggagctggagaggagagctagaatggtggtgagcacaggctgcggagaaacaagagt

SEQ ID NO: 4779 - DNA, 398 bp, Zea mays
  Clone ID: LIB3279-012-P1-K1-B11
cggacgcgtgggcttcagctttctgtgcccctgaacatgatgcctgttctgaaactcaagctccagacttatgttcaggttcagatgttgttttcgaccccagccaatgttatccagttgctagtttttctgatcttgggatctcggatacaccactaacatcaggtttcttgaatgatataacactagcaagtttgttgaatgtcaatttgaaggacctgtcacatctcaaccgacaggaacctaccaatgatacatcacttggaggagcaagtttattgaatgctaatttgaaggaccagtcacatctctctcagtgagctggaatgcatgtgcctgacttgtgggggcatggttttgaaattctcaagccaactttgcttcactcgagagcttga

SEQ ID NO: 4780 - DNA, 245 bp, Zea mays
  Clone ID: LIB3279-012-P1-K1-B12
gtcgttactactcatacaccgtcacctattacgcctgtcttgcctacaactatacacttttcagccccagtatctgctcctgcaattgcccctgagcttgcatcaggggctgtgggggtgcctccacctgttagtgctgtgggacctgagcgctgacaaaactggatgttcacaatggggaaaattttttgggggagctggaaaaattggtttttggccgggtctatctacaagggaattcttag

SEQ ID NO: 4781 - DNA, 404 bp, Zea mays
  Clone ID: LIB3279-012-P1-K1-B2
acggccaaagaagacggacggaagtgaggcgagcacgggcgctcaccggcgatggcgacgagggcatgggtggccgcggcggaggccttgaaccctcaactgctgcctctccgctcctgctcgcccacgaagtcagtttccccagcgcagcgctcggcatcgatggggctccggctgcgcagaggacggccgtgcgtggggaagaacgtgtgtcgccgcgccaagaacgcgggataccaagactacaagttccctgaccccataccggggttcgccgagcaggagacgagcacgttcaaggagcacatggcgtggcggctggagcagaaaaaagaggactacttccgggaccatgtcgaggagatcggtgacgtgttgaccgaggcacatacacaattcctgaa

SEQ ID NO: 4782 - DNA, 101 bp, Zea mays
  Clone ID: LIB3279-012-P1-K1-B3
cggacgcgggggaaaacggaaagctctgaatttctgggcactctgacgagaggcacgcgccaattcatgcacgagctgagaaggcatcacgtcactttatc

SEQ ID NO: 4783 - DNA, 266 bp, Zea mays
  unsure (1)..(266): unsure at all n locations; Clone ID: LIB3279-012-P1-K1-B4
gagcgagcgagccacgtacgaagcggtaggtagcagcagtacgtgctgccgccaagctagtgccaatggcgagggcgatgctcgtggccctggcgctggtcgtggtggtggcggtggcnagcgcggacggggcggctgcgcatcagtgcagcgcgacacaactggcggggtgcgccccggcgatcatcagcggatcggccgccacggggtcgtgctgctccaacctgcgcgcgcaagagccgtgcttctgccagtacgggcgcaac

SEQ ID NO: 4784 - DNA, 359 bp, Zea mays
  Clone ID: LIB3279-012-P1-K1-B5
acggccgctcgcgcatactattgccctcgcgccaccgtcgccgacggcgtcgctgcaacgagccaccgacccgccgtcggttgggggaaacaccaatccaccgccatggggcgtatgcacagccgcgggaagggtatctcttcatcggggctggcgtacaagaggactcctccgatctggctcaagacagctaccaccgaggggggggagatgattaccaagggtgcgaagaagggccagatgccgtcgcacattggtgttgtgctccgtgaccaggacggcatcccgcttgtcaagagcgtgactggtagcaagatcctccgcatactcaaagcccatgggttggcgccggagatccc

SEQ ID NO: 4785 - DNA, 405 bp, Zea mays
  Clone ID: LIB3279-012-P1-K1-B6
cccacgcgtccggtgagatcttgccaaaccaaatatttgaagtctgagctatagttccttcagaagttgctgagtatcgatacagattacagagaagggtacacctgactggatatttgatgttttaactcaggagcagcctgaattttcacatcaataatgttttgtaatagatcacctgccagctctggtgtatcagtaattgatcttgttttttctggaaacaagaggagaaccatatttatatctttgccatgtatcaatctattgtgccttgcagaatgtttggacaccgtcgaaggtgatagcgcgccttggcaaagaaataaatgatgaaagctcctatctttattgggcatacaagggaacatataacttggtatgcttaaggagtattaaaaggac

SEQ ID NO: 4786 - DNA, 409 bp, Zea mays
  Clone ID: LIB3279-012-P1-K1-B7
cggacgcgtgggcggcagccatgatgctgcgcgcggcgggcaggcgactcctcggcgtaggaggcggcgatccagcgcccgcggtcgctgctgctgtggcggcgagcaggagcagaggataccacgagcgggtggtggaccactacaacaacccgcgcaacgtggggtccttggacaaggacgacacggacgtcggaacggggatcgtcggcgcgccggcgtgcggggacgtcatgaagctgcaaatccgcgtcgacgaggggtccggcaggatcgtcgacgcgcgcttcaagaccttcgggtggggctccggcatcgcgtactcctccgtcgctttcggatgggtcaagggcaagcaagggggggaagtgggggccatcaagaacaccgaggttgcgaagcacctgtt

SEQ ID NO: 4787 - DNA, 408 bp, Zea mays
  Clone ID: LIB3279-012-P1-K1-B8
cggacgcgtgggttcaaggaaagcgccatgtagttgcctatgctgtgcggcgtgtgacaaacttcaatgaaataacctgtcactttctgcactgcattcaggtgcatatggagctcacagggttaaagatctattcttcagctgcaacatatggaggagtagcccatgccccatcacagccaaatccggttgatggaaactacatatccaacttggtcttgagtgtttttcatgacccatctgtcatggaccaggagcatggactgcacatcaaagatgtcatagatcgtctcaaactaccagatgatgtagtcagtgcggccatccaaggtcatgttgatgtgggcaacatttacaacacaattgatgacttccactacaaatctgtccggaatggatgaccacgtt

SEQ ID NO: 4788 - DNA, 408 bp, Zea mays
  Clone ID: LIB3279-012-P1-K1-B9
ccagaactctctagagtggatgcccgttttcttcgtcatactgctgctgggcggtctgcaacacccgaccatcgccgccggtctgggcggcatctacatcgtcgcgaggttcttctacttcaagggatacgccaccggcgttccggacaaccgtctcaagattggggggctcagctacttggcgttgcttgggctgatcatttgcacagcatctttcggcatcaacctgctcatcagggagatgctctaaactttgggtttatatgtgagctccaggctgggttaaccgcacaagttactcatggtctgagcatcaaaactttgtgacactggtcttttgggattttatagtggagttctcgtttctttctttgtctgtgtgttgattagcaaaagtagcgtgcgaat

SEQ ID NO: 4789 - DNA, 331 bp, Zea mays
  Clone ID: LIB3279-012-P1-K1-C1
gtgcttgcaagttcatctgtggttcaagctttgatggtcagtagtgttatctgttactactagtctattaggcgggggtaggcgtcaaccagtgtgtacgggtttgattttcggtcatgctgttaacagcattgcggttcgtcgaactggatatgtagtttagtacgctgtgtcatcacctcttgtgtaagggaacgcttcttttctgtggtatggaagatgtgaacttccaacaaataaaggagatgctctaaactttgggtttatatgtaaacttacaagctgggggggcggccgatctaaaggatccaagcttacatccgcgtgcttg

SEQ ID NO: 4790 - DNA, 348 bp, Zea mays
  Clone ID: LIB3279-012-P1-K1-C10
aggacgcgtgggactagttttagatcgctgcgcatgtaaaactagggcatcggcgcaagccgttcggcttgcccttcacgaacgcttggtccttcttcttgtatgtccactgcgacctttacagatccgctcctccagctagggttagcggtcctctgaagcgatggcgatcaagccgaccatggcggttgaacaagatcgggtacgacaagaagctgcgcagtctgctcgatgagtacaccaaggtgctcatagccctcgccgacaacgttggatccaagcaggtccataacatccggccgggccttatggacgactcggtggtgctcatggggaagaacacgctca

SEQ ID NO: 4791 - DNA, 354 bp, Zea mays
  Clone ID: LIB3279-012-P1-K1-C11
acggacagttggatgattattttcagagttgggatgctttgaaagctggcttgcccgttggaacagtcagtggtgcaccaaaagtgaaggccatggagttgatggataaaatggaagttacgaggttaggaccatatagtggtggtctaagaagaatatggtttgatggtgacatgcacattgcactttctctccgaaccatggtattctcaacagggccgagccacaacacgatgtacttatacaaagacgcaaataggcgtcgggagtgggtcgctcattttaaggctggggcaagcatttttgacgacagtagcccagatgactaacaacgtgaatgcgaaaataaagctg

SEQ ID NO: 4792 - DNA, 407 bp, Zea mays
  Clone ID: LIB3279-012-P1-K1-C12
ctcctcttcctccaccgtgtaatagatgtgtttaagcactacttcgaggagctggaggaggagtcgctcaaagataacttcgtcgttgtgtatgagttgctcgatgagatgatggattttgggtacccacaatacacggaggcgaagatattgagtgagttcatcaagacagatgcatacaggatggaggtcacacagcgtccacccatggccgtgacaaatgctgtgtcatggaggagcgaggggatccggtacaagaagaatgaagtcttcttggatgtagtggagagtgttaacattctagttaacagcaatggccagattgtgagatcagatgtggttggggcactgaagatgcgaacatatttgagtggaatgccggagtgcaaacttggcttgaatgatag

SEQ ID NO: 4793 - DNA, 406 bp, Zea mays
  Clone ID: LIB3279-012-P1-K1-C2
cccacgcgtccgcccacgcgtccgctcgcgcccggcgcagccgtcgccgccggcgggagccgctccgaagagaaggcccgcctcttcgccgccgacaacggcctcgacgtcgccaccacccgcctccacggctcgtacgatgcgctcctcgacgacccggacatcgacgccgtctacatgccgctccccaccagcctccacgtgcgctgggctaccgcagccgccgcacgtggcaagcacgtgctcctagagaagcccacggcgctgtgcgccgccgacctcgacgccatcctcgcggcttgcgagaccgcgggggtccagttcatggactccaccatgtggatgcaccatccgcgcaccgccaagatgcgggaaatcgtcgacgacaaggacgccatcggggaca

SEQ ID NO: 4794 - DNA, 403 bp, Zea mays
  Clone ID: LIB3279-012-P1-K1-C3
cttctcttggcggatattgccatcatgactctgcaaaaaatagctcttctatcttagattcttcatgccagcctgctgacggttcttctgttagcccagacctcatgctggacataccccctggaatatctgcgcatatacctcctggcttcacaaaagcccactgtcagcttcagatgggaactgctgctctgtcttttgctgataggcatcgcagtctgatttcggacattcctccaggctttactgaagttcatcggggactccctcctgcaattccacctgctggaccagcttgtgtgtcgacccctgggactgaaaagaagcccttcgttaggttctcgcttaatgtcccaaggcctgttggaatgggagctccacctggatttactccactgcatgc

SEQ ID NO: 4795 - DNA, 251 bp, Zea mays
  Clone ID: LIB3279-012-P1-K1-C4
gtccgcgcgcgcgattatatctcaatcgttgcggggttcaagagatcctatgcgaattggccctgccgagacatagcgactattacactattggtgttataacacatacagtgggctgttggatgctttatttaatgaatccactgagccccacaaccacaagcaactgactcttatacatccatatatttagctttccatgctggggcatcagaggcatgtgacggggatgggcgagaatgatctgtaag

SEQ ID NO: 4796 - DNA, 400 bp, Zea mays
  Clone ID: LIB3279-012-P1-K1-C5
ggaactattgataactggacttgtttgaacttttcacgcatgcgccctgatgaggtacaaaggttctgtatggatctgactcatatgtgcaatgccactggaatggttgtcaatccacgcccgtttattgaagtccggtctgctgctcctaaccatatagagaatgctttgagagatgtacacaagagagccacccaaatacttgcccaacaagcagtgggaaatcagctccagcttttgattgtaattcttcctgaagttagtggttcttatggtaaaattaaaagagtctgtgagactgacattggaattgtatctcaatgttgcttgccaaagcatgctagcaagccaaacaagcaatatttggaaaatgttgcactcaaaatcaatgtcaaggttg

SEQ ID NO: 4797 - DNA, 184 bp, Zea mays
  Clone ID: LIB3279-012-P1-K1-C6
cggacgcgtgggtgcgagaaccccatactaggaattgtttcttagacacctaaaaatcaatttatcttttagagtggatcttcttggcacatcttctaaattttcctttctacctctgtgacaagtttcaagtcgatctgatttgatttatttcaaatttaacttttggaggaacatttttaga

SEQ ID NO: 4798 - DNA, 406 bp, Zea mays
  Clone ID: LIB3279-012-P1-K1-C7
tgacgccactaacaaattcaacatttaccctgagcaaatcccttcctggcttgttgactggattcctgagaaaggaggttaccttatagggaatctgcagccagctcacatggattttaggttcttctctcttggcaacctttgggccatagcttcgtctctaactactccaaaacaagctgagggaattcttagccttattgaagaaaaatgggatgatcttgtagcaaacatgcccctcaagatatgcttccctgcaatggaagatgatgaatggcgcattattactggcagtgatcctaagaataccccatggtcatatcataatggtggatcttggccaaccttattgtggcagatcacattggcctgcataaaaatgggcagaccagaattggcccggaga

SEQ ID NO: 4799 - DNA, 253 bp, Zea mays
  Clone ID: LIB3279-012-P1-K1-C8
gagacgttacagggttgcctcccctaagagaaatagaagatgaagctgtccagaatatgagtgtaacatgaagcagagctgaagttgagcgccaaaaccaagaggccattgctaaggcacgagtaagacaggttgatgagaaaggaagagcttatggaacagggaaaaggaaatgcagcattgctcgggtttggattaagcctggcgatggtaaatgcattgcgaatgaaaagggagctgatgcttactttcc

SEQ ID NO: 4800 - DNA, 350 bp, Zea mays
  unsure (1)..(350): unsure at all n locations; Clone ID: LIB3279-012-P1-K1-C9
ctattaatctctgtatgtgtaggtaacccgttcaagatgaagcaccttacagtggccagagtaggagctcaagaaagaaccgagaggaaggtggaaagcaatcggccaataagcagacgaggagtatgtgatctggctagtagcgggtacaggcgctaatggcgtcaaatgttttgtatcacagtatcaccatgttttgcttttgcttcgctcctgaccgctgtgcaaagagtagacagcttgtttctttcggaggcaagtcatctgagaaccatcgngtatagcgtatgatgtcattggattttctttagtggaggccaagttccattttttccggaactccaaaatgc

SEQ ID NO: 4801 - DNA, 213 bp, Zea mays
  Clone ID: LIB3279-012-P1-K1-D1
cccacgcgtccgcggacgcgtgggctgcaactgaaagcctgcgccggcgacgccgcggagaagctgctgctcgccgtcgcaaccgagggtcctatctgtggtgtgccagacttcaagatgaggggaaagaagagtgatgagctcgaacctgtcgatgctggcgatgaagatgatgatggtggtgacgatggggacgaggatggtgactttggg

SEQ ID NO: 4802 - DNA, 338 bp, Zea mays
  Clone ID: LIB3279-012-P1-K1-D10
gcggtttcatccgtacccatcctgcacacgaagcctagaatagccctgccctggtccgccacctgctcggatcccgaccaccccacccccacccgagacaacaagttgatggaggctaagatgggacgcttcttcgagtccgtgagcaatttcttcaccggaggcgaccacatcccctggtgcgaccgcgacctcatcgccggctgtgaaggacagcttgtcaatgctgcaaatgaggaacagaggaatgaaagccttatgaggttgtcatgggcccttgtgcactccaggcagacagacgatgtaaaccggggaatcagcatgctttaagctttttt

SEQ ID NO: 4803 - DNA, 377 bp, Zea mays
  Clone ID: LIB3279-012-P1-K1-D11
cccacgcgtccgcgaagatcggggcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggggcagtgccgcgagctcaagttcctggacctgcgcggctgctgggccgtggacgaccggttcctgcgggagcgccacccggggctgcgcgttctgggcccgcgcgttgtcgaccactgctacgagaacagctactgggaggagtgctccgactactac

SEQ ID NO: 4804 - DNA, 400 bp, Zea mays
  Clone ID: LIB3279-012-P1-K1-D12
gtgacctgattggttccaagaaatttgttgaagtctacaaaagcggtcggatgggcctgaaacagaagcgggacggtagaaagcaggcacagaagattgttgcagccgtggacccacaacgcaatgccaagcgaaagcaacgaatggcagtcaagcaccgggaacacacgacgcgaaagataatggtgatgaaaattgggaggtggatgagatagcttggtatttaggctctgtggaattcggtgaatcatataattgtagaggataatttttcgtgctacaagtgctggcataaaattatgtttgtgttttatatgctgaataactgacttactgcccgaagtaattatactgttgagttaccgaaccataccgttagtaaaaatttagaggcatatgc

SEQ ID NO: 4805 - DNA, 415 bp, Zea mays
  Clone ID: LIB3279-012-P1-K1-D2
gccacctctccttcggcatcgacgaggcgaaaccctagcgccggagtcccgctccctcctcccacgacccatggcgtcggatatggcgtacgcgccgccgatgaaggcgggcaaggccgggttcgaagctggcatgatggatccgcagcacaggatccgcatcacgctctcctccaagagcgtcaagaacctcgagaaagtctgcggggatctggtgaagggcgccaagggtaaggagctcaaggtcaagggccccgtgcggatgcctaccaaggtgctccacatcaccaccaggaagtctccctgtggcgaaggtaccaacacctgggatcgctttgagatgaggattcacaagagggtgatcgatctcgtcagtacaccagacgttgtcaagcagatcaacctaatcaccatt

SEQ ID NO: 4806 - DNA, 414 bp, Zea mays
  Clone ID: LIB3279-012-P1-K1-D3
cgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacaaaaaggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttgg

SEQ ID NO: 4807 - DNA, 406 bp, Zea mays
  Clone ID: LIB3279-012-P1-K1-D4
gacaaaaaaaaaaaaacagagcgcagcattggaggcgaggaagagctgtcggccggagatggacaagtactgggaggagacgcaacgctacctggagtacgaggagctcagcatctatttggaggcgcaggaggacgccatgtcttgctacgactccagctcgccggacggctccatctaccactcctcgtcgtcggcggcggcgtgcggcaacaagaacatcctgatggagcgcgaccgccgccgcaagctcaacgacaagctctacgcgctccgcagcgtggtgccgaacatcaccaaaatggacaaggcgtcgatcatcaaggacgccatcgagtacatacagcatctgcacgcggaagatcggcacatgctgtaagagctgcgcgtgctcgacgacgacacc

SEQ ID NO: 4808 - DNA, 196 bp, Zea mays
  Clone ID: LIB3279-012-P1-K1-D5
catggcttctcccaagccgctcctactgctcgccacctcgttcctgagctgcggcctgctggtggccgccgactacgccccaatgaccctgaccgtggtgaacaactgcccctacccggtgtggccgggcatgcaggccaacttcgggcacaacgttctggagggcggcggcttattactcccgccattctgccac

SEQ ID NO: 4809 - DNA, 374 bp, Zea mays
  Clone ID: LIB3279-012-P1-K1-D6
aaaaaaaaaaaaaaaaaaaaaaaaaaaaaaaaaaaaaaaaaaaaaaaaaaaaaggggggggggcctattttaagaataacaaccataaaaacccttaccatgataattcttacctccattttcctcaaaacccaatttcaatcgaatgcacctaattgtaacccatctcctttaacacaaccccccccatatcatttctatttacattggcaggttgtttaaaataccttgttttttagcctcttccgaatttcggtgaatcatttaattttttgagaataatttttcctgctacaagtgctggcataaaattttttttttgtttttatgccctctcactttcttactttccctcaaaattatactgtttcttt

SEQ ID NO: 4810 - DNA, 406 bp, Zea mays
  unsure (1)..(406): unsure at all n locations; Clone ID: LIB3279-012-P1-K1-D8
nttagaaaaagaagtgttggtacatgattagtccaaatcatgatttacacaactaaccactattatcatgtcagatggaagattgaacgccacttcatatcttagctttgatgagtagtatgcatctattgggatttcatatacaagattagatgctgggcatacaacactatatcacgtgtagcgtaatgacaaaagagttggtcatactcatggaacttcccttttgatgtgcttatatatgtgctttgacgcaaactgtatgaatacatagagatagtctacagcataatgtcctcacatactcgtccaacaacaaggaatcgctttgagatgaggagccacaagaaggggatcgatctctgcaggacaccatacgttggtaagcagatcaccttaaatacca

SEQ ID NO: 4811 - DNA, 276 bp, Zea mays
  Clone ID: LIB3279-012-P1-K1-D9
attcctccaagcggccgatataccaataagtgtacgaacgcggatttttcgggagctcgtaccttaaataaaaaatttgtatacaaagcattcttcttagcttaaaaaaaaaaaaaaatcaaggaacaaaaaaaaaagaaaaagaagaaaataaaaaaaaaaggtgttttaaacattaaaaatatatttaagtgtagattaaagaaaaatgaccaaaactcacttaaggtgctttacccccaaaaacttaacaattaaatttgagggcgcgctttt

SEQ ID NO: 4812 - DNA, 409 bp, Zea mays
  unsure (1)..(409): unsure at all n locations; Clone ID: LIB3279-012-P1-K1-E1
ccccgtccccggccgccgcggtgccaacccagctctccggtgcgcccgcgacccctgctcccgtcgtcagggtggcggcgccncgcggagtcgcctcgccgtccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctggtatgcataccactccctcttcgcctatttcgaccgcgacaacgtggctctcaaaggatttgccaagttcttcaaggaatccagcgacgaggagagggagcacgctgaaaa

SEQ ID NO: 4813 - DNA, 405 bp, Zea mays
  Clone ID: LIB3279-012-P1-K1-E10
ggcctggtagataaaccagcactactcatgcgtcaccccacacaagtgtcgggggcgccggcgtgctcgtgatctcaaccaacgcgtgtctccgctccggtcacccgacactccacgcaaacatgtcgaggaggaagaccagggagccaaaggaggagaacgtcacccttggacccactgtccgtgaaggagagtatgtctctggtgatactcacatctatgcatacttcaatgacactctcattcatattaacgatttgtctgggagggaaactctggttcggatcaccggtggcatgaacgtgaacgctgaccgagacgacgtcgcaccttacgctgctatgcttgctgctcaagacgtcgcacagcgcttcaaggagcttggcattactgcacttgacatta

SEQ ID NO: 4814 - DNA, 249 bp, Zea mays
  Clone ID: LIB3279-012-P1-K1-E11
aacacgccgaatggagcaggactgagggagcgtgatcgcacataaggagcagggtccatgtgggtcctgtattgactaagaaagaacccccgagttcaccatcaacctgcacaagcacgttcatgtatgcactctttataaaaacgcccacaatgctattaaagaaatgacgcagtttgcacagacggcaatgggcaccaactccatcaggtttgatgtgagactcaaccaacacatctggtgcagtgg

SEQ ID NO: 4815 - DNA, 378 bp, Zea mays
  Clone ID: LIB3279-012-P1-K1-E12
cccacgcgtacgcggacgcgtgggccgcgcgcgagatcgacgccccgggtgggctctagatcccgatggcctcacgcacccccaccctgctaaaggtcatcatcctcggcgacagcggggttgggaagacgtctttgatgaaccaatatgtgaacaagaagttcaccaaccagtacaaggctacgattggggcggatttcctcaccaaggaggtgcaattcgaggacaggctcttcactctgcaaatatgagacactgctggtcaggaaaggtttcacagtctcggcgttgcattctaccggggagcagattgatgagccctagtctatgatgttaattctatgaaatcgtttgataatcttcacaactggcgtgaag

SEQ ID NO: 4816 - DNA, 412 bp, Zea mays
  Clone ID: LIB3279-012-P1-K1-E2
attttgcaaagcagtttgatgcaatcaggagaaagtgctgtccagatgaactagactggatccgctccttaagtcgctgcaagcgatggagtgctcaaggtggcaagagtaatgtctactttgccaaaacactagatgacagatttgtgataaagcaagtgacccggacagaattagattcatttgaggattatgctgctgattatttcaaatatttgatagactctgtatcatctggaagcccaacttgcctcactaaagtccttggtctttatcagatcactgccaagaatttgagagatgggaaagagctgaagatggatgtaatggtcatggaaaacctatttttcaagagaaaggtatcaagaatatatgacctaaagggttctttgcgttcccgctacaaccctga

SEQ ID NO: 4817 - DNA, 403 bp, Zea mays
  Clone ID: LIB3279-012-P1-K1-E3
cccacgcgtgcgaccacgcgtccgctgacgcggtgtctgctcccacttaccgtgctctcccccaggtggcggcagcggcggcggggtagcatttgtgctacgagggcttttgcaatggcggcttcggggttcggcggcggcgaggcgttccggctctcggccgcaccaggggccggcttactgaagctgcacaagggcgacatcaccctttggtctgtcgactgcgccaccgacgccatcgttaatgctgctaatgagcgaatgttaggtggcggaggtgttgatggagctatacatcaagctgctggaccagagctagtgcaagcatgccggaaagttccagaggtcaaaccaggagttcgttgtcctactggagaagctaggattactcctgcttttgagc

SEQ ID NO: 4818 - DNA, 392 bp, Zea mays
  Clone ID: LIB3279-012-P1-K1-E4
gtcgggggtcaggacaagatcagacctctctggaggcattacttccaaaacagacagggtcttatctttgttgtggatagcaaagaccgcgaccgtgttgttgaaaccagagatgagctgcacacgatgctgaacgaggatgagctacgtgatgctgtgctgcttgttttcgccaacaagcaagatcttcctaatgccatgaatgctgctgagatcactgacaagcttggattacactccctgcggcagcgacactggtacatccagagcacttgtgccacaactggcgagggtctgtacaagggcctggactggctgtccaacaacattgcgagcaaggcttgaatatcaaatgcgaactgactaggagctccggatgtatgatggaaact

SEQ ID NO: 4819 - DNA, 405 bp, Zea mays
  Clone ID: LIB3279-012-P1-K1-E5
gccctacaacgcaacgctctatgatcaccatctcgttgagaacgcaaacgagcgcatggtgctcgacaacgaggctctctataacatctggttccgcacgctcaagctttccacaccaacctttggtgatctgaaccaccttatgtctgcaacaatgaggggggttacatgctgccttagattccctggccagatgaattgtgaccttcggaaacttgcagagaacctggtccccttcccgcgcctgcacttttttatgggtggattcgctccactgacctcacggggctcccagcagtaccgggccctcactgtgccagaactgacccagcagatgtgggactccaagaacatgatgtgtgctgctgaccctcggcacggtcgctacctcacgggatctgctat

SEQ ID NO: 4820 - DNA, 407 bp, Zea mays
  Clone ID: LIB3279-012-P1-K1-E8
cggacgcgtggggttccgcgccgaggagaaggccgccgccgacaaggggcgggggctcatgctcatggacgccacggcggcgatgctcatgcggcccgacggccaccccagccgctacgggcactggcccaacgagaaggtgcagctctacaacgactgcatgcactggtgcctcccgggacccatcgacatgtggaacgacatgctcttacagatgctcctcgcctagcagcaagcagcaaagatttttaaaaaaaaaatctcaccaattcggccggcggtaaccgtgcacagattcgactggttttgtttttgcctcgtttcgctttttttaaaagaagaaaacggtgcaattttgacggctcatgctaaaggccgcaaagcatgcgcgctataacaagaaaagg

SEQ ID NO: 4821 - DNA, 164 bp, Zea mays
  Clone ID: LIB3279-012-P1-K1-E9
cccacgcgtacgaccacactttcaaggacaagtggacggacgcgagggccgtgtccttatactactacgcaataatctaccatatcctaaataacccgaagtcctaccgattcagtgtttccaacctttgatgttgaaaaatcttttagtaacttgaccataat

SEQ ID NO: 4822 - DNA, 357 bp, Zea mays
  Clone ID: LIB3279-012-P1-K1-F1
ccaaggtcaaggccatggtgaccagcctcaacgccaaccgcccggacgccaagttcatgtacgtcgacaactacgccatgatctcgcagatcctaagtaacccgtggtcctacgggttcagcgtggccgaccgcggctgctgggggatcgggaggaaccggggcatgatcacctgcctgcccttcctgcgcccgtgcctcaaccgcaactcctacattttctgggacgccttcccccgacggagaggtaacgtgctctcgcagggcgctcagtgcgcacgacgcgctaccatgacatcagactcgcgatgcagcggactatgcaagttcatcgtcgagcgtgttgacgtctatgtta

SEQ ID NO: 4823 - DNA, 297 bp, Zea mays
  Clone ID: LIB3279-012-P1-K1-F10
ctctcatttttttccattcgatccccccttggaaaccaaaaccacaacttggggcgcattggttgtgctcaaaaccaaaaaaaaacccgcggggaagaaaccaggggaagaagagcccgcggtcgaaaaagcgcccgccgggaagaagccgaatgcggaaaatcttgtccccgctggcaagttcgctgtctaagaaagcggcaagggcatgatgggcaataaaaaaggcaagaagagcgtggcgacctacaagatctacatcttcaatgcgctttattatgtgcaccctgacattgg

SEQ ID NO: 4824 - DNA, 312 bp, Zea mays
  unsure (1)..(312): unsure at all n locations; Clone ID: LIB3279-012-P1-K1-F11
nacgaaatgttacttctgtgctttctggtggtagggagaaacccatcacctatgggggacaggttggtatttaacaaaattaaaagctagaccttggtggaacaaatgagcttattacttcaagggcttctccattgtcaccagatgtcatggaatttttaagaatatgcttcggtgaagttcttgaagggtatggaatgacagagacatcttgtgtcatcagtacgatgaatattggtgacagatcaatttgacatgttggatcttcaaatccttcttgcgaggttaaactggtggtcgttctataaatga

SEQ ID NO: 4825 - DNA, 396 bp, Zea mays
  Clone ID: LIB3279-012-P1-K1-F12
agggacgcgtccggcttgatcaactcactgatcttcataggagggagcaaatgatgtgtgaagcgggggtggggcttagaagaaagctggaggacaccaacaaccaggtgcatggccaattgtgggagcacggtgccaacttattactcggctacgagcggcactcctcgccacagcaagccccatcacatgttggcaatggattattctttcatcccctgaaagctgcagtagagccaaccctgtagatcgggttctctcccgagcatatgaataacttcatgccggcttggctaccctggggatggatctttaatgcaaaggtaataaataaagatgcgatggctgaatcatattgtactgcaagagtgacaattgggtgttccactcacatat

SEQ ID NO: 4826 - DNA, 345 bp, Zea mays
  Clone ID: LIB3279-012-P1-K1-F2
agccgcggcaaccctacagtcgaggtcgacgtgtggtgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggggctaatgcgattctggctgtgtcattagctgtttgcaaagctggggctagc

SEQ ID NO: 4827 - DNA, 411 bp, Zea mays
  Clone ID: LIB3279-012-P1-K1-F3
cccacgcgtccgcgaatacctctttcttcgcctgctggctctctcgtcgtccgtgcctcgtcctctccggcattcgaggatagtttttcgccgggggcggcctagaaatcagccgtcaggtgaaccgggaggggtggttgcctgaggaggaagagatgatcacgccagcgaagctggtggagcagctgcgggagcaccagatccggtcggaccagtcctactccgccgcgctcgccgtgttctcgaccaacccccacatctgctccaggagagatctcaaggttgctgtgatctatgccggcctgttttgttttctcatggtgtgctgctatgccggcctttacttgaaatggttgagactgtcagccatgtttgtaaccttcgggatcctcctttcagagagtctcaaaa

SEQ ID NO: 4828 - DNA, 260 bp, Zea mays
  Clone ID: LIB3279-012-P1-K1-F4
ctcgcatttcttcccatccgatccccccttcgcaaccaaaaccccaactcgggccgcatggatggcgcccaaggccgagaagaaacccgcggcgaaaaaaccggcggaggaagagcccgcggccgaaaaagcgcccgccgggaagaagccgaaggcggagaagcgggtccccgctggcaagtccgctgccaaagaaagcggcgagggcaagaagggcaagaagaatggcaagaagagcgtggagacctacaaaatctaca

SEQ ID NO: 4829 - DNA, 270 bp, Zea mays
  unsure (1)..(270): unsure at all n locations; Clone ID: LIB3279-012-P1-K1-F5
aaatgttancttctgtgcttntctgttgttagggtagaaacccatcancctatgtggggacaatgttggtattttaaccaaaattaaagctatgacttggtnggacgaatgagggcttatgacgttcaggtgccttctccattgtcaccagatgtcatggaatttttaagaatatgcttcggtgaagttcttgaagggtatggaatgacagagacatcttgtgtcatcagtacgatgaatattggtgacagatcaattggacatgttgga

SEQ ID NO: 4830 - DNA, 351 bp, Zea mays
  Clone ID: LIB3279-012-P1-K1-F6
gcttgatcagctcactgatcttcagaggagggagcaaatgatgtgtgaagcggataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataacttcatgccggcatggctaccctgaagatggatctttgaggcaaagggaataaataaagatgcgatggcagaatcatatttgtactg

SEQ ID NO: 4831 - DNA, 316 bp, Zea mays
  Clone ID: LIB3279-012-P1-K1-F7
cccggccttttgggactggacatgggaccagcttgctgactatgatcttcctgctgtgcttgagttcgtctataacagaacaggaggcatgaaagtccactacgttggtcactccctggggaccttgattattcttgcggccttctcggagaacaggttaacagacattgtgcgatcagccgcgttgctctgcccaatcgcttatctcaacagcatggaatcgaggctcatcctgcttgccactcgcatcttcctcgcagaaacgattcacatgctaggttatcacgaagtcaacccttgtgggccagtggcaaag

SEQ ID NO: 4832 - DNA, 391 bp, Zea mays
  Clone ID: LIB3279-012-P1-K1-F8
gcgacccccgacaagtacaagagcttcatcgcttctgttcgtgctggcgttggtgagcaaagcggggggcaacagcagcgggatccccgtgctggtcgacgaagacgacccgctcgcgctcgagtcgtttctaaacatcactctggtgaacaaggcagggcgctccgtaagcttgaagatggatgtctccagagcctacttcgtggcttacgtagcagggcagcgctcgtgccttctgaagagatcaggccgcacgttctcgtcggcgatctgttactacggtggcccgtggggaacaagttcggctcctgtcacgcgacctgctgttgctgccggcgacggagaggatcctggggtcgcggcatggcgagcgagagatctcgacgaggcc

SEQ ID NO: 4833 - DNA, 368 bp, Zea mays
  Clone ID: LIB3279-012-P1-K1-F9
tatggataaagagttcatatgtttctacttgagttctatactgttatggtcactattaagaagctaattttaagtcctatgtggctatgtgctgtgtactgcctcgttgcattatgtgaaagactgtgagtatcgagctctctaaagtcaatgtatattttcaaaaccttgatttaatatagttatacctgattacatatttggttcacaatgttggttcctactctgatttgtactttatgacaatttgaacatgtgtcttagttatttggcaacaaaggggttatattccacctggcatggggagaagcttgttggtttattacattggacaagtgcaaaggatcttgggatcctttgtcatggat

SEQ ID NO: 4834 - DNA, 372 bp, Zea mays
  Clone ID: LIB3279-012-P1-K1-G10
cggacgcgtgggcttcgcagcagcatccgcgtgcggcggcgtggaacaaggtgggatcttggctcagtttctagagtgttgcaattctttctatccatcattgctttgtgttcaagagaggttatctttttctgcgaatgcagtgctgcgcgtgccgatttgagcgagaagtttctcgtgcggcactcgaggtgagatttcacctcgtccacgttcttgctcaccgccaaaaacccaagggggagaaggaagggaagaggcggaatttccattggttggttgctgcgtgaatccgcgggattcaagctcgagtcttccttgaattgcggccggggccatggttctctcctccaattccaccaccaaggcaac

SEQ ID NO: 4835 - DNA, 216 bp, Zea mays
  Clone ID: LIB3279-012-P1-K1-G11
cgacccacgccaccgcctcaacctagtctaaagtatggtaattaaacatctcgccactatgggcgccgaaatatctagtcgacaacactttcctgaaccgtggccataccatacctcgcacggtgaaataacaagcagagtgttgtgttcaactcatatgctatgtcaagagaattagcccaaggatctttatcctcgcaccgcatgagaggatgt

SEQ ID NO: 4836 - DNA, 402 bp, Zea mays
  Clone ID: LIB3279-012-P1-K1-G12
cgctctctaccgtccgagaccccaagcaccagcgcggcggcgggggcgggggcggcggcgaccatggctgtcggaaagaacaagaggatctccaagggaaagaagggtggcaagaaaaagaccggcgaccctttctctaagaaggattggtatgacatcaaggcaccgtcggagttcagtgtgcgcaacatcgggaagactgtcgtatccaggacacagggtaccaggattgcttgtgagggtctgaagcacacagtctttgaggtttgcctatctgatcttcacggcgacgaggatcaagcttacaggaaaatgaggctccgtgctgaagatgtgcagggcaggaatgtgctcacaaactcttggggcatgaattttaccactgtgtaactcacatcccta

SEQ ID NO: 4837 - DNA, 243 bp, Zea mays
  Clone ID: LIB3279-012-P1-K1-G2
ctttccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccggcaaggccgatgccaagctggcggtgaagagcaagggggcggagaagcccgccaagggcagggaagg

SEQ ID NO: 4838 - DNA, 268 bp, Zea mays
  Clone ID: LIB3279-012-P1-K1-G3
gccctgaatgtcattgcgtgtgagggcacagaccgagtggagcggcccgagacgtacaagcaatggcaggtgcggaaccaacgagcaggcttgaagcagcagccattgaaccctgatgtcgtgcaggtagtgcggaacaaggtcaaggattgctaccacaaggactttgtgatcgacgtcgatcaccgctgacttttgcagggatggaaagtgacgatcttctatggcatgtcaacatgggggagaaaaaggggccccctgttacata

SEQ ID NO: 4839 - DNA, 375 bp, Zea mays
  Clone ID: LIB3279-012-P1-K1-G4
ctcgactcgaccgccgccgtcccagttcgcttcgcgtcacccagagctcgtcggcctgcgtccccgcgagaagcgagagcatggacacccaggtgaagcttgctgttgtggtgaaggtgatgggcaggaccggctccaggggtcaggtgacccatgtcagagtgaagttcttggatgaccagaaccgtctcatcatgaggaacgtcaagggccctgttcgtgagggtgacatcctcaccctgctcgagtctgagagggaggccaggaggctgcgctgaaaccctggtggccttggatgtaattctgttaatttttgttctattgtttggcgaacttgccgggggaccttcacaacatttgctttgagatttactc

SEQ ID NO: 4840 - DNA, 285 bp, Zea mays
  Clone ID: LIB3279-012-P1-K1-G5
cccacgcgtacgacgagcccggcgggcggaagggagagagcgcgccagagcggggccggacaaccctggtccaccgcactattctggaccgtggccatggccatggtcgccgcgtgccgatcccgggcgctgtgggcgtgccgctccgccgcctacctcaggatctccaccttgcccagggccttctccaccgtgctggaggatctgaaatatgctgacactcatgaatgggtgaagggtgggggcgattcaacaaccggggggattacttgaccatgcccagga

SEQ ID NO: 4841 - DNA, 411 bp, Zea mays
  Clone ID: LIB3279-012-P1-K1-G6
tacagaaccacaatctagccgcaagtatgggtatttccatctcgtaactctgcacgcacaaaggagcgagagggcaagtgtctccgaagcccttgccgttcgagaccttgcacggggaatcaataattagagagatgtcttcatctcatatggaatgacaagagaagttggacaaggatctggatcctcggagcgcatgggaggaggttttgctgctgtgttaaagcctgatccttttgatggtaaaaacttcttgatttggaaagctaagatggaattgtggcttactgcaatgtcttgttatcatgtcgctgagggcaagcctgccaacttaccttctgaggatgaggctaagtttgaggcggatgacaaccttttttgaggagctgtgattagtgcacttgatacaaa

SEQ ID NO: 4842 - DNA, 371 bp, Zea mays
  Clone ID: LIB3279-012-P1-K1-G7
cccacgcgttcggcattctcgaattacgattcccaatccagcaaaccctaccagccttttgcaaactcagagagggacccgatggcacccaaggcggagaagaagccggcggcgaagaagcccgcagaggaggagcccgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctccttcaaggccatgtccatcatgaactccttcatcaacgacat

SEQ ID NO: 4843 - DNA, 245 bp, Zea mays
  Clone ID: LIB3279-012-P1-K1-G8
cccacgcgtccgcccacgcgtccggaccctcgctacccagccattagcaaattcgcttatgctgtgcaagacttatcttacgttatgtctgtaggcttttggtattacaagtactcaagttttgagtttttgagatgtggctatgacaatgtgatgaagaatcctaaaccatcgtattagagtgaaactttgttttatatagagggccaagtttcttggaaaaaaaaaaaaaaaaaagggcgggc

SEQ ID NO: 4844 - DNA, 188 bp, Zea mays
  Clone ID: LIB3279-012-P1-K1-G9
cccacgcgtccgagaagaccgtgcagaaaatatacgaagagttggtgaagtggcaaagcttttttctgatgctggtgtcatatgcattgctagcttgatatctccatacaggagagatcgtgatgcatgccgtgctctacttccacattctaactttattgaagtatttattgatttgcccctaaaaa

SEQ ID NO: 4845 - DNA, 390 bp, Zea mays
  Clone ID: LIB3279-012-P1-K1-H1
cccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttggggaggtttctacctcaaagactggtaagcatggccatgccaaatgccactttggtgccatagacatattcaacgggaaaaagctcgaaaatattggtcctttgtcacaaaactgggatattccggatggggaccggactgagtaccaactgattgatatattaaaggatgggtttgggagccttcttac

SEQ ID NO: 4846 - DNA, 294 bp, Zea mays
  Clone ID: LIB3279-012-P1-K1-H10
caggtaaccacctgagcccagagtggaccttatcaaacactatgcaggggagcgtagcgggctacctgagactgcttataaccaggcatgcgaggagaatgaatgcgttgtgctgactgaatgggctcaagcattgattgcttagcacgctatggctagatgttgatcccaaatcatgttttggaccttacaaacacatagtgtgacttcctctctggcatatgatgaggaacgacctcatgtctactttgaactaccttgaggaattttttatacttttgcaagaacatgtac

SEQ ID NO: 4847 - DNA, 196 bp, Zea mays
  Clone ID: LIB3279-012-P1-K1-H12
ttcactttatcttctaatcatttttctacacgtgtcaacttccaattataggggtttaacacccttgaaaacatataaccacacattttctttgctttttctccaaaacacatttattatacttcaacccacttatgactaatgagtatgttttttgttttttacaattctttcacgtacaacgccaccactattt

SEQ ID NO: 4848 - DNA, 143 bp, Zea mays
  Clone ID: LIB3279-012-P1-K1-H2
cagaccggcacgaaaaacggggcgacccacgcgtacgcacatacacaccattattcatacgcctgctcctccgcctactataagattcaggcaagggtggagatcgccatttcggactcctaagagcaccacttctaatcgaa

SEQ ID NO: 4849 - DNA, 408 bp, Zea mays
  Clone ID: LIB3279-012-P1-K1-H3
ctttacagaccacagttagggacaacattgttcaaatacaaaattgagatattgaagtctgagaaacaattagtgaaaattttattcacatagaaatttgaggtgttgaaggaaactgagaaggaattagaaattccaaagaaaactaaaaaggaagtagagaattcctgatgaagatttgcattaaagaacacatataatttctatggaagctttccactgaagagaaaaggtttttgctgctggaataaaaggagagcttagacggtcaatattgaacaagttcatgatgttatcacaattaataaatatctattacctattgtctaccttagtttcagtcccctcccttatgtaacgtaagtggaccaacgatataggacactcatttttttggaccccaaaatc

SEQ ID NO: 4850 - DNA, 403 bp, Zea mays
  Clone ID: LIB3279-012-P1-K1-H4
gcggctgcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctggggtcatggatgtcatttccatccctaagacaatggagaactacaggctgttatatgacac

SEQ ID NO: 4851 - DNA, 366 bp, Zea mays
  Clone ID: LIB3279-012-P1-K1-H5
aagaatttttgggaattctagggagagtttagaatatatttcctagtattcaattgtgcctagatgttcaactaatcctgcatatttttaggtatgcgaggaaaagtaatggagatgctaactgcatgttctgatgcattgatggattagtcttttatcctccctgtctgttatatatgcctttattattgcatggagctaataaatcattatccctactgagattgaattttttttgcattgatatcaaataaatcgtccattgaatcattttttctatgttttcagaatgatggacaaggtacaccatgatagtagaatttttttacaccctgggtatcttgatttaattcatcatttttgggc

SEQ ID NO: 4852 - DNA, 403 bp, Zea mays
  unsure (1)..(403): unsure at all n locations; Clone ID: LIB3279-012-P1-K1-H6
cccacgcgtccgcccacgcgtccggtttatgatcgaatcacttctcaagttgatacacctgccatttatgatgtttttcagttggagaaaacatttaagacaacattttcgttacttgttctccatatgtggcttgttctacgccgcttgaaggaagaagggaaggatggtgttaagtttggacagtacatctacgaaatgtacaaccacgatgtagagctcagagtttctaaagctggggttaacttgctgttgacaaaatggatgaaggagctagagaaaatattctatggaaacattgtgaagtatgatgctgcgataagcccagaggctcatcaagatgatcttgtaaatgtcatctggagaaatatntatgctgaggaaggttcaaaagctatggatg

SEQ ID NO: 4853 - DNA, 192 bp, Zea mays
  Clone ID: LIB3279-012-P1-K1-H7
ggagtcgacggacgacccacgccatccggctttctttaaagtatggtgatgctatagcttgtgtttgagccagtggaacaatggattttgttgtggaagttgctggtgcaccacaacttacaacctggcgacaccggaaaatctaagacgtacgcgactctgatttactccatgcgcattatcgattacatc

SEQ ID NO: 4854 - DNA, 373 bp, Zea mays
  Clone ID: LIB3279-012-P1-K1-H8
cccacgcgtccgcggacgcgtgggtgctgccggtcaatgcatttatttcttgagttaaaagtattcattcttttaagagctttagttctatgcccatcagacaattatgtgtgattagtaaagtatttcccattgcaggaaatgaagcaccaatgcgatgaaaaaaaagaattgtatgaattcatggtaaacacgcagaaagaaaagggaaggtctaagaatgctaaaggtgataatggagcatcagagcaattgaaacaagctcaggaagattatcaagaggaagcaactctttttctattccggttgaagtcattgaagcaaggacagttccgaagtctttttacacaagctgctcggcatcatgctgcac

SEQ ID NO: 4855 - DNA, 278 bp, Zea mays
  Clone ID: LIB3279-012-P1-K1-H9
caggaagctgcccttccagaggctcgtcagggaaattgcacaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagccctggggttattgttaatct

SEQ ID NO: 4856 - DNA, 107 bp, Zea mays
  Clone ID: LIB3279-013-P1-K1-A1
cccgctctctggcaagtgctacgagggcggcatcatcaccagcatgcaccgcgtcacggaccgcaccatcatcgagacgccgtctctggtgactcgtttccttttta

SEQ ID NO: 4857 - DNA, 373 bp, Zea mays
  Clone ID: LIB3279-013-P1-K1-A11
gaaagcgatgcctaccataccacactgctgtcagtctctggagcatttaggtggtctggatcaatggaagggttgtgtcctagccagccggcaaagatgagctgctgatggtaatgatgatgataagaggccactgctaccctactacgtaccctcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaaggg

SEQ ID NO: 4858 - DNA, 178 bp, Zea mays
  Clone ID: LIB3279-013-P1-K1-A12
aatcagtgtcgcatactcggatgagactgaacgtctagatggcatgcatttgccactagattttttttctgctattaccaaggactgcacaaagaaaatgtagatgtatacacaacaagaacattccatctgacttggtagaccatctatggcacaaataataataataatttgcaat

SEQ ID NO: 4859 - DNA, 430 bp, Zea mays
  Clone ID: LIB3279-013-P1-K1-A2
ctcgtggagacgactgggccgggggccgccgtcgttgctgccctacgcggctacacccacgtgttcttcgggcccttagccgcgacgagcaccaccagggagtagaagaggttaaccttctggttggaaacgatgtacttcgaaggctatggcttccgtggaagtactttcgagcagacatatcgctgctatcctgcgtctttcatcgacaagccacaacttgaggccggtgacaaaattataatgccaccatcagctcttgatcgtcttgcatctctgcatattgaataccctatgctatttgaagtccacaatgcagcagcagaacggacttcgcattgtggtgttctggagttcattgcagaagaaggcatgatctacatgccatattggatgatgcaaaatcttctgttgcaagaggggagatatg

SEQ ID NO: 4860 - DNA, 437 bp, Zea mays
  Clone ID: LIB3279-013-P1-K1-A3
cccacgcgtccgcgccgccagacactccgtagtctgtaccccaagcaccggcgcggcggcggcggctaccatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcaggaatgtgctcacatacttctggggcatgaattttaccaccgataagctcagatctctagtaaaagagtggcagacattgattgaag

SEQ ID NO: 4861 - DNA, 373 bp, Zea mays
  Clone ID: LIB3279-013-P1-K1-A5
cccacgcgtgcgattcgacctagagactcgggacgagccgtaaagactacgattaacggtgccaccagcgacgcctggccgccttgacggctaggcagcgcccgaaccgaaccatcttgcgcaggagggccactacagcgtgcgacacggacacgcccccgctaggcgccatgaagctgacgggggagaccgttatagaagcgccactttgagatacgcgtgcatgccaacgactcgattttgtatggggagaagaatattgaatagactcacggaagagacacatctccatggctgcaacaaccgttgagttacaaagctaaggtgtcgtgcgacgaatgcacatttgaagagatgacagtctatgaggaag

SEQ ID NO: 4862 - DNA, 393 bp, Zea mays
  Clone ID: LIB3279-013-P1-K1-A6
gttgatatcacagacacatgggaacctttggaagaaggccttctcccactagagacaactcgccatgtgtcgatgatcactgtgacactgaaaaagaacccctgtgtacacattatccaggataccagacacctataccagatgtagaggggaaacccgcttttgactatgatcatgaagaatacgcatcccactggtcgtggaagaggacgtggtggtggcagaagaggcaggggaagaggcatgagcaatggcccccctccacctgcttatggttacaacgaagagtgggaggaggaaggagattattataacagagggcgcgggagagggcggctacgtggacgaggtgggagagggcgtggtggctactactgaggtgggagggcgtgt

SEQ ID NO: 4863 - DNA, 437 bp, Zea mays
  Clone ID: LIB3279-013-P1-K1-A7
ccttgctcgacccttgcccgccgcctgaactcgcctcccccgcggccggtcccctgcatctgttcgccgcgccgcaacccggaggagactacgactacgagcaccaccaggacaccaggtagcagcaactgttttgctgcaatctgacaaagtggagggtttaagagtcgctgcttcttttatgtctgaacaatctttgctttatttgggattgctgggagagtattcttgcgcgacgaggaaaaggcacaagtttctgctccactgcatgcatcaagagcccatccggtttccttgttctgaggtgtcattcgctagtgctcagagccggcttggttttctcgaaagatcagcagccactcttgattcaggactttgtcacacctgatagcatctagttaatacatctttatccaagatggcactgcaaaacattg

SEQ ID NO: 4864 - DNA, 438 bp, Zea mays
  unsure (1)..(438): unsure at all n locations; Clone ID: LIB3279-013-P1-K1-A8
cggacgcgtgggcacagaaagacgaaagaagaaacggggcgactcgcagatccaagcggagaagctgcgtcgtggcctgaccctgtccgtcctctccggtcggcgagagcaagaagagatcccgcgccgtcctcttctccacctccacctccacccatggcggcctccaccttcagcggcgacgagacggcgcccttcttcggcttcctcggcgccgccgccgcgctcgtcttctcctgcatgggcgccgcctacgggacggccaagagcggcgtcggcgtcgcctccatgggcgtcatgcgccccgagctcgtcatgaagtccatcgtccccgtcgtcatggcgggagtactcggcacctacggcctcatcatcgccgtcatcatctccancgggatcaaccccaaggccaagccctacttcctcttcgacggctac

SEQ ID NO: 4865 - DNA, 438 bp, Zea mays
  Clone ID: LIB3279-013-P1-K1-A9
cccacgcgtccgcggacgcgtgggtggagatggtgagaaaaatgaggcagttgatattcaaagtggttctgaatcccttcctgataatgccaaggctgaagcaactgatgaccgtgctactgtcagtcttcctgatgaaaccgggaatataccatcagttcatactgataattcgcaaaatgatgccagtgaaaaccaaggtgatgcaacttacactacctcggattcgtctgagcatggcattgttgaggctgtccatattgaaactggattggaagatgaaagtgcaacagcatcatctgggactggatctggtgatgacaacggtaactcatctgatagcgcctctgcagaagaaaatactgagactgtatctggtgatgatgagaagggcatgggaacaggtacaaccactgaagcgtcatattccatacaaca

SEQ ID NO: 4866 - DNA, 411 bp, Zea mays
  Clone ID: LIB3279-013-P1-K1-B1
ctccggggaagcgaggcaaggccaaaggggcggcgccgccgccgcccaccgcggcggcgagtgccggagctgtagggttccctggctgcctccgcctgatgccgccgtcgaccgtggccatatctatacacgccaagcccggctccaaggtcgccaccatcacagagattggggacgaggcggtgggcgtgcagatcgacgcgccggcgagggatggcgaagccaacgccgcgcttgtcgactttatcagctcggtacttggggtgaagaaaagagaagtgtctataggctcgggttctaaatcgagggaaaaggttgtgctgatacaagatgcgactcttgaaggtgtttacgatgctctgaagaagtcttgtaattgtgcatgagcttgcaaacacatgttagaaaatg

SEQ ID NO: 4867 - DNA, 439 bp, Zea mays
  Clone ID: LIB3279-013-P1-K1-B10
caaaccccggcgaagttgttaaacctgaccaattcaaggcaataaacgacgaggggatgccgatttaccagaggcccttcatgaaggggaagctctacattcatttcacggtggagttccccgactcgctggcaccagagcagtgcaaggctctcgagtcggtacttccgccaaagccttcgtccaagctgacagacatggagatcgatgaatgcgaggagacaaccatgcatgatgtgaacaacatcgaggaagagatgcgcaggaagcaggctcatgctgctcaggaggcgtacgaggaggacgatgagatgcctggtggagcccaaagagtgcagtgcgctcaacagtaagcagactaccataatgggattcaaggcactttggttgctcttcaattatgcgagtgcgcctgtggactgtatggttctatggtttt

SEQ ID NO: 4868 - DNA, 434 bp, Zea mays
  Clone ID: LIB3279-013-P1-K1-B11
gaaaagatgagtggctatctgcccaacaagaaattcttttgggagctgctaggattatcaaatcacatggcattgaactgggaagcaccatgcagtgctgttaattcacgcttctggcacttttaagtaggataaataccgttagcctgcagaagtgcagaacttcatacagatgctacctagccgttttgttcttcaacgttttatgtcttcagaccatggacacccactaccaatactattctgttactgccgttttctttggaactaaggtctagtttccttttgtggtcgtcctaatggttggtgtttggatcggtttctgggagcttctttgtctatgtatactggtcaacgtttgcgccgcgcccacgcctgctctgtggatgagccctgagcgttttattggtcaattctgtgaaatattgggtttt

SEQ ID NO: 4869 - DNA, 438 bp, Zea mays
  Clone ID: LIB3279-013-P1-K1-B12
ggaatggccgtagctcaccaggaggagcccttttgcctggaggggcatttccaatgaatcggccaggaactggaggcatgatgcctgggatgcctggttcaagaaagatgcctggaatgcctgggttggacaatgataactgggaagttgcccgttctaaatcgatgccaagaggggactcgattcgcaaccaggggccgttgcttaataagccatcaacagttcacaagacatcatctattaacacgaggcttcttcctcaaggcagtggcgcaggactaattggcaagagcgcacttttgggaactggtgccccaccatcacgtcctctcagctttgggcctgagcccacacctcatattacaccatcaccaaaaccattaagtgcagcaccagctcttgcccctgctcctgataaaccagccagtgctcccaagg

SEQ ID NO: 4870 - DNA, 432 bp, Zea mays
  Clone ID: LIB3279-013-P1-K1-B2
gccgcgacgagccgacgagagcaacgacgaccatggcgacgatggtcgcttcttcctgccacgggcaacttctcctgtttctcctcgtggccgtcgcgtcggcctgcctcggctccgcggcagcgcatcaagccggatctggagagggctacacgatagctggccgcgtcaagaccgatggcatgagcgtgaagggctttggtctggcaccaaagacatcaaccacaaaggtgatccttatggccggccaaagggtaccattggccaggccagacggttactttgcattcaacaccgggccagctgaacctcatctgatggaggtctcctcaattggttacttcttttccccagttcgagtagatatcagtgcaaggaatcctggttatattcaagcagcatggactgaaactagaagagttctaaatgagc

SEQ ID NO: 4871 - DNA, 445 bp, Zea mays
  unsure (1)..(445): unsure at all n locations; Clone ID: LIB3279-013-P1-K1-B3
gcgaaagagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccncaagaccaatgagaactacaggctgctgtacgataccaagggccgcttccgccttcacccaatcagggatgaggatgctaaagtcaagctttgcagggttaggtct

SEQ ID NO: 4872 - DNA, 417 bp, Zea mays
  Clone ID: LIB3279-013-P1-K1-B4
cggacgcgtgggcgctgccgaaggtgggaaagaaggcggcggcggaggcaccggcaccggcaccgcctaggaaaggaaaccgaggaaactacagccatggtggtacggatccgtctggcgcggttcgggtgccggaatcggcccttctaccgggtgatggccgccgatagccgctcccctcgagacggcaagcacctcgaggtcctcggctactataacccgctcccagggaaggatggaggcaagaggatgggcctgaaattcgaccgggtgaagtattggctgtcagttggggcacagccatcagatcctgtgcagagtattctctttcgtgccggacttctgccaccacctccattgctagctatggcacggaaggttgggccacgtgataggcgccccattcatccaatgact

SEQ ID NO: 4873 - DNA, 437 bp, Zea mays
  Clone ID: LIB3279-013-P1-K1-B5
cccacgcgtccgcccacgcgtccggtccggcagcccctggtacggccccgaccgcgtcaagtacctcggccccttctccggcgagcccccgagctacctcaccggcgagttccccggcgactacggctgggacaccgccgggctgtccgccgaccccgagacattcgccaagaaccgcgagctggaggtgatccactcccgctgggccatgctcggcgcgctcggctgcgtcttccccgagctgctctcccgcaacggcgtcaagttcggcgaggccgtctggttcaaggccggctcccagatcttcagcgagggcgggctggactacctcggcaaccccagcctgatccacgcgcagagcatcctcgccatctgggcctgccaggtcgtgctcatgggtgccgtcgagggctaccgcattgccggcgggccgctcg

SEQ ID NO: 4874 - DNA, 439 bp, Zea mays
  Clone ID: LIB3279-013-P1-K1-B6
gaacttgtgacaaactttgaatcagacaaatctcctgcagaatttgcaaaatcatataaagaagatgaacttcttggaggacatgttataatgcttggctcagatcctgcaagccaggctgctgcactcgaggcactacatgcatatcctggtggcttgcaagttggaggtggaataaatttgcagaatgcaatgtcttaccttaatgaaggggccagtcatgtgatagtgacctcttatgtgtttagcgatggcaagatgaacattgaaaggctgacaaaacttgtcgagctggttgggaaacagaggcttgtgctggaccttagctgtcgaaaaaaggatggcagatatactattgtaactgacaggtggcagaagttcagtgatgtgtttgtggatgaaccggcattagaatatctcgctgccttcgcagatgagt

SEQ ID NO: 4875 - DNA, 439 bp, Zea mays
  Clone ID: LIB3279-013-P1-K1-B7
gtccactttccccgtgcttctccgccgtcgaggccgcgtcccagtgcgaagagactccgactcagatggccagccgctgggtccggcccgaggtgtacccgctgttcgcggcgacgggcgtggccgtcggcatctgcgggtttcagctcttccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaatatgttggggacatccatgacctctaaaagtactttgagcgc

SEQ ID NO: 4876 - DNA, 402 bp, Zea mays
  Clone ID: LIB3279-013-P1-K1-B8
gagaagcgcagctgcggccatggacgccaccggcactggagctggagggaaggcgaagaagggagcggccggtcgcaaggccggcggtccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacatgaagacgcgcatcgtcccgcgccacgtgctgctggcgatccgcaacgacgaggagctcgggaagctgctgaccggcgtgaccatcgcccacggcggcgtgttgcccaacatcaacccggt

SEQ ID NO: 4877 - DNA, 217 bp, Zea mays
  Clone ID: LIB3279-013-P1-K1-B9
gcgagagggcacggtggttcgttcaacaccctagcatgctcagccctagtccggagcccggagccacggcgcggttagggagccgtccccggcggccgtcggatccgtcgcgcggaccatgcggtgggtcgtccagtgtcgtcgggactcgcgccatgacttggtggagcgcgcgtttcgtttcttcggttcgccgcgcctggctggcctttttctc

SEQ ID NO: 4878 - DNA, 428 bp, Zea mays
  Clone ID: LIB3279-013-P1-K1-C1
gttggcttctcctcccccaccggttcgtgttcaggttctggttcgcgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgttgaggcggcggtggcggatacggtggcgggcgccgagatggaggcggctacggcggtggcggtggaggctacagcggtggtcgtggaggctacggc

SEQ ID NO: 4879 - DNA, 433 bp, Zea mays
  Clone ID: LIB3279-013-P1-K1-C10
cggacgcgtgggcggacgcgtgggcggttttccctgattctacgacacaggcagaagtctacagcacctcaacagcagaccttgtggagggtgttctgcaaggtaggaatgggacagtgttctgctatggagctacaggggctggcaagacctacaccatgcttgggacaatggaaaaccccggggtaatggtgcttgcaataaatgatttgttctccaaggtgacgcagaagaaccactcaattaagctgtcatacctcgagatatacaatgagacggtgagggatttgctgtctcctggtagcccccttaacctgagagaagataaacagggaattgttgctgctggtcttacccaaagaagtgtatactccacggacgaggtcatggagttacttcagaaaggcaacaagaatcgaacaactgaaccgac

SEQ ID NO: 4880 - DNA, 434 bp, Zea mays
  Clone ID: LIB3279-013-P1-K1-C11
cccacgcgtccgccaccgatcgatcgagctctaggctctagctagcgcgctgcatatgtgaggcaacttttcatttatctgacacacgtacttacggcccacgatggccgccgccgccggcctcccgtggtggctgctgctcctcgccgtggtcccggccgtcaccgctgcggccaccgccggcggagaggggagggcgccggcgctgttcgtgttcggcgactcgctcatcgacagcggcaacaacaacaaccttgcgtcgcttgccaaggccaactacttcccctacggcatcgacttcgccggcggccccaccggccgcttctgcaacggctacaccatcgtcgacgagctcgccgagctgcttggactgcccctggtgccaccctactctgaagcctcgtccgtgcagcatgttctacagggcgtcaact

SEQ ID NO: 4881 - DNA, 430 bp, Zea mays
  Clone ID: LIB3279-013-P1-K1-C12
caattatgatttacaaatatcataggggtatcatcatctttctcttcattcttaccgctcaagtcttggacctcttccccttcgtagttttatgcacgaagctcttcttatgccgaagctggctttgcaccatcgtggcttgtaacttcgctgtacgtgcattcaaccgaagcttctttatgctactttggtcgaagttcatcttagtccgtactttgcttatatggttgaaacacattttcttacatcgagagtaagtcattttgaagacattcggcaaggtaggccccacaagttattaagcatgcatatactataggataatcatatcttagaattgttttgtttagtttatacccttggagtaaacctacatggtttaaaatgattagaagcacgaaacataggttgtctaaaattccactatacc

SEQ ID NO: 4882 - DNA, 439 bp, Zea mays
  Clone ID: LIB3279-013-P1-K1-C2
cccacgcgtccgctcgccatctacgcgttcacccgggacgccgccctgcggcggcgaatcgtggacgagacgtcgtccgggagcgtcaccttcaacgacgcggtagtgcagtacgcgatagacgggctcccgttcggcggcgtcggccagagcgggttcgggcagtaccatgggaagtactcgttcgagatgttcagccacaagaaggcggtcatgaagcggggctaccttgtggagctgacactcaggtacccgccgtgggacgagagcaaggtcaccctcatgcgctacctctaccgcttcaactacttcgccttcgtcctctctttcctcgggctcaggcgatgaacttcactccagcatcaacgcaagggtcgcacagggattgggcccaataaaccggcattgacagtggatggaggaacatgccaatatagac

SEQ ID NO: 4883 - DNA, 441 bp, Zea mays
  Clone ID: LIB3279-013-P1-K1-C3
gctccggcgagccgctgacgagggcctgtgcggcgaccgagctcgtggcgggagaagatggacgaagcgagcacctccgcgtccggcgccgcgacgaggcgcggcttcgtgcctgcgagatcgggagttttctataggttcacccagcagaacctcccagcttggaagccagcaatgacacctggatgtataatagcaatgttcttgattatcggaataattttcatacctttcgggcttctttgtctccaaacttcaaatcatattgcagaaatcatctaccgctatgatgttgactgtgtgcctgatgcttacagaggaaataggcaagcttatattaaggacagctcgatttctaagaactgtactctggaagcgaaggttctggaatacatgagagcaccaatttatgtttattatgaacttgagaatttctatcag

SEQ ID NO: 4884 - DNA, 129 bp, Zea mays
  Clone ID: LIB3279-013-P1-K1-C4
tgattgcttggaattgtgcagtatactatatgcacctttttaatcatgtgtgtcgcgtctgtcggtatgtatgtcgtctgggggaaaggaaatttaagttatatgaaatgaatatgctgttgatgtgtc

SEQ ID NO: 4885 - DNA, 418 bp, Zea mays
  Clone ID: LIB3279-013-P1-K1-C6
cccacgcgtccgatacgctccccccgcccaccgttcatttgcttggtaggctgctggaacaaaacttggggggtaagatggcgggcagcccagtgccgaacaggatttatgcaggtaggtatcctagggcacgaggtgggattgaatctgtggcgcagtgattttttttgtgcggccccggaatacaacacagggcctggggcgccaaggcattcccttttgggtgtgagaaaggccttgctaaacttagcttaactctgaccttggtctggctctctctttctctttcttgaaagttttgagtgtactatctctctctctcgctggggtgtgggcatactacaactgtagctggcgaaatataaatgctttgttctgggggtaaaaaaaaaaaaaatgggcagccgttctagaggat

SEQ ID NO: 4886 - DNA, 440 bp, Zea mays
  Clone ID: LIB3279-013-P1-K1-C7
cgactccgccgccgctccgcctcagcgcatcgcccgccgcgacctcatcgatcaccttcagctttcaatcatggcggacgtcgatgtcgaaccggaggttgccgccggagctcccaagaagaggacgttccgcaagtacagctaccgcggcgtcgacctagatgcgcttctcgacatgtccacggacgaccttgtccagcttttccccgcgcgcgccaggagaaggttccagaggggtctgaagaggaagcccatggcgctcatcaagaagctgcgcaaggcgaaaaaggatgctcctgctggtgagaagcccgagccagtcaagacacatctccgtaacatgatcattgtccctgagatgattggaagcattgttggggtctacaacggcaagaccttcaaccaggttgagatcaagcctgagatgatcggccactacc

SEQ ID NO: 4887 - DNA, 70 bp, Zea mays
  Clone ID: LIB3279-013-P1-K1-C8
cgaacgcgttcacaacactatttatcccaatagtcgattgtgattaggtagatgggggaggactctagca

SEQ ID NO: 4888 - DNA, 439 bp, Zea mays
  Clone ID: LIB3279-013-P1-K1-C9
ggacgccgcgcttcggagtccgtcttcctcacggcctgcgcagaatcgcaggagacgggaaaaatcccgctgatccgctcggtcttcgcccgtcggctcgctctaggcaccggctccgacactgcctggcgatttcccccgtgcgacacccggcgatctgagcgcgtgactcagctgcccgccgccgggctccttctccgcgccagctatcgtcccctccccgagggtcgacggccgtgccctgctcgagagctctgccgccgtcgaaaccacgggctcgtggtaacttgttgtcgtcggagggatccccgatggccgcggaggcagatcagaaagtcgtggtgcacgtgcggtccacgggcgatgcgccgatcctgaagcaatccaaattcaagatttcaggacgagataagtttctgaaggtcatagagtttcttcg

SEQ ID NO: 4889 - DNA, 398 bp, Zea mays
  Clone ID: LIB3279-013-P1-K1-D10
gacttgtggtaggaggctcttcttttggcagggcgctggacgtgatgcaatatatatatcagctacaacaacggctggctgaattacaaacgtctttggggttgttcaagcataaagccatactggcaggagctactttacaaacactcaggctataatatatgtaagatgattcaagcgatacagaaaaggctagtaacagcaaaaagaagaattccatgccatccttgaggggggtgaacttaaaggggcacatgttcttgtgtatgcaaataagcaggatcttccatgtgcactggatgataatgccattacaggggcattagatctacacataattaagagccaaccatgggcgattctcaaaacatctgcattaaagggagaggggctctttg

SEQ ID NO: 4890 - DNA, 436 bp, Zea mays
  Clone ID: LIB3279-013-P1-K1-D11
cccacgcgtccgcggacgcgtgggagcctctctacctctacctaccggagcagggagcacgccgcacgagccctttccgccgccgccaaaatggtgaacgttcctaagaccaagaagacctactgcaagaacaaggagtgcaagaagcacactctccacaaggttactcagtacaagaagggtaaggatagcctgtctgcccagggaaagcgccgttatgaccgcaagcagtcaggatatggtggccagaccaagcctgtcttccacaagaaggccaagaccaccaagaaaatcgtgttgaagctgcagtgccagagctgcaagcactactcacagcacgcaattaagaggtgcaagcattttgagattggtggagacaagaagggcaagggaacatctctcttctaagtttctcatcacccatctcgatgttgga

SEQ ID NO: 4891 - DNA, 351 bp, Zea mays
  Clone ID: LIB3279-013-P1-K1-D12
cggacgcgtgggcaatactagcctgtgctggacgggtctacccgttggtagtcgctgcacaccccatggagcctaaccagatcgcgatcggcatgagcgacggcaaggtccatgtggtggagccattagacggggacccgaagtggggatcggcacctccacaggacaatggagcgcacccgcacccgcatccagcgatatcagcggcaccgtcgaccgccaccaaccaggcatctgatcagccaacaaggtgactctggcctgcagcactggaggagattcgttagcgcagagactggtaggacctgtaggagatagggagaaaaggtaaacgattagatgacgagaggt

SEQ ID NO: 4892 - DNA, 442 bp, Zea mays
  Clone ID: LIB3279-013-P1-K1-D2
gccgccgccccgatccccttcctccccaagcccttcaactatccactcccgcgtccccggagaagcggcgagatgtacggcatcctgacctccccctgccctcgagccccgcttctccgcgctctcccgagcccatccgcccgcgcattccccagaacactagccttccccgcgaggcccctcccccgcggtctccgcctgacccctccgcacgccgccgcggaggcatcggcggcagccacggcgttgggcgggcttctggcgtcgccgctctcgactctggaggccgccctgcggggcctcaacctcgcgccccttcgcgcccccgtggcggcggcgatgtcggcggtcgtgcggtggctgggagtgtaccgggaggtgctgctcgtcggcgtgctgctctcctggttccccaacatcccctgggaccgccagcccttct

SEQ ID NO: 4893 - DNA, 440 bp, Zea mays
  Clone ID: LIB3279-013-P1-K1-D3
ttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctaccgc

SEQ ID NO: 4894 - DNA, 206 bp, Zea mays
  Clone ID: LIB3279-013-P1-K1-D4
tccgcttttccttccccatcgtttcccaatcgttttcactgaggtactcacgcgtaccgggggggagagtgagcagatcgtgatgactgacctctcatgttcagtacccctgtattcatccagcagcctagccagctccaccatcaacccaattctacaaaaagtcttcatcacctacagtcctgacccaaattacattatcatac

SEQ ID NO: 4895 - DNA, 436 bp, Zea mays
  Clone ID: LIB3279-013-P1-K1-D5
cggacgcgtgggtgaagaactgaggtccatattcaagagagatgtccatctaatcctccaagttagagttgcgaagaagagaagtgcttgaacagatttttttttagtgcctgtatagactgctagtgatatgggaagtgcagttcagtgttggcacaatgtattaacgagaatggttagtaagtggtgcttgggtgcatcagttccggggactgagttgatagaactttggattgaggatctaatggaggcactgagctgtactggtgtgtggagccaagatttctgaagaaaggatatattggcggcaattcacatgccagtagtgacaaggaaacggcttgcggcatggtgagctgccgcacctcctggcgaatcttgtttttgtgatacttgataatatagatacgtctatgctagaccactgacacccttt

SEQ ID NO: 4896 - DNA, 436 bp, Zea mays
  Clone ID: LIB3279-013-P1-K1-D6
gcgagttccgactccctcactcatctccgtccgtccgccgcaccgtcgccgagcgccgctccgcgccggagacgtcctgtttttttgccgcctacgagcgctgtccctcttttctttccgcggctctgccccaacttctgcatccgaatctcccacgaagttgtcacggcgatggcagcgaccggcggcgtttcaactgacgatatcccgatcctgcaggcagagaacctcaccagcaacgtcaagtccgtccactacagtcgaacattcttgtcgatcattggtggagttgttgctggaatctggggattcacaggcttgacgggatttgtcttctactttctgataatgatggttgcatctatcgggctcttagcaaagtcaaagttttcagtgcagacatacttcgatagttggaccaggatttcaattgaag

SEQ ID NO: 4897 - DNA, 438 bp, Zea mays
  Clone ID: LIB3279-013-P1-K1-D7
aaaacagtgatacttttgtgctgcattcggagcaagaaaggaaaggcaaagtaaaacctgtgcatattgttgatgttcctggtcatgctaggctcaagcccaagcttgatgaagtcctgcctaaagctgctggggttgtctttattgttgatgctcaggatttcttgtctagcatgcaagctgctgcagagtacctttatgacattctgacaaaagcaactgtagttaagaaaaggatccctgtgcttatattctgcaacaagacggataaagttaccgcccactcgaaggaattcatcaagaaacagttggagaaagaattgaacaagcttcgggaatcaaggaacgccatatcttcagctgacatctctgatgaagtccagctcggggtccctggagaggcattcaacttcagccagtgccagaacaaggtggcta

SEQ ID NO: 4898 - DNA, 436 bp, Zea mays
  Clone ID: LIB3279-013-P1-K1-D8
gagagcatgaaggtcctgtacaagtgcattgatcccgtggtccttcctgtggagttcgggggaaagaacagtgttgtgtacaaccatgaggactactccaagttgatgctgcaagaagatatcgaaacatcaagcttctgggaggatgatgcgaaaactgttaaccatgctatcaatgggaccttggttcctgatgttgcatctcagctgtcacggattgctgctaaagccagttaatgagctactacgatgggagctattcagaatgctttaatggagtaactagaaagtcgagcgccaataaaatgttcatagtaaacagaaatagagcaaataacagatgagatatcacttgtccatagtcgaaatagttgcacttatcgaacactttattcagtacacgatgagttacaggagactatcgtaatgatgtaag

SEQ ID NO: 4899 - DNA, 435 bp, Zea mays
  Clone ID: LIB3279-013-P1-K1-D9
cggacgcgtgggtttccaagtagagtaccagaaccagatacccgatctcaagggatgaagatagtgactgggccatgggaattagaccgagaaagaaagggccaggttgagatatcgggggcaggttgcccttccggtgcctgaagggcaaacaaaatgtcataccaagtcaggctgctgcgcttttcctatgaattggccttctcgcaatcccttctgttttgcctcgcctcaatctgttgatgcagatccaggttaagcagatggctgacaacagcattgagcaagcattgatagagaatcctcctaatgtgctgaaatggaagccatcagaaagagctaaacggtttcgacgatgcaggtcaactccctcagatcccaccgatcaaaaacctgcagaaaacggatctgtgcttaaagccaaagagttattca

SEQ ID NO: 4900 - DNA, 96 bp, Zea mays
  Clone ID: LIB3279-013-P1-K1-E1
cggacgcgtgggtgatactggaacatttggcgcgctgtgggcgtccctgtcatgagatcaattgcagaaataaaatgcaatttagatttgagcacc

SEQ ID NO: 4901 - DNA, 246 bp, Zea mays
  unsure (1)..(246): unsure at all n locations; Clone ID: LIB3279-013-P1-K1-E10
agaaggnccaacnacaacaaaagaacaagcaagagccggaacagangaggaccgggggggccgcccagaaaagggaaggaccacagcacaagaaggaagggagacgaaaagaacaagagaagcacaagcacacggccaaaaaacaaaggcagaagacggcccgacagaggaaaacagaagaagcagccgccgcaacaaaaagagagaaggagcggcgggaagcaaagacgacaacacgggaaacaa

SEQ ID NO: 4902 - DNA, 434 bp, Zea mays
  Clone ID: LIB3279-013-P1-K1-E11
agaagctcctccccgctgtcgccccctctcctccccgtcctcctgccacgatggcaggctctgctaccgccgccgccattaaggactcataccggtcctactactttgcggtggcgaggcggcggagcaggcgcctgaggagggcgagagtctggggtgccctggcgcgcgcgttgtggcagagggcggcggcggccggggccctggtgcgcgcgtcgggcgccagggtggcgtgctggctgaggaacgctcggccctacgtcggtgacctcttcgtcgggaactacatgttcctgcaggtggcgccgtcgccgatgacgatcacgggcggcggcaccgtggtgcccttcgcgcagtacaactacggctgtaaggccagggccgtgcatctgcaccgctaccctactggggcggtgctctacgagacatagcga

SEQ ID NO: 4903 - DNA, 432 bp, Zea mays
  Clone ID: LIB3279-013-P1-K1-E12
cccacgcgtccggcgtctactcccacggccacggcctctcccgcgccggccccgctcggctccgcatcgtccgcctacacctccacctagtcttcccctccaccccttccccgaggctctcttcccgccgaatccccgcctcgcccgacccgccgctcgacgtcgccgccggagacgcgaccggcgaggtcgactggcccgcgcctaacgacgaccaggaccaggaacaggaggaccgcgacgagggcatcggcttccatatccaggtgtccaaggtcgggaagcggaaccggcgcctcgtgcgggctcgggttcgcgtccacgcgccgttcgaggccgtgtgggccacgctcaccgactacgaaggcctcgctgacttcatccctgggctctccgagtgccgactcctggaccggcacgatggcttcgcgc

SEQ ID NO: 4904 - DNA, 424 bp, Zea mays
  Clone ID: LIB3279-013-P1-K1-E2
ccatctcaggcggaatggcggcttctggtgagggcgcgtcgctgccgtctccggcgggcggggaggatgcgcaccgccgccgcgtcagctatttctacgagccgtcgatcggagactactactacgggcaaggtcacccgatgaagccccaccgcatccgaatggcgcactcgctggtggtccactacggcctccaccgcctcctcgagctctcccgcccctacccggcctctgaggccgacatccgccgcttccactccgacgactacgtcgccttcctcgcgtccgccaccggaaacccgggtgtcctcgacccgcgcgccattaagcgctttaacgtcggtgaggactgccccgtgttcgacggtctcttccccttctgccaggcctccgctgggggaagcatcggcgccgccgtcaagct

SEQ ID NO: 4905 - DNA, 373 bp, Zea mays
  Clone ID: LIB3279-013-P1-K1-E3
ggaaattcaatgtggacggcaagaaagttcagctcgtgtcatgaaagccaagcaaataggaattctttacgttgttggtgtctttgggttgatttccgtttcttctcgttgtgttctgtagcttcaaggaagcaggaaattcaatgtggacggcaagaaagttcagctcgtgtcatgaaagccaagcaaataggaattctttacgttgttggtgtccagcactcgtatttgttgttgctcgaggttccaaacagatgtaggagcacattgagctatgtagtactagtactggtatagataaatagtcaaaacctatcgcagatgcggaggtaaaattttgcaaaaaaaaaaattaataatctaactttataag

SEQ ID NO: 4906 - DNA, 315 bp, Zea mays
  Clone ID: LIB3279-013-P1-K1-E4
gcgccgccgttcgccgaagccccgcgtcgcgtcgcgtcgcgtagagtgcttgatggctgccgcaaggggcattaaccagcttctgaagagaattctccacaaccagtccgctggtccatggctgctttcttcatttcggggaaatcatgaagagtcctctgctggattgagagcattggcgcttcttggagttggtgcctccggtcttttgagttgtgctacaacaacatctgctgatgaagctgcgcaccgcttgtcagccccagattattcatggccgcatgctgccgtcatgagctgttatgatcatgcatc

SEQ ID NO: 4907 - DNA, 437 bp, Zea mays
  Clone ID: LIB3279-013-P1-K1-E5
gtgtacccatccccccaagtttcgacctcagtggttgagccatacaacagtgtcctgtccacccactccctcctcgagcacactgatgtggctatcctgctggacaacgaggccatctatgacatctgccgccgttcccttgacattgagcgcccaacctacaccaacctcaacaggcttgtgtcccaggtcatctcatccctgactgcctccctgaggttcgatggtgctcttaacgtggatgtgaatgagttccagaccaacttggtgccctacccgaggatccacttcatgctttcctcctatgctccagtcatctctgctgagaaggcctaccacgagcagctgtctgtggccgagatcaccaacagcgccttcgagccatcctccatgatggccaagtgcgatccccgccatggtaagtacatggcctgctg

SEQ ID NO: 4908 - DNA, 434 bp, Zea mays
  unsure (1)..(434): unsure at all n locations; Clone ID: LIB3279-013-P1-K1-E8
cgacaacccaaacaaacaacccccctacacacacacacggaggcccggtccgggtggccgtttcgattcgatgcttgtggccgcccatcagcgaacgagtcgcagccggatcccgactcacccgagggcgctcggccgcctctgaagccggaaggagcgcgcgcgtcggacatgggggagctcgcggcggcttcctcgcccccgccgcccgccgtgctgcaggtggtcttcgtcgacggcgagcagagcgtggacctgggcacggtcgccgtgcagccgtcgctgagcggtgtgaagcggctgcaggccgtggtggcggaccgcgtgggcgtcgcgccgtaccagatctcggcgtccctggcgcggccccgccgcgcgcgccgcgtgcccctcgacgacgccaccgacctcgtcgtcgncgtcgcgcgggaggg

SEQ ID NO: 4909 - DNA, 442 bp, Zea mays
  Clone ID: LIB3279-013-P1-K1-E9
agaaggttcaacttcaacaaaagatcaagcaagagtctgaacagtttaggtcttggaaggctgcccgtgaaaaggaagtacttcagctcaagaaggaagggagacgaaatgaatatgagatgcacaagctcttggccttaaatcagaggcagaagatggtcttacagaggaaaactgaggaagcagctgctgctacaaaaagattgaaggagttgctggaagcaaagaagtcatcacgtgaaacatatggcagtgcaaatggttcggggatgcaggccttaatacgagctattgacgatgaactagaagtcactgtaagagcacacgaattacgctcatattacgagcgacaaatgcaagagagagcagcaatatccaaggaaatagcaaaactaaaggaggaatcaaagcacaagatcagtgattgtcctcaagctatgtc

SEQ ID NO: 4910 - DNA, 284 bp, Zea mays
  Clone ID: LIB3279-013-P1-K1-F1
gaagttactagttctgacactgttgtggggagagatcgaggcgtgcgtgcatgcgtgcctaatttgtaatttggtatggtcacgtactgattggtgggctggggaaggatttggtggacccacttgccagtgcaatgtcacctttgcgggctgatttgatttagttctgctcaagtagtcaggtgtttcactgtttgtatttgaagttctggaacatgcgagtggatttagacatcttcttcaggtcatgcgtgttaatatattagctttaagtgattgttaaa

SEQ ID NO: 4911 - DNA, 436 bp, Zea mays
  Clone ID: LIB3279-013-P1-K1-F10
cggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggacctctccaccggcctcaccacccgccgcttcgtcggccacgagaaggacgtcatctccgtcgccttctccgtcgacaaccgccagatcgtctccgcgtcccgcgacaagaccatcaagct

SEQ ID NO: 4912 - DNA, 418 bp, Zea mays
  Clone ID: LIB3279-013-P1-K1-F11
aagaattgtacatcaaacaaatttatgtagtacatatattgcagaggtcctcaaaatctacaccaagttatgtcagggactatatctccactcaactcattttaatgttgtacatttcaatcaaatccaaatagatgtgaaataaatgtagtaggttactctgaccagtgttgcgctcgcgcgctagcatgctcagactaaccaacgaaaaaggtgaagtgggatggtataccatttgcaattgacatttatggtttttgctacgctggcactcagtgtttccaaatatctattagtcaatgtgcgatcgtaccaaattcaacagggctctctacatatggtatgtataactatctcaatttgaactgcattctggtgggagtcactcttattggttagtaatcatttttctcaatgt

SEQ ID NO: 4913 - DNA, 249 bp, Zea mays
  Clone ID: LIB3279-013-P1-K1-F12
cggacgcgtgggcaagcacgcgcgcctgggctgccaggtcgtcctcacgccggagctgcatggcatggtcgtcgctgtccccgagcctaagccgtgggacatcccgtaatggcctgccgcgacgaatggcaaggtgcggctttcgacgctgtgagccttccttcattcccctggctcggtcaagcttgtgcgcctctgccataaccctttatgttacggatttgatgaagaataaatagttgatgggaa

SEQ ID NO: 4914 - DNA, 390 bp, Zea mays
  Clone ID: LIB3279-013-P1-K1-F2
ccggattccgggaccagtaccacgccttcaccgccgagtcgcccatgccctggctgccgtcggctccggcgcctgggcacgctcacaccctcgtggagcagaaggcggtggatgaaatggtggacgggtttgggatcggaaggctgcaggagctcctcggcgctgctgcggggcaggcggccgagattgatgacatgtacgcagggatgctcagcaagctggagaagctcgccagggaggtggaaaagagcaatctccgtgtgctcgagcaggaaaagaggaacctgctgctgaggtataaatatgctggaatggagtaggaccgaagtgcttttggtcttagcgatgtgtgtatcatgactgagttttatcggtgtgtcatgcagattt

SEQ ID NO: 4915 - DNA, 184 bp, Zea mays
  Clone ID: LIB3279-013-P1-K1-F4
aaaaaaaataaaaaaaaaaaaaaaaaagaaaaaaaaaaaaaaaaaaaaacgaacatgcgggggggtaaaataaaaaaaaacggacacgtaaatagcgaaacaatagctgttgtgggggccggtctatactgtccaggcttccgtcgttcccctggttaattgttttgctttaaatggggccccc

SEQ ID NO: 4916 - DNA, 433 bp, Zea mays
  Clone ID: LIB3279-013-P1-K1-F5
cggtcttgttctcggagagggttgagctgcttgacggttttgactcggatcatggtgtgcagctctatcagatagagagctgacgtgaggtgtgagacgcggatcgtggagtactactcagtaggagaggtggggagggggaagaaggcgatagccggggaggatggtgcttgtgcttgcgctgggggatctgcacatcccgcaccgggcgcccgacctccccgccaaattcaagtccatgctcgtgcccggcaagatccaacacatcatctgcactggcaatctctgcatcaaggaagtccatgactacctgaaaagcctttgccctgatctccatattaccagaggtgaacatgatgaggatgctcgatacccagagactaagacacttacaattggtcagtttaagcttgggctgtgccatggccatcag

SEQ ID NO: 4917 - DNA, 286 bp, Zea mays
  Clone ID: LIB3279-013-P1-K1-F6
tcggctacatgttacacgatcgcgttctccgccctgccgaagtcggcgtcactgtcacggagggaggtgcgcatgcaactgaagaggcacagaagccggaggagaaaacagcgagggactatagtttgccgcggtgtattcaaagaggattgaatgccccttctgtttagagtgtgagaaacatgaatgtatgcagaaaacttttgggcgcgttcgacacggggagaaagtttatcaagcacgctggcgcccttttttttttttcttgtttggaacttggaatgaa

SEQ ID NO: 4918 - DNA, 439 bp, Zea mays
  Clone ID: LIB3279-013-P1-K1-F7
gaacagaagccatcaaaagcgaggctgcgagagcggagagagagagtgagggaggcgccgacgccgagtcctttcttcatcctgcatctgccgctgtttccgacaggatgtttctcacgaggacggagtacgaccgtggggtgaacaccttctctccggaggggcggctgttccaggtcgagtacgccatcgaggccatcaagttgggatccactgcgatcggtttgaagacaaaggatggtgttgtcctcgccgttgagaaacgtgtgacctcaccactgctggaaccaagcagtgtggaaaaaataatggaaattgatgagcacataggctgtgccatgagtggacttattgctgatgctagaacactagtggaacatgctcgtgttgaaactcagaatcataggttctcatacggagagccaatgactgtagaatc

SEQ ID NO: 4919 - DNA, 434 bp, Zea mays
  Clone ID: LIB3279-013-P1-K1-F8
cgaggagttcctcaagagggacgagagcgggggcgcgtgctgcgtcacagccgtcctccaaaagggtggactggtcgtctccaacgctggagactgccgtgcggtgctcagccgagcagggaaggcagaggcgctcacctctgaccaccgggcgtccagggaggacgagaaggaaaggattgagaatttgggtggatttgtggtgaattaccgtggaacatggcgagtccagggctccctggcagtgtctaggggcattggggatggacacctaaagcagtgggttgtggctgacccagacaccacgacgctcctggttgaccagcagtgcgagttcttgatacttgcttctgatggcctctgggataagatcgacaatcaggaggcggtagaccttgcacgacctctctgcatcaacaatgacaagacctctc

SEQ ID NO: 4920 - DNA, 430 bp, Zea mays
  Clone ID: LIB3279-013-P1-K1-F9
gctggttcctcgtcatcgtgcagactgttgcaaacggtgggtggaagggaagcctcaccgtcatcagcatcggcgccgacagtaacctccacgcagaaggtgtggcacagtctgcaggccttcggctacatcgggttagcctactccttctccaacatactgattgagatccaagacacgatcaaggcgccgccgacatcatagtcgaaggtgatgcacaaggcgacgcggctgagcgtgtcgacgactaccatattctacatgctgtgcgggtgcatggggtacgcgtcgttcggcgacaaggcgccggacaacctgctgacggtgatcggcttcttcgagccattctggctgatcgacgtggccaacgtggccatcgtggtgcacctggtaggcgcgtaccatgtgttctgccagcccatcttcgcct

SEQ ID NO: 4921 - DNA, 432 bp, Zea mays
  Clone ID: LIB3279-013-P1-K1-G1
ccacggcggcgtgcacgacggcaccggcgtcgtgctctgggagtggtgcaagggcgagaaccagagctggaagatcctgccgtggggtcccgaggccaactccgccgcggcccacgcgggaggcccgcacgccgtgcgcgtcttctgcaaggccggcggcgaggactacagcctcacggtgcgcaacggcacggcgtgcctggcgcccaccaacccgcgggacgagtaccagcactgggtcaaggacatgcgccacagcacccgggtgcgggacgaggagggctacccggccttcgcgctcgtcaacaaggtcaccggcgaggcgctcaagcactccacggggcagggccaccccgtcaagctcgtgccctacaacccggactaccaggacgagtccgtgctctggaccgagagccgcgacgtcggcaacgg

SEQ ID NO: 4922 - DNA, 437 bp, Zea mays
  Clone ID: LIB3279-013-P1-K1-G10
cccacgcgtccgttttcgacaaggagcctttccctcttaccagtaacgatctaattgagaaggctcttggagatcacggcatcatatgcttggaagacgttgtgcacgagatcgccacggttgggccgcacttccgagaagcatcgaggttcctcatgcccttcaggctcaagtgtccggagaggaggctgcagatgaagaggaaaccctacaaggatggcggcgactcgggcgaccgtggcgacaagatcaacgaactaatcgagaagctgaactagaagcgcagaccttgcctcctccggctgtcgttttgcgttggagcgatggatctgttattaccttgtcggttttgtaatagcattagctgggtgtaccttcggctttgaaaccttacctgcgcttgtgcgatcaggtcatgaaataacaagcgcttcttt

SEQ ID NO: 4923 - DNA, 394 bp, Zea mays
  Clone ID: LIB3279-013-P1-K1-G11
cgcgcatccagatctggctattcgagcagaaggacctccggattgagggtcgcattatcggattcgatgagtacatgaacttggtcctcgaagacgctgaggaaatcaacgtcaagaaaaacactaggaaatcactgggccggatactcctcaaaggtgacaatataactttgatgatgaacagtggcaagtgaagattcttatggcaggaacgatgtttggtgctcgcttcgattatctgtgacacaatgtactccatccatccgtccagacttaaatgatgtatcatgtcattgtggtttagtgagagttgtataactacctgaggaaactcacgtgttactatatgctaagatgctgtgacggtgagctattcagtgctcacttgtgttcc

SEQ ID NO: 4924 - DNA, 437 bp, Zea mays
  Clone ID: LIB3279-013-P1-K1-G12
tttggttgtttacaaatctggcatacatggacttggtctctacacatcagtctttattccacgcggctctatggttgtagaatatgtgggtgaaattgttgggcaacgggttgctgacagaagagagatcgaataccagtccgggaaacggcaacaatataagagtgcatgttatttctttaagattgacagggagcatattattgatgccacccgcaaaggtgggattgcaagattcgtcaatcattcatgccagccaaactgcgttgcgaaaataatctcagtcaggaatgagaagaaggtaatgttctttgcagaacggcacataaacccaggggaggaaattacgtacgattaccacttcaaccgggaagatgaaggccagaggatcctttgcttttgtagatcaagatactgcaggcggtacctcaattagt

SEQ ID NO: 4925 - DNA, 440 bp, Zea mays
  unsure (1)..(440): unsure at all n locations; Clone ID: LIB3279-013-P1-K1-G2
cggacgcgtgggctgcactgacaacaattgaggtgattgtggaaaagctgggtgaatttgttaatccatatttgaaagaaatacttgatctggtagtactgcatcctgaatgcagcactcaaatgcatgccaaattagatgcaaaagcagcacgtgttcgagagctattgactgtaaaagttccagtccggcttatcctctcacctttactgaatctgtactctcttactgcaaattgtggagatgcaagtcttacgttggcattcagcatgcttgctagtctagttggtacaatggaccggctggctgtaggaacttaccattcaaaaatatatgaacattgtttagcagctcttgatctccgtcgtcaacaccctgactctntgaagaatataaatatggtggaacaaagtattattcatgccataatctctcttacc

SEQ ID NO: 4926 - DNA, 436 bp, Zea mays
  Clone ID: LIB3279-013-P1-K1-G3
cgcgaggtcgacgcggattttcttctttataccgcgggcaggcggactgggcggctgacggagccgcggagggaaccgagtggccccggcgacgcgaggccgaggcgagctaatctgacggcggcagtgacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcaattggtgtcacaacatctcttctattggaaaaaccccaaggagcagaaagccatacttattattgtgctgatggctccactatacgctatctcttacttcgtgggtcttcttgatatccagggtagcaagacatttttcacatt

SEQ ID NO: 4927 - DNA, 440 bp, Zea mays
  Clone ID: LIB3279-013-P1-K1-G4
cctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgat

SEQ ID NO: 4928 - DNA, 441 bp, Zea mays
  Clone ID: LIB3279-013-P1-K1-G5
aaatcagcagtctgaatcttgctacctaaatctactacctgctagttggtcttgagataatgtcatcgagcaaccacaatcatgacgataatgtcaatgaatcgtagactcgtagtcacagcagggttttttatcatctgttattgactctgaagcagtaggaggaaatgcggaagtggaagagattgaagtttctgatgatgaagaccagaaagatggtgttggttcaaagagaaagttgacttcagctgtttggaaaggattcaagagggttaaagtagaggataaaattaaagcaaagtgcaactggtgcgcaaagaaacttggagagacaaaaaatggaaccaaacatctacacgatcatctcaagacatgtccataccgtaagagcaaaatgaccggacaaagcaagacatttagtcaaagctcattgaggtttgg

SEQ ID NO: 4929 - DNA, 435 bp, Zea mays
  Clone ID: LIB3279-013-P1-K1-G6
aaaaaaaggtttttgttttcattttgaggggaaagggtgaggagcccagcattggattggaggttggattttggctcccagcctcccaggtctccaacggacttgagtagtactactagtggtggttgcatggtgcaatcatttgcaggaatccaaatcattcgccctctagatcgtgctgccatgtctctgtccacccccatcaccttgtgttccgcgacgtctcccctctctctctctctagttttgctgatatgttttttactaactcgctccaccaaatcagttccaataaagccatggagctagctaacccttgctgaactgtggaatggtttctgagcagagcgtggcggagctgaagcagaccctgctggcgaccactctggagctggaggcggcgagggaggagctgaggcggaaggagcagagcat

SEQ ID NO: 4930 - DNA, 424 bp, Zea mays
  Clone ID: LIB3279-013-P1-K1-G7
tgtactccttccaacggttgtcctctaaccaataatattttttcacctaatgaatattgagcttttattttctttaccccaaaacaaaattatgctagttctgagattttagagtaaactaaaattgagtgttgcgattagactatgtccataggcatgagaattacaaaatatatatgtccttacttattgttggttatttctttgtgctaatgactacactgttgaagttattgttctcgtgaggaattatttgtgaaagtctccaattttctgtacaacgttgatatgattcatgtcggcgttgtggagcatgctcatatgcgtgaaagagaagatcatgtactcatgcttcgacgcgaacgcgaggcatgaaaccatcgtcaacacttcatcgtgtccgccatgcttcatgttcaccaca

SEQ ID NO: 4931 - DNA, 436 bp, Zea mays
  Clone ID: LIB3279-013-P1-K1-G8
cggacgcgtgggcgccgcctccacccgcaccacaccaccggcgatgtccacagcggcggcgcagggcggcagcgacaagccggcgctccggaggcccgtcttcaccaaggtcgaccagctcaggccgggcaccaacgggcacaccctcaccgtcaaggtcgtcagcgccacccccgtgcctgggcgcgcgcgcccaggcgcacccgccgccgccccatcccgcgcgccgcgcatcgccgagtgcctcgtcggggacgagaccggcgccatcgtcttcaccgcccgcaacgaccaagttgacttgctgaagcccaatgcgacagtgatcttgcgcaatgccaaaatagacatgttcaaaggatcaatgaggcttgcagtggacaagtgggggcggattgaggctgtagagccagccagtttcacggtgaaggaagac

SEQ ID NO: 4932 - DNA, 438 bp, Zea mays
  Clone ID: LIB3279-013-P1-K1-G9
cctgatcctcgttcctctccgccccgcttgcgccgcgcctccgcccccgtctcctgtgagatcagctccggcggcacgcggatatgactacttcaaggcgtcttgctgacaggaagagtgcaaagttccagaagaacatcacaaagaggggttctgtgcctgagaccacggtgaaaaagagcaatgactaccctgttggacctatagttcttggattcttcatttttgtggtcattggatcatccttgttccagataatcaggacagcgacaagcggtgggctggcctgaattcactgagctaaaaccagaaatttatctgtccgtgagctgggaggcagtatctgtgttgtgtagcaaacttgttcatggatatgtagtgcgaatgtcactactgttctgtttgcagtatcaaaagagtttaaactgatgttgtaac

SEQ ID NO: 4933 - DNA, 418 bp, Zea mays
  Clone ID: LIB3279-013-P1-K1-H1
atcccagtagacaaatatccaacattcaatttcgttggccgcatccttggtccaagaggaaattccttgaagcgggtggaggcaaatacggactgccgtgtgctaataagaggtcgtggcagcatcaaagatccagcacgggaggaaatgatgcgagggaagccaggatatgaacacctgaatgaacccctccatatattggttgaggcagagctacctgttgaaatcattgatgcgcgcctgatgcaagcccgcgagatccttgaagatctgctaaagcctgtggatgaatcccaggactacttcaagaagcagcagctacgggagctcgcaatgcttaatggcacccttcgtgaggaagggatgcagagatccggttcagcgtcccctttccacaacagccttgggatgaagagag

SEQ ID NO: 4934 - DNA, 181 bp, Zea mays
  Clone ID: LIB3279-013-P1-K1-H10
aagaatggagggtgctctgcctccggcgtatcggatatgtccgataggagtctgcggggggggtactctgcacccgcgtggattatgtgttgaccttcgatttcactcatcaacctactcatgcgccttcactgatgcacctttaagaagaaggcaccgtatgccattttggatatctatt

SEQ ID NO: 4935 - DNA, 436 bp, Zea mays
  Clone ID: LIB3279-013-P1-K1-H11
ggcctgcagagcactttcacagaggaacagtgacccaacgaaagcttctcgaccttgggacatgggccgtgatggttttgttatgggggaaggggctggtgtcctcgtattggaagaacttgagcacgccaaggaaagaggtgcaacaatatatgctgaatttcttggtggaagcttcacatgtgatgcttaccacatgactgagccacatcctgaaggaagagggattactctctgcatagaaaaggcactagctgatgcaggggtagcaagggaagaaatcaactacgtgaatgcccatgcaacttctacacaagcaggtgacctgaaggagtatgaggctattgtgcgctgttttcgccagaaccctcaactgagggtgaactcgaccaaatcaatgactgggcatcttataggagcagctggtggaatagaa

SEQ ID NO: 4936 - DNA, 432 bp, Zea mays
  Clone ID: LIB3279-013-P1-K1-H12
gccacctggccgcccatttggctctggccctcctggtgaccgcccaaggggcccaggccgttttgacggcgacaggccaaggtttggtgacagggatgggtaccgtggtggtcctcgtggtgctcctggtgactttggtggcgataagagtggagctcctgctgagttccagccatcattcaggaggcctggctttgggcgtggtggcggcagcggcttcggcgcgggcccaacctcttcttccatggagtgaagttgcccttggtttggacatggtgtttcccttcgcatgtggcctttagttttgaaggacagttattatgtactagtaatattactcggatcggccagtgctgacatatgcaaaaaaatgttctgtcgttatacattggttccagtattattgtcttcgcaaaactcttgggttttcaa

SEQ ID NO: 4937 - DNA, 188 bp, Zea mays
  Clone ID: LIB3279-013-P1-K1-H2
atgacgcttgacctacactgaccacactagttgtgattgcggaaacgctgggcaaatgggggtatccatattcgaaagaaagactagacctactgccacggcataataaatgcaccactcagcttcatacctacttccatgcaaaagctgcacctattcaagagctattgtctcacaaagtatgaacc

SEQ ID NO: 4938 - DNA, 440 bp, Zea mays
  Clone ID: LIB3279-013-P1-K1-H3
cgagtctccagccaaccgcatccagtccaccccatccccctcgaccccgacaaccccgagtcccgacccgatggcgcccaaggccgagaagaagccagcggagaagaagccggcggccgaggagaaggcggagaagacgaccgcaggtaagaagcccaagtccgagaagcgcctgcccgcctcgaagtcctccggcaaggagggcggcgagaagaaggggaagaagaaggccaagaagagcgtggagacctacaaaatctacatcttcaaggtcctgaagcaggtgcaccccgacatcggcatctcctccaaggccatgtccatcatgaactccttcatcaacgacatcttcgagaagctcgccggcgaggccgctaagctcgcccggtacaacaagaagcccaccatcacctcccgcgagatccagacctccgtgcgcc

SEQ ID NO: 4939 - DNA, 440 bp, Zea mays
  Clone ID: LIB3279-013-P1-K1-H4
ctcctcgccgcctcacccgtctcctcctccgcagcttccccgcgatcccgaccatggagggcgacggtaccaaccttgatgcggcgatagagtcgctcctgaatgtcgagaagcagatgaggctggccggagatgtcgccggcactcggaaggccgtcatcgacatcgtcgagctctgctacaaggccggcgcgtggaagacgctaaacgaccagatcgttctcctatctaagaggagaggccagcttaagcaggctattactgctatggttcagaaagcaatggagtacattaatttgacaccaggcattgacacaagcatcgagctaataaaaacactgagcagtgtctctgctggcaaaatctatgttgagatagagagagcaagattgatcaaaaggcttgcaaaaattaaagaggagcagggacagatttacgag

SEQ ID NO: 4940 - DNA, 434 bp, Zea mays
  Clone ID: LIB3279-013-P1-K1-H5
aaagaagggcggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgacaaactcagatccctagtgaagaagtggcagacattaatcgaagcccatgttgatgtcaagacaaccgacaactacatgttgcgtttgttctgcatcggcttcaccaagaggcgcccaaaccaggtcaagagaacctgctatgctc

SEQ ID NO: 4941 - DNA, 435 bp, Zea mays
  Clone ID: LIB3279-013-P1-K1-H6
gcgtgagacgccaggacgctctagcagtacagcagcattatcagggagcgtgccgtgggagtgggaggttgcctcaggtgcggagcagtcgccggcggcgaccatcggtgtctgagatgaaggagagaggcggctccagggcggcagtggacgagcgctacgcgcagtggtagtcgctcatccccgttctctacgactggttcgccaaccacaacctggtttggcacatccctctcctgccggtgggggccacagtttgagaaagctacctacaagaatcgtctacgcctttacctatctgaacagaccgatgggagtgtgcctaatactctggttatcgcacactgtgaagttgtgaaaccaagggttgcagctgctgaacatatctcgcagtttaacgaggaagcacgatcaccttttgtaaagaagtacatg

SEQ ID NO: 4942 - DNA, 391 bp, Zea mays
  Clone ID: LIB3279-013-P1-K1-H7
cgtcaacacatgagaagtgccaagactttgtatgcagctcgagatcaccatctccaacatggaagacaacctcaccatcagatgtcgacggtcttccttgcagctccctccacttgtccaacttcgacattggccacgatcctcaaatttgtcaacttcctcacgtcccctgcagcttgccctagctctccgacttcgacgttggctgtgatccccaagtctgtcaacttactcttataggcttcgactttccctgcacgcgctcgacgtcacccgttggctgtgatacaaaatagtcaattatacattaagatcaatctcatccaacaacttcttctcaatgcacaaaattgccaaaccatataatcaatcttgagtcattgttgatctc

SEQ ID NO: 4943 - DNA, 385 bp, Zea mays
  Clone ID: LIB3279-013-P1-K1-H8
aagcacattgcgtcttccagtttctggaggggctaaggctaatgtacttactgttaagaatgctgtcagttcagcagttgacattatgcaagcgatggggtcatccatttgccatttgctatcaaagttacaggcttcacactctctggttacggaactttcagctgttgctgctaaggaaagtaccttactcaatgagtacagagaactcttggcaacagcagcagcactacaggtccaggagtccagcctaaggacacagctcatacaacagacagtgagcaggttaaggtcctgtatgtatttctgactaggaagattagaggtaaacaccattcattagtttcaactgctgaactgacagcattcttaacaggtagtacat

SEQ ID NO: 4944 - DNA, 389 bp, Zea mays
  Clone ID: LIB3279-013-P1-K1-H9
aagaaaggagggtgctctgccggcggcggagcggagatgtccgagaggaggcgcggcgccggcaccggcacccgcaaggatgaggtggtgacccgcgagtacaccatcaacctccacaagcgcctccacggatgcaccttcaagaagaaggcaccgaatgccatcaaggagatcaggaagttcgcccagaagaccatgggtaccaccgatgtccggatcgatgtgaagctcaacaagcacgtctggagcagcggtatccggagtgtgccgaggcgagtccgtgtcaggattgcccgcaagaggaacgacgaggaagacgccaaggaggggcagtactcttttgtcacagtagctgagatccctccggagggtctcaaaggtttgggaac

SEQ ID NO: 4945 - DNA, 372 bp, Zea mays
  unsure (1)..(372): unsure at all n locations; Clone ID: LIB3279-014-P1-K1-A1
cgccgcattagctcgccccctcgttcgccgcctctcctgctcctaccgcagctctccctcangnnnccgttcgcaatggcggccttcaacaagcttggtggccttctaaggcacagtgctctggtgagcgggattacatggggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgtgaggtcaagaggctttggctttgtgaactactccgacagtgatgctgccaaggaagctatttctgcaatggat

SEQ ID NO: 4946 - DNA, 171 bp, Zea mays
  Clone ID: LIB3279-014-P1-K1-A11
ggatccagaaaatcgatgccaggatacctgctgggttcttagaagggatgacaagaattattccaggcttgggtggagctaatattatggaaaggcttcggaatgctcctgttgatacaaacaacccccagaatggtcaaatactgcttgattttgaggacgccatgggag

SEQ ID NO: 4947 - DNA, 412 bp, Zea mays
  unsure (1)..(412): unsure at all n locations; Clone ID: LIB3279-014-P1-K1-A3
gggccactaacgaggttcgcgccaagtcgaagttctggtacttcctgagaaagctgncgctggnnnaaagagcaatggccagatgctcgccatcaacgagatcttcgagcgcaacccaaccaccatcaagaactacggcatctggctgcggtaccagagcaggacggggtaccacaacatgtacaaggagtaccgcgacacgaccctgaacggcgccgtggagcagatgtacaacgagatggcctcgcgccaccgcgtgaggtccccctgcatccagatcatcaagacggcgacggtccacttcaagctgtgcaagagggacaacacgaagcaagtccacaactcggcgatcaagttcccgctcgtgtaccgcaaggtgaggccgcccaccaagaagctcaagaccaccttc

SEQ ID NO: 4948 - DNA, 303 bp, Zea mays
  Clone ID: LIB3279-014-P1-K1-A6
aaatagagagacagttaggggcaattatgaggatattgccaaggtattggattcaacaggaggcaaggataccgatagggtcaatggctgggtggcagtgcttgaggctcctgattcagaccctgcatccagttgctcggttccggctgcctcttctcttggcggatattgccatcatgactctgcaaaaaatagctcttctatcttaggtcacactatccccttggttgctcagttatgttttgatcaatgttcattatcttgttaagctttttacgactccacttttttacagattcttca

SEQ ID NO: 4949 - DNA, 341 bp, Zea mays
  Clone ID: LIB3279-014-P1-K1-A8
ataaacacagtggagcaaattgagaaacttgagaggcctatcacaatggatgttggttccattgtcctcatggacctgctatggtctgatcctacagaaaatgatagtgtggagggtttgagacctaatgcacgagggcccggcttagtgacatttgggcctgatcgagtaacagaattctgtaaacgaaacaaattgcagttgatcataagagcccatgagtgtgttatggatgggtttgagcgtttcgctcatggacaattgatcactttattttcagcaacaaattactgtggtactgcgaacaacgcaagggccatacttgttgtcggcaggggctt

SEQ ID NO: 4950 - DNA, 387 bp, Zea mays
  unsure (1)..(387): unsure at all n locations; Clone ID: LIB3279-014-P1-K1-A9
ctctgccaacaccagcataacaaaaggatgagctgccctgcnnnggccagctcctctccaataccctgtactacaagcgcttcttcccatattacgccttcaatgtgctcggtgggcttgacagcgagggtaaagtttgttgctttactttctcacatttattggtggaacactcaagtaagcatgttgtgcacctgcacagggaaagggtgtgttttcacctatgatgcagtaggttcctatgagagaactggttatagtgctcagggaacgggatctactttgattatgccagtcctggacaatcaactaaaatcaccaagtcctctattgctccctgccagggatgctgtcacaccattgtcggagtcagaggccatcgatcta

SEQ ID NO: 4951 - DNA, 335 bp, Zea mays
  unsure (1)..(335): unsure at all n locations; Clone ID: LIB3279-014-P1-K1-B1
gaccagaaagnnnaaacctggcggggtacctggctgttcattctgctactagctacgtgaccacacaggagctcactattgatagtggcctgtccatttgaggcttttatgatcctgccaacagaactacagagtcaagcacaacgacaacaaaaaaaggacatcagacgctacagaacgcatcaaaagactactcgaatttgaaaacaaactgcatcgataactaaactgaaaaatcattgttaaaaagaagctattcatgggagagataaataaagctaatcgtcttgcttcggaaaaaaaaaaaaacaaggaaacctttacacataaaaata

SEQ ID NO: 4952 - DNA, 319 bp, Zea mays
  Clone ID: LIB3279-014-P1-K1-B11
aacgccgccagcaccgccgccgcggcccccgcgcctgccgggaccgtgcaagtgccgcgcgggcaggtggatctgatcgacttcatcgactggaccggcgtcgagtgcctcaaccaggactcgtcccacagcatcgtcaacgcgctcaagcagagtttgagagacgacgaggggctgtaccttgccagggattcggacgagcaggtgctgatctacatccccttcatgcagggaggcaaactgcattccgggctattcaaaagtcccgagggagagggccccaaaacagtaaaactcttcttcaacaaagagcatatgg

SEQ ID NO: 4953 - DNA, 155 bp, Zea mays
  Clone ID: LIB3279-014-P1-K1-B12
tatgtgtgagcatgcttgcttgtaacgagacattgaattgttcggaaatgaccattcctgtgctcttattgaaaataaactctgcgttaggttcctcccaaccaaaaaaaggacaaataaacccaaagtaaacataaactggtgaatataaaact

SEQ ID NO: 4954 - DNA, 393 bp, Zea mays
  unsure (1)..(393): unsure at all n locations; Clone ID: LIB3279-014-P1-K1-B2
cgccgcctagctactagtcgcccccgtctcaattcggcactgacgttcattccgcttgtggattgctnnancacctccattcgcagtcggccgtgtcctcggagccgcgggagatggcggatcaggagaccgtagctgtggttgaggcacctaccccggttcttggggaaccgatggacctgatgactgccctgcagctcgtcatgaagaagtcaggtgctcatgatggccttgtgaagggtcttcgtgaggctgccaaagccatcgagaagcatgccgctcagctctgcgtgcttgccgaggactgcgaccagcctgattatgtcaagctggtgaaggctctctgcgctgagcacaatgtccacctggttactgtgcctagcgccaaaactc

SEQ ID NO: 4955 - DNA, 410 bp, Zea mays
  unsure (1)..(410): unsure at all n locations; Clone ID: LIB3279-014-P1-K1-B3
gcgcgccgccacacctgccgntgctaccgccccgcaccttgcttgctttcccgtcgccgnntttgcaagcgcaccaagaaggctggaattgttggcaaatatggaaccaggtatggcgctagcttgcgtaagcaaatcaagaagatggaggtatctcagcactccaagtacttctgcgagttttgtgggaagtttgctgtgaagaggaaagcagttggaatttggggatgcaaggactgtgggaaggtcaaggctggcggtgcttacaccatgaacactgctagtgcagtcactgtcaggagcacgattcgtcgcttgagagagcagactgaaacatgatttagcttgctacatcagggttctcctagttgctgttgacgggaatgttgagctcctctagttggatcacg

SEQ ID NO: 4956 - DNA, 398 bp, Zea mays
  unsure (1)..(398): unsure at all n locations; Clone ID: LIB3279-014-P1-K1-B7
cggacgcgtgggcgttcccaagccagccattggttggtagcaagccaagctaatcaagnnantttagatacccgctcccgctcttcttccctccgacgaaggcagctgacgacacagcaggctagcttcggagttcggagcactcagccatggccattgccggcgctctcctcctactgctcggactcctcgcgcgggaggccgctgccggcgggtggcagagcgcgcacgccacgttctacggcggcggggacgcgtacggcacaatgggcggcgcttgcgggtacggcaacctgtacagcacggggtacggcacgagcacggcggcgctgagcacggcgctgttcaacgacggcgcggcgtgcgggtcctgctacaagctgcggtgcgacaacgac

SEQ ID NO: 4957 - DNA, 408 bp, Zea mays
  unsure (1)..(408): unsure at all n locations; Clone ID: LIB3279-014-P1-K1-B8
agctgctcgcactngcngcgncccgnncccgcacttctcttccttctcgtttcgtccttttnttgcacgcaactgccaccggccaccgcgcaaactccattgcgcgcagatcaagaccgccacacccaccaccagcgcttcagcgggagacgtgacgactgacgagacgaagcctctccccacggcgcctccccctccacatggcctgggctcgccttgcctcccgctcccgtctgcgccccgcggcctccgccgccggccgatcccgacacgcctcaacaccggctccgcctccgcctccgtccccacctaccacacgcacggtacctgcggccacctccgcgccaccgctccggcgtctcctcctgcttccgcggcaccggtttgctgacgccacgccctcagcat

SEQ ID NO: 4958 - DNA, 352 bp, Zea mays
  unsure (1)..(352): unsure at all n locations; Clone ID: LIB3279-014-P1-K1-B9
ggcgcagagaatccccaagcaaacaaacagggtagagggagaggagaggagagganannannaatgggtctgggacaccatggctgcgatgaagctgtacggggcggtgatgtcgtggaacgtgacgaggtgcgcaacggcgctggaggaggctggctccgactacgagatcgtgcccatcaacttcgacaccgccgagcacaagagccccgagcacctcgtccgcaacccgtttggtcaggttgcagctctgcaggatggtgacttgtacctgttggaatcacgagcaatctggaagtacgctggtcggaaaaacaagccagagctgttgagggaaggaaaccttgaggag

SEQ ID NO: 4959 - DNA, 416 bp, Zea mays
  unsure (1)..(416): unsure at all n locations; Clone ID: LIB3279-014-P1-K1-C1
ccacgcgtccggaagatgtcagacggagtggtccgtgtatctggacgatccaggggagacaggaaaggttntnntnntttggcgcagatgcttcagatggagaatcggatgaaggaattgaggtgataactgaactgcctcagaaaagacctaaagttaggcctcgcaaagcccaatcagatgtagtaggaaagagaaccaagctgtcaacacatcccactttatgtaataagaggcagcagatcaagcaaggatcaagtccccactgtgcaactactactgctgaagcacaaggatcaaaatggaccaagtatttggacacgagccgttttggtgggaggaaatgctccgatacctctggtctgcactggactgaacatgatgaatctgccactactgaggccactactgacgta

SEQ ID NO: 4960 - DNA, 157 bp, Zea mays
  Clone ID: LIB3279-014-P1-K1-C10
agatctgccccggtcacaggagctccgactccgagccctctccaatggcggttaaggtctacgtcgtgtactattccatgtatggacatgttggcaaactagctgaagagatccagaaaggtgcctcgtctgttgaaggtgttgaagctaaaacatg

SEQ ID NO: 4961 - DNA, 282 bp, Zea mays
  Clone ID: LIB3279-014-P1-K1-C11
gcggaattggcggaggggcagccggatatgtcgtcgtcggttgggggcggcagcgcgggcggcggcggagaggacatggtcagcctgctggagaaggccaaggagttggaccagctaaagaaggaacaggacgaaatcgttgccgatatcaacaagattcacaagaagctcctcgcatccccagagatggttgataaaccagttgacaccattttgctcaagcttcgtggtttatatgcacgtgcaaaggagctctctgagaatgaaatcagtgcctcaaat

SEQ ID NO: 4962 - DNA, 390 bp, Zea mays
  unsure (1)..(390): unsure at all n locations; Clone ID: LIB3279-014-P1-K1-C2
gnagctctccgctaggctcgacaatcacctgctacgctccacacgccggcggcgactacanctgcnttggcgtggttacagagaagaagggtttggggagaagacaacctaaatcaattggatctgggagtatcagatctaaaaaggttttcatcaagggagaaaaagaaacttttctgtccggtcatggctttcccaactgcagcagctgttttgcttaatgagaacatgcagattcataaaggaaacagggttgatgcaccaagtgccaaaccactgaaatcatcagccaaacctgagagaaaggctcttcaggatgtgtctaacattcctaaaggcactgctttaaagaacagatccacagtcaaagaggggtccgccttgaaagaa

SEQ ID NO: 4963 - DNA, 393 bp, Zea mays
  unsure (1)..(393): unsure at all n locations; Clone ID: LIB3279-014-P1-K1-C3
agcagaccggcaggccagaaangggnggaggnngagatcacccacatcccggctgcggctgcnnnaatgaggcgtcgatatcaatactcagcagagttttgaagctttgaaccccaaagccgttgctgttgtgatagaccccatccagagtgtgaaggggaaggtggttattgatgcattccgcctcattaatcctcagaccatgatgcttggccaggagccacgtcagacaacatcaaatgttgggcacctaaataagccatctattcaggctcttatacatgggctgaatagacactactactgaattgcaatcaattaccgggaaaatgagcttgaggagaaaatgctgttgaacttgcacaaaaagaaatggaccgatgggctaatttt

SEQ ID NO: 4964 - DNA, 403 bp, Zea mays
  unsure (1)..(403): unsure at all n locations; Clone ID: LIB3279-014-P1-K1-C7
ctcgatctgaattacctcgaatacagtgctgggggttcctatgtcactgcttgcattcnnnncagatggacaaagtgactttgcttcagatggatgcaaaattaccaattgatacatttgaaaatgtaatgggacttgcaatagaagggtgcaaagcaattgcaacttatatccgagaggtgctattggagaatacaaagaaacttgagtgtcagcgtggttaaccttaggaggtgaatcccacttgcctagtctgttctacgcttgaaatctgactggcggagtaaaactaacggtttatctgcgtactcggcagtgcaagcagggtgatgacctgaacctacacagccattaaaaggcttactggttgcgtgttgggatggctggctctggtgcaatgcac

SEQ ID NO: 4965 - DNA, 191 bp, Zea mays
  unsure (1)..(191): unsure at all n locations; Clone ID: LIB3279-014-P1-K1-C8
cagccggcctccgccaggcacccaagccgcctccgcctccctagccatcaccagtcgnnnnnaacttgtcctgctccctcgcctctcctgctcggtgctcgacagtcgcccccgctccctgggcacccgcgtnccttggctcacccgacgcccgcggcccaaggatgggctgggccccttcccccttcccc

SEQ ID NO: 4966 - DNA, 295 bp, Zea mays
  unsure (1)..(295): unsure at all n locations; Clone ID: LIB3279-014-P1-K1-C9
ggccggacggacagcccggagcgacccacgcgnccgcccacgcgaacgcccacgcgtacggccacgcggacgcccacgcgaacgctagnggnnncgnnaattgggggatgggggggaagaatccaatccggggagggggggcaaaactttgacaggcgggggaaccctacaattgggggagaagtggtttggtcagaaggaaactttggaagggcagctgtttccagtggagcattaaatggtggatatgaagctctggagttgagggatggtggctctgactatttggggaagg

SEQ ID NO: 4967 - DNA, 212 bp, Zea mays
  Clone ID: LIB3279-014-P1-K1-D1
ttcgaatttttgtagatgaagtcagttttttttttcttgggggtaagtaggaactttcagaaacattttgttctgctgacattgccccggaagattttctgggacctgaccattttgatgtgaaaggactgttgattgccagcgctgtttgaacaggaatctttgtaaaactgaaacacatgttctcttctagttggacaaatatcacgagg

SEQ ID NO: 4968 - DNA, 325 bp, Zea mays
  Clone ID: LIB3279-014-P1-K1-D10
atcagatttgcccccactgattctagtgctcaaacaagggctcctgtcccagagggccaaccttcagatgtcaaagttgacgagggaagcaatggtagcgggaaagatactttgtctctggccgacaagactgcgggctctggggtaaatacggactctagggcctgaactgaaggaccacctcaggctgtggaaaccagggacaagggagaagacacaaaggacgaatctaggggagacaaagagggagggggagaacccaatgaaggcaggtgcatgccatctgaaggggagggcaaaacaaaaggaggagatgctgaagaaa

SEQ ID NO: 4969 - DNA, 259 bp, Zea mays
  Clone ID: LIB3279-014-P1-K1-D11
tccttctggcagcagagcggcagccaatggccatagagacggacgcggcggcggcgagggcgagggcgtcgggctcggtttcagatacggcgcccatgtccccggccgccgaggcggcagcggctgcggcggccccgggcccggcgcgcccgcgcgggggggtgaggaagctcatccccacggactacctgccccggagcaaacggcgctggaggctggccgccccgtccggcgacggcgcggacaggctcgcctcgac

SEQ ID NO: 4970 - DNA, 288 bp, Zea mays
  Clone ID: LIB3279-014-P1-K1-D12
ggcaggaacaagacacactaaggaaagaaacaccaaagggatgaaaagaggcactgcaacaggagagcgcacacatggccatgctggcgggggaaggaaggcgaccatgggagaagggggcagtgcaggagcgcatcaaaaactgcgagggtgaatgacgccaaaggcaggacagctggatctggggctgccggcaagaaggctttcaccgcaggcagagtataagactaagggccatgaggaggcgatatagcgacggcgttgagcggtaaaaaaacggccttctag

SEQ ID NO: 4971 - DNA, 222 bp, Zea mays
  unsure (1)..(222): unsure at all n locations; Clone ID: LIB3279-014-P1-K1-D2
aaaaacaaaaaaccccacccatggctacggcnnnggcgtcctcctgctcgccacctcgttcctgagctgcggcctcctggtggccgccgactacgccccaatgaccctgaccgtggtgaacaactgcccctacccggtgtggccgggcattcaagccaactccgggcaccacattctggaaggcgcgcggctttttcctccccccgctctcccacaaaaact

SEQ ID NO: 4972 - DNA, 319 bp, Zea mays
  Clone ID: LIB3279-014-P1-K1-D5
cctcggcgccgcctggccacgccttatccagatccaggatgcaaagaaaccatgactgcaccaccatgggtcttgattcattgtcatctccgcacaggaggggccaaaacatatgctgcgtgtgatcatcaaaaaagcctcagtcatctcgtgatgacagttggtctgcactggttgagcggcaccggttcctcctgacaacacattttgtgcttgccttcctatgcagtatctatctgtactttgcagtgaccttgggggcatcaaatgcgtgcagtggtttgacaggaggggcacaagagatcgagtgccaggcaag

SEQ ID NO: 4973 - DNA, 378 bp, Zea mays
  unsure (1)..(378): unsure at all n locations; Clone ID: LIB3279-014-P1-K1-D8
ccgcaagctgcccttccagcgcctgggccgcgagatcgcgccggactggaagaaagannanggttccagtcctccgccgtcgccgcgctgcaggaggccgccgaggcctacctcgtcggcctgttcgaggacaccaacctgtgcgccatccacgccaagcgcgtgaccatcatgcccaaggacattcagcttgcccggcgcattcgcggggagcgcgcctaaggggcccggcggataagccgtgggccggggggcaaggtctttttgggaggttggactacagggcggggccggggggaagagggggggtcttgtaaaaaagggtcaaaacaagggaaaatctttggtgggataaagggaaaagcgactttgtgtggt

SEQ ID NO: 4974 - DNA, 335 bp, Zea mays
  unsure (1)..(335): unsure at all n locations; Clone ID: LIB3279-014-P1-K1-D9
ggacagcacggagatgcccgaagcaccttctttagtctcacnnnnnggggaagcacgttccccgtgcaatcttcgttgatctagaacccactgtgatcgatgaggtgcgcactggcacgtaccgccagctcttccaccctgagcagctcatcagtggcaaggaggatgccgctaacaatttcgcccgtggccactacacaattggcaaggagattgttgatctgtgccttgaccgtatccgcaagcttgctgacaactgcaccggcctgcagggcttactggtcttcaatgccgttgggggtggcaccggctctggccttggttctcttctcctt

SEQ ID NO: 4975 - DNA, 322 bp, Zea mays
  Clone ID: LIB3279-014-P1-K1-E1
agttatttccaaacatgcttgcatcaactttccaggacaaaatgaaggaagaggaagcattaaaaaggaaattgaaagcaaggatggagtatgcaaaatttttgcaagataccgcaaaagaaatggcaaaggaagttcaaacatctcgtagcggagaaacaaaacaaacagctgaagatctggacgaatttttgaataaggttaggagaggtggacgtgtctctaatgatgaaatcttgaattttgcaaagctattcaatgatgaacttactctggataacatgaacagaccacgcttggtaaatatgtgcaaatatatggg

SEQ ID NO: 4976 - DNA, 332 bp, Zea mays
  Clone ID: LIB3279-014-P1-K1-E10
ataattcaagtcatcgggggatgggatgattgttggagggcttgctaacatatcaaacactcagaaaagcatcaggggtatatgctacatttcttgctccttttgggtgaccaaacaatccccacaaaagcattggtgtttgttagtttctgaacactatttgatgtttatttccgttctttgttaattcaggagatggtttaattttcgggaggacttcttccttctctttttactgcctccaattatattatatccttgattgtattctgcttttatttcttattgggtcttgtagaatagatcatgttttacttgactgcatcttaccc

SEQ ID NO: 4977 - DNA, 342 bp, Zea mays
  Clone ID: LIB3279-014-P1-K1-E11
taaaatcagtcaaggaagggagctttacatggctctagagaagggtggtgaaacgcttctatatgcatccacagctgtagagaaattcagcaacaggtactgggagggagtattctctacagattagaagcaccagagggagatcttagcttttccatacattacctattatgtacatcctgttttttccccagctgtatcgttgccccccattggtgagagactcggaccactctttgcgaagggaataaggagttcgtatcagttgtacagctgctctgctaccgtgtgctatctgcaaaagaatagcctagtctgggaataacgcagagcgggatagag

SEQ ID NO: 4978 - DNA, 341 bp, Zea mays
  Clone ID: LIB3279-014-P1-K1-E12
cttatgcttatcggaggatccttagcttttttcatggtgttaacagagtatatacttatttcagcaacaagtgccataaccgtgacgatagctggggtagtaaaagaagctgtaaccattttgggtgcgggattttatttccatgatgaatttacttggttgaaagggtttggtcttttcaccattatggctggtgttagcttgatcaattggtacaagtatgagagattcaaaaggggtcagataaatgaggatgacgtcagctctccatttactggtgacgtcaagtacattattatagacgacttggaatatgagaatgaatttgaggaagatacata

SEQ ID NO: 4979 - DNA, 53 bp, Zea mays
  Clone ID: LIB3279-014-P1-K1-E2
aaactgaggtcctggtgctcgctgatgccgcgcaccgggccatatctatacac

SEQ ID NO: 4980 - DNA, 312 bp, Zea mays
  Clone ID: LIB3279-014-P1-K1-E3
gacgcctcgtcccctccagttccatccaatccgccagtgaacagatggcgtcgcagtgggctgctccgccgccgggctacccggccgggcacgggcaggcgtacggcgaccagcagctggccacgccgccgcctcaagcagcgacggccgtggccgtgacggcggcgagcaacggcgtgggcaacccctacgtcgtcgtcacccccgcgtctgccgcaccgtccacctgccagaccgtcaggaaggcgctgggccgctacggcaagctgctcgaggacggaacccgcaaggccgccgacgccaccggcaaca

SEQ ID NO: 4981 - DNA, 330 bp, Zea mays
  Clone ID: LIB3279-014-P1-K1-E4
gaggttctgaggaggaggcacactgctggaacgaatatgaatgatgagagttcaagggctcattcaattcttgcaatcattattgaaagtacaaatctgcaaactcaatcatatgcaagaggcaagctaagttctgcggaccttgctggatctgagagggtgaaaaaatctggttcagcaggaaagcaatggaaagaagcgcaaagtataaataaatcgcttgcttctttggctgatgttattggcgctttatcttctgatggacaacatataccgtaccgggaccataagtaaacaatgcttatgagtgattctgtcggaggcaatgcg

SEQ ID NO: 4982 - DNA, 321 bp, Zea mays
  Clone ID: LIB3279-014-P1-K1-E5
gcagttcgacacggaggcgctgcccaacgacctcgtcaagcgcgggctggccgtgcgcggagaggacggggagctggagctcaccatcaaggactacccctacgcccacgacgggctcctggtctgggactccatcacgcagtgggcgtccgagtacgtcaacgtctactacaagtccgacgaggccgtggccgccgaccccgagctgagggcgttctgggacgaggtgcgcaacgtggggcacggcgacaagaaagacgagccgtggtggcccgtgctggacacccgcgacagcctggtggagacgctgaccaccatcat

SEQ ID NO: 4983 - DNA, 315 bp, Zea mays
  Clone ID: LIB3279-014-P1-K1-E6
ctagcctccgtgaacccgggccgcgccgactcctccggccgcctcgcgctctcgctgccgtgcggcgcgtgggtcggccgaagcgggctcgttcgccgcgccgccgccttctccgggacacgggcgagtttagcgggcgccagggcgcagatcggggccgccgtgcctgccgtcgagcagttgcagcgcaggatggcaacccaagctactgtgcatgccttgaaggatattctgaccagcctccctaagccgggaggtggtgaatatggaaagttctacagccttcctgcaataaatgatccaaggattgataag

SEQ ID NO: 4984 - DNA, 218 bp, Zea mays
  Clone ID: LIB3279-014-P1-K1-E7
tgcattgaggtgccagattgtgaggatgtggagatttatgtcgagactgttgggttgatgtactgcaaggatgtcaagcagaggcttatcaagcaaaatgttgcacgagttctgcgaatcttgaaggtcgcagaatgactaggcttccgtgcatgcatcacatcatgtttagactacctggaagcggttccttgggtcggcgacgaggaggagaacgt

SEQ ID NO: 4985 - DNA, 373 bp, Zea mays
  unsure (1)..(373): unsure at all n locations; Clone ID: LIB3279-014-P1-K1-E9
gacccacgcggccgcaggatcctttacgccatccacaatcgagtgaccgttctttcttccaactacgcttttnnnggacccgttcgttccaccacaccccaccgacggtcgcagatatgtcgccgtcggagccgacgcgggaggagagcgtgtacatggccaagctggcagagcaggcggagcggtacgaggagatggtcgagtttatggagcgcgtcgcgcgctccgtcggcggcgccggcggaggggaggagctatccgtggaggagcggaaactggtgttcgttgcctacaagaacgtgatgggcgcaagaaagggcttgtggcggatcatatcctgcatcgagcagaaagaggagggacgtgggaacga

SEQ ID NO: 4986 - DNA, 251 bp, Zea mays
  Clone ID: LIB3279-014-P1-K1-F1
ttacacgcttaaaaaatcttgtggaggagaaagagaaaaaaattaaggagctacaggacaatgttgctgctgtcaatttcactccatccagcaaactgggaaaaatgctgatggctaaatgcagaacactgcaagaggaaaacgaagagattggggcgatggcatcggaaggaaaaatccatgagctcgggatgaaaatcgccgttctgaagtcgcagaacaacgagctccggaatcaattcgatgttttg

SEQ ID NO: 4987 - DNA, 330 bp, Zea mays
  unsure (1)..(330): unsure at all n locations; Clone ID: LIB3279-014-P1-K1-F10
cannnnnnnccgcgcgggtggtgggtctcgaaggaggatggcgacgcggtgcagctgaaggtgccgatgccggggctggggaaggagcacgtgaagatgcgggtggagaaggacgccctggtgatcaagggggaggccggcaaggacctcgagggcgacgacgacaagggcccggcgcggtacagctaccgcatcggcctctcctcccaggctttcaagatggaccagatcaaggctgacatgaagaacggcgtgctcagggtcaccgtcccgaagatcaaggacgaggagcgcaaggacgtcttcgagatcaagatcgagtagggtgtg

SEQ ID NO: 4988 - DNA, 339 bp, Zea mays
  Clone ID: LIB3279-014-P1-K1-F11
cctgtgggacgagcccatcccacttctcctcacatccaaccaaacgccagcgagaagaggaccgtcccgtcccgttacggttcgtctctccacccctagttccccaaaccggggcatcgattcatcgaaccctgcccggagacgcgagcaatcatagacaggcatggcgatcgctcggaccggcgtgtacgtcgacgactacctcgagtactcgagcaccctggccggcgacctgcaaaggattctctccaccatgcgcgagctcgatgacagggcacatggcattatgggtcagaccaaagaacagataaagtatattctgggagtatcatcccatgg

SEQ ID NO: 4989 - DNA, 255 bp, Zea mays
  Clone ID: LIB3279-014-P1-K1-F4
aggaatccttcaacgacctctgtccagcaagcgctacatgggcttgcatactgtgtgtatggcaaacctgacgtgcggcgtgtgatgttcgaggtgtttgacttcgaacagggccagcctaaagcagtctgaggatcttctccattggtaccgatgctagaggtgctgaatgctgaccaacaagacccgcaaggcagtgggacaaatgcgggagattcttgaaggcgtccattcgacaggagatctttcgattct

SEQ ID NO: 4990 - DNA, 298 bp, Zea mays
  Clone ID: LIB3279-014-P1-K1-F5
gctaaagcaagtgctacagtagctgcaaccctgcccaagcgtatgaccacacgcattgctgctagtggcagaggtggtgccagctctatgctccacttctacacccatgaggctgccgaccacaaaatgtcaccaaacacttttctgatcatgagcattgtgatcatagctgttgtcactatgctccatgttattgggaaactgtaccgcaccttcaactaggtttgtactaccataaccactaacacagacgccaccacaagaggcgccttatagagccatttcaatggatagcaag

SEQ ID NO: 4991 - DNA, 268 bp, Zea mays
  Clone ID: LIB3279-014-P1-K1-F7
tgtgaggacggtgaaggatgtgaacccccacgagtttgtcaaggcctactacggccatctcaaacgctccggcaagatggagcttgctgagtgggttgacattgtgaagactgcgaggttcaaggagctgcctacttatgaccctgactgggactacatcagggctgcatctgtagcaaggaagatctacttgagacaagggattggtgatggtggcttccagaagatttatggtggccggcagaggaatggctcacgcccaccttac

SEQ ID NO: 4992 - DNA, 323 bp, Zea mays
  unsure (1)..(323): unsure at all n locations; Clone ID: LIB3279-014-P1-K1-F9
tttttcttnaatggactccaccggcaccggagcagggggtaaggggaagaagggagcggccgggcgcaaggtcggcgggccaaggaagaagtcggtgtcgaggtccgggaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctggcagggacaacaagaagactcgcattattccgcgccacgtgcttctggcgatccggaacgacg

SEQ ID NO: 4993 - DNA, 305 bp, Zea mays
  Clone ID: LIB3279-014-P1-K1-G1
tccgatccatccacgactgcgctcgctgcccccgctcgagacgctgacacgccctcgtacgagatctgcgccccctccgctccatccacgaccgcgccccccaagcgagtcgccgccatttcgccgattcccggccgctgcctagggttttggcgccagcgcggtcggagggttgtgcctgtgggtcgcgttcccagtgtcgcgcgcggcggcagaaggtggaaggagtggcggttctccggagaggaagtggaggaggttgaggtggtgggtctccacggagcgagattatcagatgccgcggc

SEQ ID NO: 4994 - DNA, 344 bp, Zea mays
  Clone ID: LIB3279-014-P1-K1-G10
tgctcatatcttctgcagagaggaccaaatcaaggacgaggttaaggctgttttggaattcatcaattatgtttacgagatatttggcttcaaatatgagttggagttgtctacgagaccagagaagtatctaggtgaaattgaaacttggaacaaagcagaacgacaattgacagaagctttgaatgagtttgggaagccgtggaagattaatgaaggggatggtgctttctacggtccaaaaattgatattggtgtgtttgatgcccttaagaggaaatttcaatgtgcaaccttacagctggattttcagctgcccattcggttcaagctgacttattctg

SEQ ID NO: 4995 - DNA, 320 bp, Zea mays
  Clone ID: LIB3279-014-P1-K1-G11
tgatgctgtcagggagggtaaccagaaagaagtagaggatggtagacaagaagggaagcgctattatgacatggctcgactcgctgatgagaaatatgctagggagattatcaagcccagggaaacagagtcaaaaaatgaattttgtcttgatctgcgcaaacaagatgcaggaaatgtatctaatctgttgagactccatcttaaacagagggcaaacattccatcttttgattacctgagagttattattggtattgacgacagcagtttcaagatgggacaaagaagaagaaaggtcatgaagtatgtggaaaaga

SEQ ID NO: 4996 - DNA, 296 bp, Zea mays
  Clone ID: LIB3279-014-P1-K1-G12
ggttacaaatatcatcccaaatttggaagaccaggataaggtttcaggatatattgtcgaccagaacaggaagaagatagagaagtttgaattcgagaacacgacgccaccagttgagatatgcgacgagctctggaagaagatttagcgtgtttcagatcattcttgttgtaaggcggcggaaacctgtgcctgtagattgtcgcggtgtggttgatgcagaatgccatgttgtttgtatcattagttcatgacgctggactgttttgtaaggcggcggaaacctgggttgtatc

SEQ ID NO: 4997 - DNA, 255 bp, Zea mays
  Clone ID: LIB3279-014-P1-K1-G3
ctcttgctaacgtcatcaatgacaaagtcggtatccgtgaaggtctgattaccacctcccatgccatcactgctacccaaaagacctgcgatcgaccctcgtctaacgactggacgggtggaacggctgctagtttcaacatcattcccagcaccactggagctgctaaggctgttgacaaagtgcttcctgtccttaaccgaaagttgactggaatgtctttcccgctcccaacccgcgatgtttctgatgttg

SEQ ID NO: 4998 - DNA, 274 bp, Zea mays
  Clone ID: LIB3279-014-P1-K1-G4
caaacggaagcgacctgtaccggatactggatcagtgtaaagtcggggaaacggtgaccgtggaagtcctgcgtggcgatcataaggagaagatccccgtggtcctcgagccgaaggccgacgaatcatagcgaacccaggttcttctgtaccatagcctgatcagtttgtcactttgggacaagacaagaggcgggcgtcttaagcattttcgcctggtgtattttctgcagcagacgcgcaaatacacaagggcgcgtgtgctagcattttc

SEQ ID NO: 4999 - DNA, 248 bp, Zea mays
  Clone ID: LIB3279-014-P1-K1-G8
aacgaacttccgcgtgctgcgcgtgcagctgcccgggaaggacaggcgtgtggccaagcgagagtccaaggaggtgtccatccctcctcacctgatgtcaggcaacgcatcggagctgtttggcttcatcgcctccgcgctagccaagtacgtcgacgcggcgggcgaaggggacggcaggcagagagagctcgggttcaccttatattttcccgtgcgccagacgtcgatcgcgtgagggacgctca

SEQ ID NO: 5000 - DNA, 327 bp, Zea mays
  Clone ID: LIB3279-014-P1-K1-G9
gcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattgaacaatgcctattctgcttacaatgtgccccagaggtcatatcatgggatgaatgcaactgctggactctcatatgtcatggcaccatctcctgtctttgcttctgccccaaaagagaaaggcttttctggatttatgatcgacttt

SEQ ID NO: 5001 - DNA, 207 bp, Zea mays
  Clone ID: LIB3279-014-P1-K1-H12
gaatcgcatcgcaaagagcttttgccagtcgtaggaatgggcgactctgtggttcgttctgtgttttcagcttcttctcgcttgctattgtcttcatggttcctgcagggtaggtaggtgctgttggatgtgtagatcatgtagaggttggaggttgctaccgatgcaaaattctgagaggattgctattttattgaactgtcttta

SEQ ID NO: 5002 - DNA, 292 bp, Zea mays
  unsure (1)..(292): unsure at all n locations; Clone ID: LIB3279-014-P1-K1-H7
cggggacgagatcgggaccggcgactggcaagcggaagggccccagggggggatgctcggnttaggatacgggtccattcacaccggccgcgtggggcgccccatccaggtttgtcatggattccatttggggggggnngntgggtccttcttcgtgcagaatgacatgtgccgactgaactatgggtaaaagacagccggcaactcttgtgatgaacgaattcgctaagggcttgatgtcgagacgaagaataccgactgtcggcgctactctcatatgctttggatgttc

SEQ ID NO: 5003 - DNA, 213 bp, Zea mays
  unsure (1)..(213): unsure at all n locations; Clone ID: LIB3279-015-P1-K1-A1
cccacgcgtncgcggacgcgtgggttggaattaggccgccggacgccgttgcgtgggagagagcaaagtgaaccaggccgaaaccgaagctaccgtcacgaccaccacccccgaccactgcagtaacgccggaccctcgtcttcctgttccccactaccaggaggggattcccgcggcgaagatataaccgccgccgttcccgaaggaaaggg

SEQ ID NO: 5004 - DNA, 399 bp, Zea mays
  Clone ID: LIB3279-015-P1-K1-A10
gttttatttagcatgtagccttaactggtcgtgtgttacagtacagaactgatgctgagttacaacaccctgatctgatccctcaactccaatgtaacccttaacagctcattctgtaaggaacctgtcaccctgttacctgttgctgaactaatgaagtagagctagataatgacgttttatcgtagttattattaataacttatcctctgtgatgttgcacctgaaaaaaaaaaataaggaactaccatctgaagatgacatgggcaacaaagaaagtttgtcacaatgcacttggtgactggaaaaataaaaaaacaggggggggccgctttaaaggatccaagcttacctccgcgtgcatgcaacgtaatagtttttttatagtgccacctaaat

SEQ ID NO: 5005 - DNA, 443 bp, Zea mays
  Clone ID: LIB3279-015-P1-K1-A11
cggacgcgtggggtttgaggagcctgttgaggaaggcagcggaattaacagtcttgcgcttggcgcactggataacagtttcctcgttggagacaaaggcattgaggtcgtgaggaatttcgagcatgggatacacggcaagggcatgtccgtgaagttttctggagggagcacaaacttctcgacacccaaaaaggctcttctcatgcgggccgagactaacatgctcctgatgagcccagccactgatggaaagccgcatgccaagggggtacatcaatttgatatcgagacggggaaggttgtttcagaatggaagtttgagaaggatggagcggatattaacatgagggatatcacgaatgatagcaaaggtgcccagttggatccatccgaatccaccttcttgggactggatgacaacaggttgtgccggtgggata

SEQ ID NO: 5006 - DNA, 341 bp, Zea mays
  Clone ID: LIB3279-015-P1-K1-A12
ccgccttctgctccacagaggcacttcctgcttccgcggttatggcaagcgtaatggtgagcgcaggaggaagtctgtccgtggttgtattgtgagccaagacctatctgttatcaacttggtaattgttaagaagggtgagaacgatctgcctggtttaactgacactgagaagccaaggatgaggggtcccaaaagggcctccaagatcaggaagctgttcaatcttgcaaaggatgacgacgtgcgcaagtacgtgaacacgtaccgcaggacattcactaccaagaatggcaggaaggtgagcaaggcacctaaaatccagcggcttgtgaccccct

SEQ ID NO: 5007 - DNA, 227 bp, Zea mays
  Clone ID: LIB3279-015-P1-K1-A3
gggttggcttctcctccccctccggttcgggttcgggttcgtgaggttctccggggttcgggttcgtgggtgagcggatcgagatggccgcgtcagatgttgagtaccgctgcttcgtcggcggcctcgcctgggccacggacgaccactcccttcacaacgccttgagcacctacggcgaggtcctcgagtccaagatcatcccttgatcgggagacgcaaaggtc

SEQ ID NO: 5008 - DNA, 387 bp, Zea mays
  Clone ID: LIB3279-015-P1-K1-A4
gtgatgtcttctccttcccctccggttcgttttctcattcgcgttatcattcgacatggggaatttccatttagccggatccacacccaaaaaactattttcttcactcataattcctagaccatctctccttggtcattaaacagatgaaaattttgtcaggggaggttgcgtttaatacaagtgctcttaatcgcctcacaaagtaagctgaaataactccaaaaacgaaataattcaaattgaaactaaaaataatacctttccaattaacccgcatcatcttcttatcttatctttggagagagaagatcgctcatgcaacattaggaactcaaggaaaggtccatacgttagagcattcaccgtcttatcattaactacttg

SEQ ID NO: 5009 - DNA, 397 bp, Zea mays
  Clone ID: LIB3279-015-P1-K1-A5
ggggaagcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacgagatgaagcgcaggctgaaggagatggaggaggaagccgccgccctccgcgatatgcaggccaaggtcgccaaggagatgcaaggaggtgaccctagtgcatctacagctgaggcaaaggagcaggtggatgcccgttctgtgtatgttggaaatgtggattatgcttgcaccccagaagaagtgcaacagcatttccaagcttggggaactgtcaacagggtcacaatcttgactgacaagtttgga

SEQ ID NO: 5010 - DNA, 281 bp, Zea mays
  Clone ID: LIB3279-015-P1-K1-A6
ggggaagcgagggagctcacgcggtgccatggacgaggaggagcacgaggtttacgggcaggggatcccggaggacggcgacattgacggcgctgacgttgatatggctgcctccggggatgacgcggtgaagcttcatgagcttgacgagatgaatcgcatgctgaatgagatggaggaggaagccgccgcccttcgcgatatgcatgccatggtcgccaaggtgtagcatgggggtgaccctagtgcatctacagttgatgcaaatgagcaggtggatg

SEQ ID NO: 5011 - DNA, 357 bp, Zea mays
  unsure (1)..(357): unsure at all n locations; Clone ID: LIB3279-015-P1-K1-A7
ctcgcatttcctcccaatccatcccgcctccaaacccgaactccaagtcgccccgcatcgatggcgcccaaggccgagaagaagcccgcggcgaagaagccggcggaggaggagcccgctgccgagaaggcgccggccgggaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatctnctctaaggccatgtccatcatgaactccttcatcaacgacatcttcgagaagctc

SEQ ID NO: 5012 - DNA, 412 bp, Zea mays
  Clone ID: LIB3279-015-P1-K1-A8
gcgcgcacacgttcgccggacataacctaggtaattgagggtgtaattgtctttagaaagacaggacagatcctcggttacatataaataccccgtacagtgtcattgcgggggacggagaaaattactattgccccaatatactgtgtttactggcatcaaacctttcactactctcccaccgtttgagcttgcctgaccacgagtttgaaagtttcaagagtggtacacgctccatcgctaatctagagtgcaccctacagccaggacactcgatcgatcgctgcttagagcgagagcacatgatatactcgtcatttcgtcgccattgtactcgtgtagctacaaattatggactggtaagctagcgcaacaagagaggacctggaattcatactacttaatgaagatg

SEQ ID NO: 5013 - DNA, 388 bp, Zea mays
  Clone ID: LIB3279-015-P1-K1-A9
gcagaagcaaaaaaagaaaggtcttgttgccgatggggagctcagggttctcgtggacgcttccggaccaccccaagctccccaaggggaaaccggtggctgtcgtcgtgctggacggatggggcgaggccaaccccgaccagtacaactgcatccatgtcgctcagactcctgtcatggactcgctaaagaatggcgctcctgagaaatggagactagtgaaggctcatggaacagctgtgggcctcccatctgatgatgacatgggcaacagtgaagttggtcacaatgcacttggtgctggtcgaattttcgcccaaggtgctaagcttgtcgatcaagctcttgcctccggaaagatttatgatggagatgggttcaactacat

SEQ ID NO: 5014 - DNA, 381 bp, Zea mays
  Clone ID: LIB3279-015-P1-K1-B1
aggcgatgtaggggaggcatgcaactgcatccgtgagctgggtatgtctttcttcaaccatgaagttgtcaagaaggcgctcgtgatggcaatggagaagaagaacgagaggaccctgaacctgctgcaggagtgctttggtgaagggatcataaccatcaaccagatgaccaaggggttctcaagggtcagggacgggcttgacgatctggctctcgacattcctgatgccagggagaaagttctttcctatgtgccggccccgaagaaaagggaatggctcctgctgggttcggtgttgcatcttcggcttgaacagctgggcagaagagaagtacgaagcttaagcggctcaacaaacccaggttggatgtgtgtttt

SEQ ID NO: 5015 - DNA, 422 bp, Zea mays
  Clone ID: LIB3279-015-P1-K1-B10
gtcagcctccctctccggatcccccacctgctccgccgccggccaacgcatcgctccccttggcagccaggatgacagaagcaccatttctgccacgtgagaggctcttcaagctgcaacatcatttccagaacatgaccaagcacacctacctgaaagggcgctacgatgtgatcacctccgttgccatccctcttgcacttgctgcctccagcatgttcatgattgggcgtggagtttacaacatgtctcatggaattgggaaaaaggagtgatctaccacgggttaactagtttttctacttggcatggaagtaccatccagactatgaagtcttctttgcttgctaaataatactgtcaaagaacaagtcgactacatttttgcatcatatttctgtttgtatttggggatatgaaat

SEQ ID NO: 5016 - DNA, 444 bp, Zea mays
  Clone ID: LIB3279-015-P1-K1-B11
cgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaag

SEQ ID NO: 5017 - DNA, 450 bp, Zea mays
  Clone ID: LIB3279-015-P1-K1-B12
cggacgcgtgggcgccgacccgcagccgccgccgttcgccatgggtttcctcgacgcgctctaccgtgtggtgatgcgccgcaacgccgtctacgttaccttcgtcgtcgccggcgctttcgcgggcgagcgggcggtggactacggcgttcacaagatctgggagatgaacaacctcgggaaaaggtacgaagacatatcggttttggggcagaggccagctgaggaatgataaattttggtcaccagtttgcttcggtttgaccgtttcattttggcacagtaataaacgatgtaaacttacgctgctcctatgacctccttctcattcgtttactctgaaaatgcttttgtggggatttcgtggtgcatgattgaaacctgttagggcttgttcggttagctctcaatccacatccatgtggattgagtgggattggatagttttga

SEQ ID NO: 5018 - DNA, 380 bp, Zea mays
  Clone ID: LIB3279-015-P1-K1-B2
attcttgagactaacctaatcagcattctttacataataatattataaggaggattaatttcatatacaatactatatataagaaataatgcttcgataattggtagcctatcaagagtatgaatctatacaaatataataatgagaaactaatgtagagggaaaataaatgccaaacaccagatcagagttgaatcaatgtaatcctgtttttatgtagagaacaagattgcagatcaccttcaaaattggaagtctgagttaatgaatcgggttggtcaaaaagctatagtgcattttgttctcagctctatgatggtctatcttgttatggcagttgatctccctccatgggtcatcatagaaattggtaagatttg

SEQ ID NO: 5019 - DNA, 444 bp, Zea mays
  Clone ID: LIB3279-015-P1-K1-B3
cggacgcgtgggggcggcggaggggaagaggaagggcgtcccggcgctagggtggtggctgatgctagtcggctccctccgcctcgcctccgtctggttcggcttcttcgacatctgggcgctccgcgtcgccgtcttctcgcagacggagatgactgatgttcatggccgtacatttggtgtctggactcttttgacctgcaccctgtgcttcctttgcgcactgaacctggaaaataggcctttgtacctggccaccttcctatcattcatctacgctcttggtcatttcctcacggaatacttgatataccacaccatggctgcagcaaatctgagcacagttggcttctttgcaggaacgtcgataatatggatgcttctgcagtggaattctcatgggaacccccggggtttctatgctgggaagcagcatgactgatg

SEQ ID NO: 5020 - DNA, 241 bp, Zea mays
  Clone ID: LIB3279-015-P1-K1-B4
ggttggattcctcaagatgaatatttggatagcaacatgagcttaaacagtacagtaatctaaaaacattccaacattcgacacaacagtaaggctggctgagccatgatcgaaataaacatgaaataatagcaacattaagccgtctagagacccgccgacaagatgcaaaacagccctcatgtgttggttgccctggtgtatatctgctggctggaatgaacagagatcattcttatga

SEQ ID NO: 5021 - DNA, 395 bp, Zea mays
  Clone ID: LIB3279-015-P1-K1-B5
gcatcgtctgcctgttcctgatgcccgttctgcccaaccgaagcccagctgctccaagcagcggcggaagagacctcgtgatggcagccggaaagacaagcagtgagaccccagagatactggaactcatcctccatggaaggcgttgcaagagcacgagggcgaagattaagctatgtattttaccatttcatgcaggagctgcttgctagtagttgctaggctttgagcctcttgcaagcttacctctatatgtagtgtacccgcaaatcttaccgtgctcgctatgcgcctgtcttgcagagaagcctgtcgatatccatggagtagtaccttttttttgtttaatagctcctgtgctacccagaatatgtttaaaatctggattttgtgtt

SEQ ID NO: 5022 - DNA, 434 bp, Zea mays
  unsure (1)..(434): unsure at all n locations; Clone ID: LIB3279-015-P1-K1-B6
aagggactccgccacggtgttggcggcctcatttctgcttctgcagcaccagcacttgggaaccagtgttttccggaggaaccggcaaaggtggccgcagcggcgctcgtcgtctccgtctttcttgagcctcacgcgccgtacgaagacgaagtcgtcgacgatgtcctcacagcaggagagcttgctgagccagagacacaaggcagcttctttgccgtaccggtccggctttcccagggacagggagtggctgatgaggttgagctgcgaggtcttcccggaccaccgccgcgtctgccagcgcttggcggcctgcctcagcgacgcgagccagcggaggcgcggngtgctggtcctggtctccaggtacaccttggcgcggttggagaagatgaggagcgcggcgaccaggcancaggagcagatgcagc

SEQ ID NO: 5023 - DNA, 133 bp, Zea mays
  Clone ID: LIB3279-015-P1-K1-B7
gtcaactccaggagacaagatagtgagaactgaagagaaggatgggcttcgagaagcagatcctgagatccggcaccggccccaagccgataaagggccacaaggggaccgctcactgtacccgctactggaa

SEQ ID NO: 5024 - DNA, 359 bp, Zea mays
  Clone ID: LIB3279-015-P1-K1-B8
ctaaaacaacagattgcttgcatactttcaagccaccacctcctttgaggggaggagatgcatctgttaattctgtccatttatttccaaaaaatactgatcacattgttgtctgcaataagacttcatcaatattcatcatgactttacaaggacaggttgtgaagagtttctcatcaggtaagcgagaagggggagattttgttgcagcttcagtttcaccaaaaggagaatggatatattgtgttggtgaagacatgaacatgtattgctttagctaccaatctggtaaactggagcatctgatgaaggtgcatgagagggatgtcataggcattacgcaccatcctcacaggaac

SEQ ID NO: 5025 - DNA, 374 bp, Zea mays
  Clone ID: LIB3279-015-P1-K1-B9
ggacattggcatctcgtccaaggccatgtccatcatgaactccttcatcaacgacatcttcgagaagctcgccgccgaggccgccaagctcgcccgctacaacaagaagcccaccatcacctcccgggagatccagacctcggtgcgcctcgtcctccccggcgagctcgccaagcacgccgtatccgaagggaccaaggcggttaccaagtttacatcctcttaaggtgccgccgcacgttgctacgatcctgtttaattctcatatttaggcctgtgctagggtgcttctgcaacaatgtagaatttgttataattgctgaatgaatcagttacccctggtgaaagttctaatatattgtaatcttgcgtag

SEQ ID NO: 5026 - DNA, 444 bp, Zea mays
  Clone ID: LIB3279-015-P1-K1-C1
agaaaaccctagccgccgccaccgaagcggcctcccaggtaagcaggatcgtccagcccgccgccgccatgaagcgcaatccccgcgtcacgagctcccgccggaagtgccgcaaggcgcactttacggccccgtcctccgtccgccgcgttctcatgtccgcggggctgtcgacggagctccgccacaagtacaacgtgcgctccatcccgatccgcaaggacgacgaggtgcaggtcgtgcgcggcacctacaagggccgtgaggggaaggtggtgcaggtgtaccgccgccgctgggtcatccacgtcgagcggatcacccgcgagaaggtgaacggctccaccgtgaacgtgggcatccacccctccaaggtgatcgtcaccaagctgaagctcgacaaggaccgtaaggcgctcctcgaccgcaaggcccggggccgcg

SEQ ID NO: 5027 - DNA, 413 bp, Zea mays
  Clone ID: LIB3279-015-P1-K1-C10
ttcttcttcaggacttcactggagttccagcagttgttgatcttgcagctatgcgtgatgcgatggccaagttgggcagtgatgcgaacaagattaacccattggtcccggtggatcttgttattgatcactcagtgcaggtggatgtagcaaggtcgcagaatgccgtacaagcaaacatggaactggaatttagtcgcaacaaggaaagatttggtttccttaaatggggctctagtgctttccaaaatatgctagttgttcctcctggttctggtattgtgcaccaggtcaatcttgagtatcttggcagagttgttttcaacacagatggcattctctatcctgacagcgtagttggtactgactcacacaccactatgattgatggtttgggtgttgctggctggggg

SEQ ID NO: 5028 - DNA, 431 bp, Zea mays
  Clone ID: LIB3279-015-P1-K1-C11
aaatcagcagtctgaatcttgctacctaaatctactacctgctagttggtcttgagataatgtcatcgagcaaccacaatcatgacgataatgtcaatgaatcgtagactcgtagtcacagcagggttttttatcatctgttattgactctgaagcagtaggaggaaatgcggaagtggaagagattgaagtttctgatgatgaagaccagaaagatggtgttggttcaaagagaaagttgacttcagctgtttggaaaggattcaagagggttaaagtagaggataaaattaaagcaaagtgcaactggtgcgcaaagaaacttggagagacaaaaaatggaaccaaacatctacacgatcatctcaagacatgtccataccgtaagagcaaaatgaccggacaaagcaagacatttagtcaaagctcat

SEQ ID NO: 5029 - DNA, 394 bp, Zea mays
  Clone ID: LIB3279-015-P1-K1-C12
ccagctattgcaagaggagccctcacagagattgcttcgaggcttagaactaggactttgagagatacaagtactgccaataatcctccaccttttgccccttccgatgatcctactgtcgatatgcctagcagaaaattaacactatatggagggcctaccaatgatacaccgtatggaaggcctgccaatgatccactgtatggaaggcctgccattgatccaccatttggaagacctaccaacgatcgaccatacggaaggcctgccatcgttccaccatttggaagacctaccaatgatccaccatatggaaagcctgccaatgatccaccatatggaaggcctaccaatgatccaccatatggacgaccttccagtactatagcatatg

SEQ ID NO: 5030 - DNA, 443 bp, Zea mays
  Clone ID: LIB3279-015-P1-K1-C2
catgatctaattatagagctaattgtacaggtttagttctcctaattggcatccaaaacccagaccaaaccttagtcccggggatgatccaaacgcatgtggagctgggttttgggaccttccggtcaaccgatcagagaatgattgtctagcttagcaaatggagagttttgtttttgttaatgcttgttcagcattgtggggggaggttccatggtagagctgataattttcccccattgataagaggttttagggtttttcttcctcattttcccagaaggaatacaccaaatagaagccttgtctggtgtcggaggcacgtaggtgtgtgttgctctgaaagaagaataggttgcctttcttttcgtcgccatctttttttcttttgaaaaggaaaggaaaaaataacgatcgagcttaacatggaaaaggtgcacagg

SEQ ID NO: 5031 - DNA, 452 bp, Zea mays
  unsure (1)..(452): unsure at all n locations; Clone ID: LIB3279-015-P1-K1-C3
atcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcaaccagcacccctggatctacgagangtaaacatggaaagtttcaca

SEQ ID NO: 5032 - DNA, 428 bp, Zea mays
  Clone ID: LIB3279-015-P1-K1-C4
cttccccaacagtggcatcctcgctgaccaaggtgtcgccggcaaaggcgtccccatcggcggcatcgacggcctcagctcagaggcggcgatgttcgacgtggagtacgggcggtggcaggaggagcactaccggctgatgtacgagcttcgggcggcgctgcagcagcacctgccggagggggagctgcagatgtacgtggagagctgcctggcgcaccacgacgagatggtgggcatcaaggagggcgccatcaagggcgacgtcttccacctcatctccggcgtctggcggagccccgccgagcgctgcttcctctggctcggcggcttccgcccctccgaagtcatcaagatgctgctgagccacgtagagcccctgaccgaacagcagatcgtgggcgtgtacgggctgcagcagtcggcgc

SEQ ID NO: 5033 - DNA, 431 bp, Zea mays
  Clone ID: LIB3279-015-P1-K1-C5
gtccgcaaatggagaacttggatccaatctgaattgggcagcatgattcgagctcgccctagcttgaaccggctgagctcagaggcgtccatgttcgacttgtagtacgggcggcggcaggaggagcactaccggctgatgtacgagcttcgggcggcgctgcagcagcacctgccggagggggagctgcagatgtacgtggagagctgcctggcgcaccacgactagatggtgggcattaaggagggcgccatcaagggcgacgtcttccacctcatttccggcgtctggcggagccccgccgagcgctgcttcctctggctcggcggttttcgccccttccatgtcatcaagatgctgctgtgccacgttgagccccttgccgaacagctgatcgtgggcgggtaccggcttgcacagtcggcgcttga

SEQ ID NO: 5034 - DNA, 452 bp, Zea mays
  Clone ID: LIB3279-015-P1-K1-C6
cttgattggctactgtaaggacaaagaccatttcgcccttgtctacgagtacatgcctgaagggaacctgcaggatcatctgagactgagagacacttgcactcacagaccactcacttggcagcaacgccttcagatcgcccttgatgccgctcaaggtctggagtacctgcatgtggcatgcaaaccagcgctgatccacagagacgtgaagagcaggaacatcctcctgaccacgggccttggggctaagatcgccgactttggtctgaccaaggctttcagcgactcggagacacacatcaccactgaaccagctggaacaatgggctacttggatccagagtattaccgcagctaccgggccagcgagaagagcgacgtgtacagcttcggcgtcgtgctcctggagctggtgacaggccagtccccggtcgtccccgtggacgaca

SEQ ID NO: 5035 - DNA, 445 bp, Zea mays
  Clone ID: LIB3279-015-P1-K1-C7
cggacatgtttggaattgagaaggcggaaataatgaggcacctttgctaccgtgatgctgctggtgctgtcaggcatactggtgaagtgccgttcaatgacttcatgaaagtagcacggaggctcaccattatagagggcacggaggggagactgcagaaacctctcgtggaatacatggtcgagcgggcttgattgcatggtggttcggacaaggcaatctgaaacttgtgcaagactgagcttagagcgaagtaactgctgtgtgttttcatttgtgtttgtctgccgccgaagcagaatcgctatgcttgtctggtcgtgtggaaaaccttggtgtacggttcgtgacttggtcgttagaactctgtcgtggtcagttgtgttttgcttggtcgaagttgatgaataacctctttgacgaattagcttggaataaagatcga

SEQ ID NO: 5036 - DNA, 453 bp, Zea mays
  Clone ID: LIB3279-015-P1-K1-C8
tctgatcaagggaggcagaacatgatcactgcgctggatgtagcaatgcctgccccttctttgacagatagaaaagatttgaggaacatacagaggagcttgcattctctgacacctgaaatcagcgacgaggatgaagatccttacgctgttgaatccatggtggttcatggagtcctagatgcaggcgggaaaagggcttccatatctcaggtgaaggaatccatctgttcagcactggaaggcagggcgacaaaacccaagttctcccacctctcggtatcgccgtgccccctcccaatcccactcccgttcccgtcaatcttcagcagcagcgtaggccagcagggcgagatcctcggcaccagccacgcagaaggagcccggccaaggggtccgcttgccgtcggctcggtgccgatggcagcgcgcctgaggtcgagcagcgccata

SEQ ID NO: 5037 - DNA, 379 bp, Zea mays
  Clone ID: LIB3279-015-P1-K1-C9
tgaagatccagccggcacaccatcggcgaagaagaggccggagagaggatgatactggccgtgctcttcgccaactccgatggaaacatccttgtcgagcgattccatggggttcccgcggaggagaggctccactggcgctccttcctggtgaagctcgggtccgagaacctcaaagggtccaagaacgaggagctccacgttgcctcccacaagtctgtgtctattgtttataccacggtcggggatgtctgcctctacattgttggcaaggatgaatatgatgagcttgcttcagtcaaggatgtttgtgcgaaacctcctaccgagcgcctctttcttgacaaatacgggaggatctgcttgtgccttgatgaga

SEQ ID NO: 5038 - DNA, 376 bp, Zea mays
  Clone ID: LIB3279-015-P1-K1-D1
gcaaaacaagaagcaaccgtaagcagaaaagagcatgcccagatcatgacaggaagcggatcccactgaggaggaacggaagctggtgctgcacatgtacgagctgggtcgactgcttacacaatgcaccttagcaagggtttactaaccgagggacctgagggcctgtgcccgcacatgccacagttgcatcgtacacatcaaagtgatcgacaaggcgcgtctgcggtgtacggaagggatggtggagcacatgtgaccagtgatcatgcatcatggccacggtgctgaaccataacgaggtgggcattcagaaggtgctcgtcagtcgctgccgactattcttggtcatggactacacgcgcagcggggagct

SEQ ID NO: 5039 - DNA, 432 bp, Zea mays
  Clone ID: LIB3279-015-P1-K1-D10
cggacgcgtgggtctttttgtaggaaaaatctcaaaccctagagaccttaaagagattcttgagacgggctcaaaatgagtttggattgagaatcaaaaagattagaagcgacaatggaatggagttcaagaactcacaaattaaaggatttcttgaggaggagggcatcaagcatgagttctcttctccctacacacctcaacaaaatggtgtagtggagaggaagaatagaactcttctagatatggcaaggaccatgcttgatgagtacaagacactggatcggttttgggcggaggcgattaacaccgcctactactgcatcaaccgactctaccttcaccgaattctcaagaaaacatcatatgaactcctcagcggtaaaaagcccaatgtttcttattttagagtctttgggagcaaatgcttta

SEQ ID NO: 5040 - DNA, 444 bp, Zea mays
  Clone ID: LIB3279-015-P1-K1-D11
cggacgcgtgggtctttttgtaggaaaaatctcaaaccctagagaccttaaagagagggttgagacggactcaaaatgagtttggattgagaatcaaaaagattagaagcgacaatggaatggagttcaagaactcacaaattaaaggattttttgaggaggagggcatcaagcatgagttctcttcttcctacacacctcaacaaaatggtgtagtggagaggaagaatagaactcttctagatatggcaaggaccatgcttgatgagtacaagacacttaatcggttttgggcggaggcgatttacaccgactactactgtattaaccgactttaccttcaccgaattttcaagaaaacatcatatgaactccttagcggtaaaaagcccaatgtttctttatttagagtctttgggagcaaatgctttatttttgttaaaa

SEQ ID NO: 5041 - DNA, 441 bp, Zea mays
  Clone ID: LIB3279-015-P1-K1-D12
gattgccatgatgattatggagatactcaattgcaatctagggagagaactagaaataacactagaagttacaacactgtattttaaaggatgccaagtggtagggctatttcagcatgtaagtttttttcaaaaggtgatggcactgaaggcaaccagcttaagcctatgattgatgtggaaatgattaatgtgactgcagcttaagcctaataatactccagcttcagaaatattgtaagaagtcaagctgtctcaagaaatattgtgaacgctatcagggaggtgttggatgctccagcaactgcagatgcgagagtagcaaaaatgcttttggcagaagagatggtgagcatttagcgtttcaaatttaggaacatgtacatttcgtgagtcccatcccgggacatcttttctgacttactatattatgatgctaat

SEQ ID NO: 5042 - DNA, 412 bp, Zea mays
  Clone ID: LIB3279-015-P1-K1-D2
caaccaactgcttccttccccgccgccgcctacaaccaacacttcacgtgcccccatccttttccgcctcaagtcaagtgttcacggtccatcctctcgagagtctaggcccttctcccgaagccgcagacgcagaaaacggctctacatatggaggcgaagaagaagccgtcggcccccgccgccgtcggagccgcgccgccgcctccgggtaacgggtacttcagcaccgtcttctccgcgccgactgcgggaagcgcaagtgacgcaaagcatgcggacttgtacacgatgctgaacaagcagagctccagagggcagaatggcagagatggcaaatcccacagccgccctacttacaaggatggcaaacatgcccatccaaatgagccatcagaatctccttactttg

SEQ ID NO: 5043 - DNA, 179 bp, Zea mays
  Clone ID: LIB3279-015-P1-K1-D3
aaccaactgtttccttcctcgccgccgcctacaaccaacacttcacgtgcccccatgcgggggcgactcaagtcaagggttcacggcccatcctctcgagagtctaggcccttctcccgaagccgcatacgcagaaaacggctctacatatggaggcgaagaagaagcctgccgccccc

SEQ ID NO: 5044 - DNA, 450 bp, Zea mays
  unsure (1)..(450): unsure at all n locations; Clone ID: LIB3279-015-P1-K1-D4
cccacgcgtccgcccacgcgtncggttaattctggtcacaaatcttctcagtcagtttcatgtggaaatgaacctagcgaacggggagctcgttctgaatgctgcaacggtggacagaactgcaactcaaatgatgaatcagaaaaaggagatctgaaaacaagatgtcgatcattggatagtgattctaatgaatcaaataagtctagttctccaggaaataagaaagaccagtctgattctgatggttgctgctgtcaaatggataagtttggcatgggagaaaagaaatcatgctgctcaccttctaagatcaatgatagttcaggtggagctgtgcttcgttatgctttgcacctgcgatttctgtgcccctccaagaaaaaatcctcgaaatcaatgcttcgttgcaaatctgatctatcaacggcaccatatagcagcaatacg

SEQ ID NO: 5045 - DNA, 451 bp, Zea mays
  Clone ID: LIB3279-015-P1-K1-D5
caaaaaaatggaaaggacttactccaaggatcagatgacctggatgttagattgatattgcttctggttgctacttctatggcgactgcgagtgtttattttctttatattctaagcactaaatttattggggtgtcatgttcgtactgtttgttctcagcatttctctcattcactctactcttcatcagagtaaaggacatcggttttgaacgtatccagaagttcgctggcattcagttagctgtagctgtcattatagctcttgctttgacaaactcatatagttctgctactactcaattgaaaggcacagatgatttcgtattagagccgtatgaaacagagatatcaaccgaatcatccccatttgccattgcactggctaaacatttgcactctataggtgctaagatgtatggagcattctggtgttctcattgcaatgaac

SEQ ID NO: 5046 - DNA, 428 bp, Zea mays
  Clone ID: LIB3279-015-P1-K1-D6
cccacgcgtccggagagatccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcac

SEQ ID NO: 5047 - DNA, 384 bp, Zea mays
  Clone ID: LIB3279-015-P1-K1-D7
cgatagcggaagaaacaagaggctgctgctgcttcttccgttgcaacttgcatgtgaggcgaggccgtgagagaagcgcgagccatgtctatcgcactgcatagcgggcgcggggtgggcggcggcggcgcccctcggttcggccacgtcgcccgctgcggctacgcggcctcgccgccggcggtggcggggcgcggcggttcgtccttggtgggacggtacagcgacagccccgctgcggcggcgcagtgggagtgggacggcgaggaggtcgagggcggcgactgcgaggtgcaaagcttatacaagggctccgttttcgacaccatggacgcgctccatgaggccctgccctccaagaaaggggtatgcaagttttataat

SEQ ID NO: 5048 - DNA, 357 bp, Zea mays
  Clone ID: LIB3279-015-P1-K1-D9
cctctccccatcggcagtcttccccaagtcgtctaaaccccaatccctaaatccccgacgcagaccacacgacgcgcacctccgttcacgaggcggaagcatgagtcgccatccgatcactaagtgggcacagaggtccgacagggtgttcttgacaatagagctgcccgacgccaaggatgtgaagcttaacttgaagtctgaaggccatttcaacttctcagctaagggctcagatgacttgccctatgagtttgacattgagctgtttgatgctgtgaatgtggaggagagcaaagcagctgttgccccaaggaccatatgctacctgataaagaaagctaagagcgggtggtg

SEQ ID NO: 5049 - DNA, 318 bp, Zea mays
  Clone ID: LIB3279-015-P1-K1-E1
cccacgcgtccgcaggagttggttttggctacctgacaacgtttggagcaaatggtcaggttgttttttacctaggctcgcgggtggcaatctagtcttaggattgatttctactagagttattaggttgttagtcttctttagactgtgtgcatctagcgcgatgtagaagttttgttgtcaagaaagttgtgacttatggttatcttgatgcaataaattttctcttctcgaaaaaaatgatgatgccgctgggaatgtaataaacttatataggaacagtttttacaattgaaaatgtcaattaccaattcttgt

SEQ ID NO: 5050 - DNA, 438 bp, Zea mays
  Clone ID: LIB3279-015-P1-K1-E10
cccacgcgtccgcgctccggcctggaggccgcggttggcgggtacatcccggccggcgccgcggggctccgcttcgacgacttcgaatccctccaccgcgcgctcggggacgcgctgttcggccccatgccggtggctgtgaccgaggacgacgacgacgagggggacatgaaggaggcgttccgggtgttcgatgaggacggcgacggcttcatctcggccgccgagctgcaggccgtgctcaagaagctcggcctgcccgaggctcggaacctggccactgtgcaggagatgatctgcaacgtcgaccgcaactgcgacggccgcgtcgacttcggcgagttcaagaacatgatgcaggggatcaccgtttggggcgcttagctgccgcgcacctgcgttgtcacaccccctctactgcgtggtgtcatgtatgta

SEQ ID NO: 5051 - DNA, 396 bp, Zea mays
  Clone ID: LIB3279-015-P1-K1-E11
ctcccctctctcccccaaggccccaacccacttgagcgagccctagagaaggcaaaagccatggcgtccttggttgttcgtgccgccggcgccgccgccgccgccgaccgtcttccctccctccgtcctcgccgcaacggcagcggggtgctctccggcttgagggtcggaacagggcactacggcgcgcggctcgcgcttgcttcgtccacagcttctcacaaagagttcaagatcgcctgccttactgtcgatgacagcagtttgggcccgggggatgaatatgagtctgacccccgcatgccaggcgaggatgagttcgaccatttctaccgtgttctcgccaagaagactgacaacctggtcaactgctacattccaatgccgcttgcactt

SEQ ID NO: 5052 - DNA, 442 bp, Zea mays
  Clone ID: LIB3279-015-P1-K1-E12
ccagcctttttgttctccccgcgagcgctatctttctctatcgactggcgacgactccgccaccggcgccgctctacgcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatactaaaggttgttgactccaagatggtcgtccagagaggccgcgagggagggccccagggaagacagatgaggattgcggagtgcttggttggtgatgaaaccggcatcattgtcttcactgcaagaaacgatcaagtggatgtaattaggcctggaacaactgttgaactgaggaacgcaaagatcgacatgttcaagggttcgatgcgg

SEQ ID NO: 5053 - DNA, 436 bp, Zea mays
  Clone ID: LIB3279-015-P1-K1-E2
cggacgcgtgggttttttcagagaaaacagagggaggaaagaaaaagctcacccccctctctcttcccaccacctctctcacgtgtgtgaggtggcgagcccaaggaggagcgggaggccacaagtccgatccgcccgtatctaatccgctcgagcgcagcggctcgttcctcgcgggggcgcacggttggcatttcgagtgctgagacatcggcttcattgaatcctaaagcacggttgagccatggctggctcccttgctgcctcagccttcttccctggcccaggggcgtctccagcagcatccgcgaagaacttggctggtgaagtaccggatagtttgagcgtccgtggtattgtcgcaaagcctaatgccaattctgggaacatgcaagtgaaggctcaagcacaaacccttcccaaggttaatggcacc

SEQ ID NO: 5054 - DNA, 447 bp, Zea mays
  Clone ID: LIB3279-015-P1-K1-E3
gcagaagcaaaaaaagaaaggtcttgttgccgatggggagctcagggttctcgtggacgcttccggaccaccccaagctccccaaggggaaaccggtggctgtcgtcgtgctggacggatggggcgaggccaaccccgaccagtacaactgcatccatgtcgctcagactcctgtcatggactcgctaaagaatggcgctcctgagaaatggagactagtgaaggctcatggaacagctgtgggcctcccatctgatgatgacatgggcaacagtgaagttggtcacaatgcacttggtgctggtcgaattttcgcccaaggtgctaagcttgtcgatcaagctcttgcctccggaaagatttatgatggagatgggttcaactacatcaaagaatcttttgaaagtggtactcttcaccttattgggttggtgagtgatggtggtg

SEQ ID NO: 5055 - DNA, 383 bp, Zea mays
  Clone ID: LIB3279-015-P1-K1-E4
gagccactaaatccttagacgtcgacagaaccatacgtgcaaatcagatacgaaggcggcatacacagagcaattcatttccacccgcgcaataagatggaagtcagaacatgtagttgttttcgtttgtaattttgtttctatagtgtaagatttgacaaggctgttagtttgcacctcggatctgcttatatccacagggcaatcgatagttcagcaagtattgagctatacctatgtcccgagaagattagatgagttggcgtcttggcgatcgatgtgggcttttcccgttgttgttccttgcaatttattttcgaaaaaaaaagaaacatgttcgctttaagctttacgatacggtatatattattcttggaagtgtt

SEQ ID NO: 5056 - DNA, 341 bp, Zea mays
  Clone ID: LIB3279-015-P1-K1-E5
gtcatgaagcctgagctagatggggtgaatgagcatgcgctcggagacaccaccaaaggataggtggcaactgaaccagactacaatcctgcgagcaaggaacatagagcaccactaagatgagaaccggcatgccggggaatttggaaaagggactactggtgcacagggtgatgcaaacatgaatgttaccaacagccagataccattgacagcaacaaactcaagcaaatgaagacgatgtacaagttcacgctcccaccaaatgatcaaagacagcgggggcacgagctcaccaagagcaaccgaaacgatgtcagacgcgatggttgacgaatcac

SEQ ID NO: 5057 - DNA, 441 bp, Zea mays
  Clone ID: LIB3279-015-P1-K1-E6
tgatgatcaagggatgctgtgtgggtccaaagaagagggtggtgaccctccgccagtgcctcctgaagcagacttcccggctggcgctggaggagatcaagctcaagttcatcgacacatcgtccaaatttgggcatggtcgcttccagactaccgatgagaagcagaggttctttggtaagctcaaggcgtaaggtgctgcggtgcaccgacaagtcccatttgtcaaaatcatcaaactgtgaaacttttgtttgttaccttgctgtaccaagttttgtagcaggatgatttgggagcatgttctggtcttctgtggattgttctacgcttcagaactgcagcgacattgcaagtgttttggtgtttgatcatcaacggaactatttatattaattatgtttgctagagtgtaaaaaaaaggaacaaactggccaggaa

SEQ ID NO: 5058 - DNA, 443 bp, Zea mays
  Clone ID: LIB3279-015-P1-K1-E7
agagcctcattcatctccattcgaaacaccctcgcacccacactctcccttcgtccccagcctaaatccccgcaacgatggctcgcacgaagcagacggcgcgcaagtccacgggcggcaaggccccgaggaagcagctggcgaccaaggcggcgcgcaagtcggcccctgcgaccggcggcgtgaagaagccgcaccgcttccgcccgggcaccgtggcgctgcgcgagatccgcaagtaccagaagagcacggagcttctcatccgcaagctgcccttccagcgcctggtccgcgagatcgcgcaggacttcaagaccgacctccgcttccagtcctccgccgtcgccgcgctgcaggaggccgccgaggcctacctcgtcggcctgttcgaggacaccaacctctgcgccatccacgccaagcgcgttaccatcatgccc

SEQ ID NO: 5059 - DNA, 400 bp, Zea mays
  Clone ID: LIB3279-015-P1-K1-E8
agagcctcattcatctccattcgaaacacccttgcacccacactctcccttcgggggcagcctaaatccccgcaacgatggctcgcacgaagcatacggcgcgcatgtccacgggcggtaaggccccgaggaagcagttggcgaccaaggcggcgcgcaagtcggtccctgcgaccggcggcgtgaagaaaccgtaccgcttccgtccgggcacctgtggcgctgcgcgagatccgcaagttccagaagagcacggagctttttatccgcaagctgccctttcagcgcctggttcgcgagatcgctcaggacttcaagaccgaccttcgttttcagtccttcgccgacgacgttctgtaggagggtccctaggcttatcttcttcgcctgttttaggact

SEQ ID NO: 5060 - DNA, 414 bp, Zea mays
  Clone ID: LIB3279-015-P1-K1-E9
aaagagtaaaataaaaggctgctggagatagtctaagactgtaaccggattcagggtttactttcacaggtatttacaggagagacgcaactttgttcttcttcaactccatcacaatcatactgtttcacaaggtaaagccaaccgaccggctatctgtatcttctcctatcatcgtctcaggttctcagcaacgtcaatcttcaaatgcggctgagcatcccttgccaaaccggctgtaagatccaatcttgcagcctacgaagtttttgagccttcctgggatgctttgaatatgcggtatgcagctatgcacattgttatgttaccaaccactgtcagagcaccttgaagggctacaaggacttcaagagactctgaattgtagaaaaaatgccacgtgcaagcacacat

SEQ ID NO: 5061 - DNA, 293 bp, Zea mays
  Clone ID: LIB3279-015-P1-K1-F1
cggacgcgtgggcggacgcgtgggttaagaaaggcaggcatgcacaagagctgatatcaacatattgggtgaattattgatctttcgacgagagggtgtgacatgactcaattcatggaggagatgacattcactgctcgactactaccatgttgcatcttagcaattaatacaccacctcatatggttgcgacgatcttgtatagcacaatacctagccattatggcacttgtcctgcaagtaattgaagaactaccaataacaagtaagacaagtactgaattaaggtttc

SEQ ID NO: 5062 - DNA, 449 bp, Zea mays
  Clone ID: LIB3279-015-P1-K1-F10
ggaggctgttaaggaggcaccacgctcatcaacattgccgtcaagatcaactgtaatgaaagctggtccacaacaagtcctggattcactgtttaaaattcctgaaacacgcacgtatgagccaagttctatggactggaaaaaggtagtaaagaaactgcaaacaatcaattataccgctgcatcaaacaatcacgaaaggcctaaggatgggggtggctatcgtgagctccgtggtgttgctgcaaggcattacgataaaatgaaagaatactatcagaaagctgcctttgcatattcgaagggtgacaggtcatatgcttcttaccttgctgaggaggggaaacattatcgagaactgggtcgcatagaagacgagaaggccagcaggaatatatttgaagccagaaataagcatataacgaacacagtaaccatcgacttgcatg

SEQ ID NO: 5063 - DNA, 456 bp, Zea mays
  Clone ID: LIB3279-015-P1-K1-F11
caatagaggaagatgatgaggaggaggatgacttcgatgatgacgaagcagtcaagatcttccgccggcagaaggtcgatcaagctgtaaaggaggctgtgtcaagagtgctgtccatggtagactctacagaagcgaggatgcaataccggcgaatgcttgaggaatttcgccaggcaactaattggaaggatcaaatgaagtaacatcaatatttgacagtgatttagagttattagggatcaacgacttcatgtaaggagcatttatgtttcgagatctgccagcacccatcaatgacataattaagtatttagggaatgtgttccagttgctactaattggccgtcaaattgtacagtgttagcgaaatcgaaagtagattatttctgccacaatgtattttcactttctgtatttaggtatattttgacaatggcagttcaattaagtaaa

SEQ ID NO: 5064 - DNA, 431 bp, Zea mays
  Clone ID: LIB3279-015-P1-K1-F12
gtttcaggcagggccagaaaaggccagaaccctgggggtggtcttatttctgaggggcttggggagaggattcctgaactatatgctctgcttcaggaaatccatggcctccatggcaaaggtgtttctgttgagaatatctcttctcagctttcaccctgggcatctgcactctttgagtttttgcccccttttatcaggaagcagctacttctccatcctgaatctgatgattcagctcaactttctcagattgagacagagaagcttctagcccagttagttgagactgagatgaacagacgtttgaaggagggcacttacaaaggaaagaagtttaatgcaatctgtcacttctttggctaccaagctaggggagcactgccttccaagtttgactgcgattatgcctatgtcttggggcatgtgtg

SEQ ID NO: 5065 - DNA, 444 bp, Zea mays
  Clone ID: LIB3279-015-P1-K1-F2
aatttttactgtgccaacacatgcacacactggtggtgcctgcatctagctattcagatcaaagcctgacaggtaccatagggcaaagtgaagaagaaacagaagagttgagcaagatcacgctagagaataaggatattcagcttgatatcaatataagagaagaatcttggagctcttcacaacaagtgaacttttacacagaaagtaccagctccagtgaggcttgtttgatggagccgaccctatggagctgcatgtttatgattttaaaggacctggtgtaaccttatcaatgtacaatagcgatgagtttattaggccttttgctaagtcctccatggatatggctctttcaaaaaagtcgtctcttcatctcagcaccaagaatacaatcatcaagaagtatgacgacaggcatggatcatctatgtttctacaagc

SEQ ID NO: 5066 - DNA, 454 bp, Zea mays
  Clone ID: LIB3279-015-P1-K1-F3
ccagacagccccccttgatctgggaacagacgatttttacaaatctagagagaacattgcagaatctcagttgaagaggatacgggacggaatggccgaagagatgctaatcagctcatgggagctacatcaggggacatcctgccagggtgtaaactgggcccgttattcgttaactgatctacgggctgttgttgcatgcgttggtggccaccgtttggcatcgctcctccgccatctagccgttgattacaggagctggtcgagtggaatgcccgatctgctgctatggcgtttccttgatgaaagaggtggaggtgaggctaaacttgtggaggtcaaaggacccagggaccagctgtcagagcaacagcgtgcatggattcttgttctcatggattttggatttgacgtggaagtttgcaaagtaagcccggtcaccaagcggagatag

SEQ ID NO: 5067 - DNA, 455 bp, Zea mays
  unsure (1)..(455): unsure at all n locations; Clone ID: LIB3279-015-P1-K1-F4
gctgcgtaaacgaatccatcgccatggcgtctcgtctcgttgcggcggcggcctcctcctcctccctctcttcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttagtggaaagaaggaagccaagactgaggcgggatcaccacaggcataggtggcggagatggagttgtacccatatctgtggcctggcaacaatgttaaataaaaggaatgctttatgttgtgctttcaagttgataaattggggcaacaagagattntgctttacctaggcaatatattgagaagctactcttactca

SEQ ID NO: 5068 - DNA, 459 bp, Zea mays
  Clone ID: LIB3279-015-P1-K1-F5
aaacaggcctcgtctcgtcctcgtccgccgccaaatcgaaccccccaaaccctagctacccggcgcaacgcccccttccccgcctctccgcggcgctgcgtgacacccgcctccgctacgaaacactggggcgggtgtagcctagcgggcgggccatggcgtcaacggtgctggaggcaacgcgggcggcccatgaggacctggagaggctggagcggcttgcggtgcgcgagctgcaacgggagcccgctaacccgcgtgaccgcctctttcagtcccaccgcgtccgccacatgctcgacctcgtcgtctccacctccggcaagctcgtggaaatttacgaggacaaggacaatgctaggaaggatgagatcaacactcatcttactgcacccacgcaaagtggactgtttagcaagtactatgaaaggctcaaagagatccgtgaatatcatcggc

SEQ ID NO: 5069 - DNA, 335 bp, Zea mays
  Clone ID: LIB3279-015-P1-K1-F6
ctcttcccgcccactcgccaagacaaacgcggcggcgatggccgtccaggcgcagcacctggtcgcaccagccttcctgccccacgacgtcggccacgccttgagggcgttggagggtgccgcggcagtcggtggctccgcgctcctggacgagctcggcctcggcgggtgcgcgccggcgccggcgccggcccccctaggtgacgcagcgatcggcggtgcccagccgcgcagtgagctcacttgcaacgccgccggtgacaacagcgtgtttctcccaaggaagcgggcacacgttgtgccggggtttctgctggtcgacttggataacaggt

SEQ ID NO: 5070 - DNA, 353 bp, Zea mays
  Clone ID: LIB3279-015-P1-K1-F8
catcggcatctcctctaaggccatgtccatcatgaactccttcatcaacgacatcttcgagaagctcgccgccgaggccgccaagctcgcgcggtacaacaagaagcccaccatcacctcccgtgagatccagacctccgtgcgcctcgtcctccccggggagctcgccaagcacgccgtctccgagggcaccaaggccgtcaccaagttcacctcgtcctaggctgcgtggcctccgcttgcaggcttccctcgtatgttcgcgtgtcttgctgtagttaggtgctgctgtgtctggtctcctccggtagcaactgttatctgatggaacagtaacaatgcttattgaatcc

SEQ ID NO: 5071 - DNA, 433 bp, Zea mays
  Clone ID: LIB3279-015-P1-K1-F9
cgccgccgcctgatagctccagcgccctcgccgtcggctgcccggctgccgtcctcccgctacgagctaggcatctccttcgccgatccaacatgggtaagacacgtggtatgggagctgggcgcaagctcaagacccacaggaggaaccagaggtgggctgacaaagcctacaagaagagccatcttggcaacgagtggaagaaacccttcgctggatcatcccacgcaaagggaatcgtcctggaaaagattggcatcgaggccaagcagcctaactctgctatccgtaagtgtgctcgtgtacagctggtgaagaacggtaagaagattgccgcctttgtgccgaacgatggctgcttgaactacatcgaggaaaacgatgaggtgctgatcgcggggttcggtcgtaagggccacgctgtgggagatat

SEQ ID NO: 5072 - DNA, 452 bp, Zea mays
  Clone ID: LIB3279-015-P1-K1-G1
cccacgcgtccgcccacgcgtccgacgcgctcgtctctccaagcctcgaaccgcatctccggcggcctagtggaacgcgaagatggcgacggcgctcggcctcggtgcgcgctccggcctccgactcctctccgcaggcgccgtggccgcctcagcaacggcttctcgtgcattccattctactggcgcaaggaggatgggggcgcacgctcatgatgagccatactacgtccacgccaagcacatgtacaacctgcacaggatgaagcaccagcagcttaaggtgtgcctcgccgtgctggctgcggtgggcactggcattggagtccctgtgtatgctgttgttttccagcagaagaagactgcatctgcataatctgaaacgccgaggtggctcgacatgaaaacatgcctgcccgtgaaatttcttttcccatttcccacaacatttt

SEQ ID NO: 5073 - DNA, 395 bp, Zea mays
  Clone ID: LIB3279-015-P1-K1-G10
cgcattcgttccaactcctgagcactttctcctagtgccagacaaagccaatcgagggcaaaatacaacattgacttcaacggcacccgaacaaggggttaggggaaaaagggagcggccggccgcaaggtcggccggccaaagaagaagtcggtgtctaggtacgagaaggcctgtcttcagttccccgaaggccgaatcgggcgctacttgaagaagggccgctacgcgcagcgtgtttgcaccggcgccctcgtctacctcgccggtgtcctctaatacctctccgcttaggttttggagctcgcccataatgcttccagggacaacaagaagactcgcattatttcgcgccacgtgcttctggctatccggaacgacgaggagcttgggaa

SEQ ID NO: 5074 - DNA, 254 bp, Zea mays
  Clone ID: LIB3279-015-P1-K1-G11
cccacgcgttcgcccacgcgtacgcggacgcgtgggtttttttttttttatacaagtgccaaacatgacacgtacaaactcttcgtcgttttgcctgtaggcttaaattcccttgactcagattacgtctacaccctggacccttgtgctacggatcgctgcacaggatttcggtgcagacggtgagtgcgttctgcaggtactacgacctgctctggctctgaactggagcgttgagcatctgtagaagacac

SEQ ID NO: 5075 - DNA, 439 bp, Zea mays
  Clone ID: LIB3279-015-P1-K1-G12
tcaccagcaaatttcaatcataccggaactgttgatgcacaacctatctcaaaacaatacatggtgggtattcttcattttgatggtgcttcaaaagggaacccaggtaaagcaggtgctggagctgtgcttatgactgaagatggaagagtgatatctcggcttcgtgagggtcttggtgtcgctactaataatgttgctgagtatcgaggcctgatcttaggactgaaatatgcgattcggcatggattcaagagaattaaagtacatggggactctcaacttgtctgcaatcaggtgaatggtgtttggcaaacgaagcagccgaatatgatggagctgtgcactgaagcgagaaagctaaaagagaacttccattcctttgagatcatccatgttcgacgggagtggaatgctgaggcggatcgtcaggcgaaca

SEQ ID NO: 5076 - DNA, 335 bp, Zea mays
  Clone ID: LIB3279-015-P1-K1-G2
gcgatgcctacaggatgctgatgcgagagatgtcaaaataaaccgtaaatctataaagaggtggagtataagacttatggagatcgcactggaggactctactatgctccaacatgatactgaaaccattactgcatgaatggctgtgcaagacaacaatagtcaatgagtaagctagctatccaaccataaggtgcacagactcataggctgtggttgctaagaattacacacctgacatggcttacttgtatatgtggtgaacacggcaaagatgtaccgtgctcgctatgctcgacatcttgcagagaacaccagttgatgtgcatctacta

SEQ ID NO: 5077 - DNA, 452 bp, Zea mays
  Clone ID: LIB3279-015-P1-K1-G3
aaaccactctcatcctctcgcaccgcaccgttcgcttcctttcgtcaactccactcctcttggccgccgcatcacctcctcttcgccgctgccgccaccgctccaccgggcagccagccagccatggatgaggagtacgacgtgatcgtgcttggcacggggctcaaggagtgcatcctcagtggtctcctttccgtcgacggcctcaaggttttgcatatggacagaaacgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacactgatgtgacaaagtacttgtcattcaaagcttgtgatgggagctatgtttt

SEQ ID NO: 5078 - DNA, 463 bp, Zea mays
  Clone ID: LIB3279-015-P1-K1-G4
gttaactcaaatggggatgtttgtgccattcagaaagctggtggagagggtgtcatgtcaagtgttatcatgcagtgtttaagaattgcttcggtaaaggctgctgatataacaagcaaaataaagaaagcagtagactcatacaccaccgagaaagccctaaagaaagtaaaacgtttgccaacctcggttcctcagaaaattaatgtcactaatgtaactatggacggcaaaggtgatggtgaattggaaaagcaatctgtgcagatgcatagtgatgttccgcagataagcaaaggtgatgagaaccagcaaagtataaaaaggaattcacccttgactagggaccgaattgcaaaacacaaacaaacatccacattcattggtggcccatcaaattgggacccatattctaaaggagtttcattaagatccctcaaaatttctgatttgccggatccac

SEQ ID NO: 5079 - DNA, 459 bp, Zea mays
  Clone ID: LIB3279-015-P1-K1-G5
cccacgcgtccgcttggaaatctgccgttgttacaaggctatttatgatattccagcaataaaagaggatccaacaaagtggataccgattcttaggaagatctgttggtacttggtgctagcacctcatgatcctatgcaatcaagccttctcaatgctacactagaggataaaaacctttcagaaatcccaaatttcaggttattactgaagcagctggtcaccatggaggtgatacagtggacaagtctgtgggaattcttcaaggaggaatatgagaaggagaaggatcttgggggagctttgggtgccaaagcttcagaagatttgaggctgaggattatcgaacataatatcttggttgtatccaagtactatgcaagggttaccctcaagaggcttgccgatcttctttgcctgactttgcaggaggcagagaagcatctctcagacatggt

SEQ ID NO: 5080 - DNA, 463 bp, Zea mays
  Clone ID: LIB3279-015-P1-K1-G6
ggcaaagcagaagttgcggatggcctcgtcctccttttatccgtcgcggatcacatctctgcgtgcgtcgatggcgtctttctcggaggctccccccgggaacccgaaagccggcgagaagatctttaagaccaagtgcgcgcagtgccacacggacgacaagggcgccggccacaagcaaggtccaaacttgaacggtctttttgggagacagtcgggtaccactgcaggctactcctactgtgcgggaaacaaaaacatggctgtagtctgggaagaagacactttgtatgagtacctgcttaaccctaaaaagtacattcctggaaccaagatggtcttgcctgcgctgaagaagccgcaggagcgtgctgatctcatcgcgtacctgaaggaagcaactgcatagttcaatgacatgccttttgccatgacaagaaaaatgttttgaagataataaaaa

SEQ ID NO: 5081 - DNA, 318 bp, Zea mays
  Clone ID: LIB3279-015-P1-K1-G7
agaacaagactacattccaatccaacgatgtatgcacctgacacctagcaaggaccttgatggccagcagctaaccttaccgtagaaactgacgcattttataaatcacattcacatcttcatcacaatataaaggtactcaacaaccgatagagagatgattcacatagaaacatatagctgggttgaataagcaccattacggtcctatcagataacacagttgctacagacagatagataacatacatagaagccagcaggcagcagcacctaactacagcaagagacgtgaacacaggagagaattctgcaagc

SEQ ID NO: 5082 - DNA, 447 bp, Zea mays
  Clone ID: LIB3279-015-P1-K1-G8
gtttggttgctggaaagggagtggacttttacaacttctcatgtccctattgttgggagggttcggagtccggatcgggatttgccacaaccagattgttcaacactcggaaggctcaccaaatcgtgctacgcttctgcttcctcctgcacgaggtgaggaaaccctagcgactgaccatggcgttgctcccgcgcaccgcacggttggccttcctctctaccccgcggtcgtacttcggcgccggcgctgcgggcgccttcccgacctccccagcgccatacgggggcgcgcccccaccggcgatgtcgaagaccgccgagttcgtggtctacaaggtttatgaccaaatgcctgggcctaagagggttaatttaatgggcagctgtgccaacggtggaggatactaccattactcctactctgttgtacgtggatgtgaccgta

SEQ ID NO: 5083 - DNA, 441 bp, Zea mays
  Clone ID: LIB3279-015-P1-K1-G9
cttcccatcccccactgctcagcagtcagtcagcactcgccacccacacgcctccggtccgcccacggttccactccaactctccgatctccaggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctggtttaaagattgctatcgatctccttgagcctatcaaagcaaagaatccaaagataacatatgcagacctgtatcagcttgctggagtggttgcagtcgaagtgactggggg

SEQ ID NO: 5084 - DNA, 420 bp, Zea mays
  Clone ID: LIB3279-015-P1-K1-H1
ttttgggccaaagatggggtagaggatgattgatctgtcggcagtctgatggcgatgaattaatacgaggtcttcaatgctgacagaaagggttaatgaaacaaacttgaatccagtgattataggcactccgcacggaccacatgattcatctctcactggacatattgctaccacaagaagcggacggttgctgccgcaactaaaacatgccgtgtggatgtcagttttcagttggcctatgccatccagagagtaaaaagtgaggatcaacgagcatgttgccgagtagtttctcaagtataaattactgcgtctacttgctccttcgctttgggaacaatgtatcaagttgtaagttgcaattaaatgtttggaacagtttgtcatggtaattgtgtggctcctatatggctatat

SEQ ID NO: 5085 - DNA, 327 bp, Zea mays
  Clone ID: LIB3279-015-P1-K1-H10
gggagaagtagatctgcatctgcgagaggaggcagcgggggtggtgatgatggagagccagtcgctgtaggccccgacagccacagctcccgcccccggatctgcggagccagccggagcttcgccagccgtcacccccgacaaggagttcacgcgcacctgcaagggccttgtcgtcgtgctcatcgtaagatacgtgctgctccagctcctaccttcgtaactaaactacctcgccatcattccatccaagacaattccctatgtatggaccggttttaccgctggttacatctatcaaggcctgccaggggccattggcagttc

SEQ ID NO: 5086 - DNA, 457 bp, Zea mays
  Clone ID: LIB3279-015-P1-K1-H11
agcagcgtctcctccccagatccatcaattcgttcggaccgcccttctcgtgtccgcgttccaaagcgcggcaggctgagcggttccgtcagatttgagtcgtcatgaatcccgagtatgattaccttttcaaacttctgcttatcggtgattctggtgtgggaaaatcatgcttgcttctcagatttgcagatgattcatatctggacagctacatcagcacaatgggagttgacttcaaaattaggacagcagagcaagacgggaagaccataaagcttcaaatttgggatactgctggacaagagcgcttcaggacaatcactagcagctactaccgtggagctcacggaatcattattgtatatgacgtgacagaccaagaaagcttcaataatgtgaagcaatggttaaacgagacttgaccgtatgcaagcgacaatgtaacaagctcctt

SEQ ID NO: 5087 - DNA, 373 bp, Zea mays
  Clone ID: LIB3279-015-P1-K1-H12
ctaacaggttaggtcaaccataccataaatgctgttgcgcgttctttctcaagacggtacatcgtggggattctcgattttgactgcgctacaaaaggaaacccaaagaatgcagggtctgattacgtgcttatacctgaacatggaagagttttttctctggtcatatagggttttcgtgtcatttctaattatgatgctgagtctggcagctttatcttcggactggaatgtgccatttggccttgctccaagcgacttaaaggacatgccgtctctcttcttgtttgcaataatgagaatggtgattggttaacgacacttactaatatgatctagctgtgcactgaagcaattatgcttgaatagaact

SEQ ID NO: 5088 - DNA, 314 bp, Zea mays
  Clone ID: LIB3279-015-P1-K1-H2
ggggccgctcggtcaccactactaccaccaccacccactagactactgcttctgctaccaaatactacggcggaacggaacggctggttgccgccgccgtcgtccttggaaaggttgaggcgtctcttggtcatccgtatcgttgccgttgtcatggtccttggagtcgttgctaccctgattgcaagccggcaaggggggaaaaaacaacaacaaagccgtgtgggaaaatggaggaggcaggcgtacaatgtacgctctcccgcccactgttgctttataatctctatatcatcatcatcttcttcttctcc

SEQ ID NO: 5089 - DNA, 439 bp, Zea mays
  Clone ID: LIB3279-015-P1-K1-H4
atcgtggctgataagtatggaaggaaaccagttatcgtactgacccttattgcaatagttatcttcaatactatgtttggactaagctcaaactattggatggcattaatcacacgatgcctgcttggaatcatgtgtggttatctcgggccaattaaggcttatgctacagaagtgtgccgaaaagaatacaatcatctggctttggcagttgtttcttcctcacgaggcattggtctcattattggtccagctcttggtggttatcttgcgcagcctgcagataaatatccaagtatattctctcagacgtccatatttgggaggtttccatactttcttccgtgcctgtgtatatcaatccttgcagttattgctctaattgcctgcatctggtttccggaaactttgcataaacacaatggggatgccgttgata

SEQ ID NO: 5090 - DNA, 155 bp, Zea mays
  Clone ID: LIB3279-015-P1-K1-H5
gtaaattagttcatttccaccttaattccctcccaatcccgaaggggatttgaggttcacaaagtagcgaatgtgtcagactcctacttccctcgcaaccatactaccttgtactacctgaaatttttatttatatatatatttgaaatgttatt

SEQ ID NO: 5091 - DNA, 462 bp, Zea mays
  unsure (1)..(462): unsure at all n locations; Clone ID: LIB3279-015-P1-K1-H6
cgggacgcgtgggtctttttgtaggaaaaatctcaaaccctagagaccttaaagagattcttgagacgggctcaaaatgagtttggattgagaatcaaaaagattagaagcgacaatggaatggagttcaagaactcacaaattaaaggatttcttgaggaggagggcatcaagcatgagttctcttctccctacacacctcaacaaaatggtgtagtggagaggaagaatagaactcttctagatatggcaaggaccatgcttgatgagtacaagacactggatcggttttgggcggaggcgattaacaccgcctactactgcatcaaccgactctaccttcaccgaattctcaagaaaacatcatatgaactcctcagcggtaaaaagcccaatgtttcttattntagagtctttgggagcaaatgctttattcttgttaagaaaagtagaaaatctaaa

SEQ ID NO: 5092 - DNA, 359 bp, Zea mays
  Clone ID: LIB3279-015-P1-K1-H7
cccacgcgtccggtcggcaaccaatgagcatatttgctgcatcgaaggctcgaagccccttctcttcactggtcttaaaggaccttgagggctagtttgggaactctatgtttccctattttctcaagtgaaaatgagctaatttcccttagaaaaatgaggttttcaaactagcctgaacgaaaggacgccgggggaaaatctaacttgactttctttgttggatgaaaggttgtggacagaatatgaagcgaagtttgtgtgactctagttgtctgcttctgttcagcatgtacctacggaaattacttgctagattttgatgtcatgtttattgagttgatttggttcgtctcttc

SEQ ID NO: 5093 - DNA, 434 bp, Zea mays
  unsure (1)..(434): unsure at all n locations; Clone ID: LIB3279-015-P1-K1-H8
gaaccggacaggatggccgccgatcgcgcacgggtgctgcgcgcgctgccggcaaggtgctggacgaaatgcctccgctgcgcttcccctttcccctccacctcgcccgccgcctcctcgctctccagcctcagccgtgctgccacgtctccctttccgcccgcctctcgctcccggcgccttctacactcgccgccctcggcggcggtgcgcgtgcgggcgcagctgcagatgcgcttcttggcgagcgaggccgcgcggggcggtgtcggcgggcgcggggcagcagcggacagcgaggaggaggcgcatgagtgggcggtggagtgggaggacagcgaggacgacggctactagcccgagatcggcgactgcggggacggcggcggngtcgcgctgcggggcgtccgttggggcgagcgtgccctcgtggc

SEQ ID NO: 5094 - DNA, 412 bp, Zea mays
  Clone ID: LIB3279-015-P1-K1-H9
caaattcattagctggtgagaatgtatcagctgatctgtttagcattggtcatggggaatttccttctggcagtattcacggcgaataaactcttttggccagtggaaaaacgatggaccatgttgatttgttgagagaacagttgaatattttgtcaggggaggttgcgtttaatacaagtgctcttaagcgcctcacagaggaagctgaaagaagcccaaagaacgagaagattcagatggaaatgaaaaagaagaccgatgaaattaaggggaagcagcaacagatagcatttttggagagagagatagctcatgcaacattaggaactcaaggaaaggtcgatacgtttgagcattcaccgtcttatcatgaactacttgagcagctcaatgagaaatctttagaact

SEQ ID NO: 5095 - DNA, 466 bp, Zea mays
  Clone ID: LIB3279-016-P1-K1-A1
cggaactggggcttctatgacaccgtgaaaggcagcctcggcctgcagctcatgtcgcccatgccacctgatcgggacacgaagccactgctcccgagagctggtttcttgcagcagcatgggcatcacaatgccccacaccagctccacgcacagcagccgcagcattaccgtgactccgctggtggcggagtctctggtggcacacctgccgagcagcaccctatccacatggacttctcgcgcaatgaagcttggctgcacccatcacaccaccagcatccccatgaacagaaggtccttcattctcgccctatcggaccagctgggcatgttgggcatccaggccatgttgcccatcctgtgcatgccgtgcatgttgtgcatcaccatcctactggctatgggatgatatcagatgcacaacatactcttcagatgatgcaaccacagcttgagtcacagc

SEQ ID NO: 5096 - DNA, 411 bp, Zea mays
  unsure (1)..(411): unsure at all n locations; Clone ID: LIB3279-016-P1-K1-A10
gcgagatcaccaccaaggcgagcgtggactacgagaagatcgtgcgcgacacctgccgcgagatcgggttcacctccgacgacgtggggctcgacgccgaccgctgcaaggtgctggtgaacatcgagcagcagtcccccgacatcgcgcagggcgtgcacgggcacttcacgaagcggcccgaggagatcggcgccggcgaccagggccacatgttcgggtacgccaccgacgagacccccgagctgatgccgctgagccacgtgctggccaccaagctcggcgcgcgcctgacggaggtccgcaaggacggcacctgcgcctggctcaggcccgacggcaagacccaggtgacggtggagtacgtgaacgagggcggcgccatggtgcccgtncgcgtgcacaccgtgc

SEQ ID NO: 5097 - DNA, 410 bp, Zea mays
  Clone ID: LIB3279-016-P1-K1-A11
cgccgtcaccacctcaatccagcaaacgcaaaccccatctcgccgccgccgcgatgtgtggccgctatgacagccgcacgacgatcttctcgccggaggggcgtctctaccaggtggagtacgcgatggaggcgatcggcaacgccgggtcagccctgggtatcctagcggccgacggcgtggtcctcgtcggcgagaagaaggtgacctccaagctcctccagacctcgcgctccgccgagaagatgtacaagatcgactcccacctggcgtgcgccgtggccgggatcatgtccgacgccaacatcctgataaacaccggccggctacacgcccaacgctacgcgctcttctaccaggaacccatcctcggagagcaggtcgacagtccctcttcgacaccaagcagg

SEQ ID NO: 5098 - DNA, 440 bp, Zea mays
  unsure (1)..(440): unsure at all n locations; Clone ID: LIB3279-016-P1-K1-A12
gttaaatcagccaggttcatcctggatttgctgaagaatgctgagagtaacgctgatgtgaaaggcttggatgtggacaacctctatgtttcacacatccaggtgaatcaagcccagaagcagaggcgccgcacctaccgtgctcacgggcgcatcaatccctacatgtcctcaccttgccacattgagctgatcttgtcagagaaggaagagcctgtgaagaaagaggctgacaacattgtcgcagcaaggaagcagtgaagtatatcagcatgctgatcgaggccattttgtcgaagtattatagccgtagctcttttatgtaccttntcaggcagccttgcctctcgagacgtttccngcaccgatgtttaaatctggatatctatgttctgtactgcactactgtgttggactgtaagtcagctcgtatacatagc

SEQ ID NO: 5099 - DNA, 474 bp, Zea mays
  Clone ID: LIB3279-016-P1-K1-A2
ggctcgaccgacgcgtgcgtgccgcccttaagacagattcggtgctcaaggcgctgaacatgacctccccgaagggcggcggcgacgccccgcgggggttccgggagaaacccaggaacgccgagaagccgaccaagtacgccggcagccccaagagcagcgccccccgcgtgatccaccagcctcgctaggttcgctgggggaactcatcaggaaggctgctgcccctcttgcagccttgctcctggctgccgccgctgtcgtggactcgtggtctgctctttcaagtcgaagtaacggtggttcgagctagtggatagtgtggctcaactgtagaagttccttttgtatagcaagcaagtaaaaaaaaaaatgaccaaaaaatataacaaaatgcagctgtaagtttactgctgctctctaagtcgtgttcagtcatccagtgtgtctagtctagggaaaccccataaaaat

SEQ ID NO: 5100 - DNA, 465 bp, Zea mays
  Clone ID: LIB3279-016-P1-K1-A3
cggacgcgtgggctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaactacctctaaaaaaaaaaaaaaaaaaaaaaaaaaaaaaaaaaaaaaaaaaaaaaaaaaaaaaaaaaaaataaaaaaaaaaaaagaaaaaaataaaaaagaaaaaaattaaattaaatttatttaaaaaaaaaaaaattaaaaaaaaatattggggggggccgttttaaagggtacaagtttttatccccggggttgggagaaataatttttattttggggcacaaaaaaaaaataaagggggc

SEQ ID NO: 5101 - DNA, 394 bp, Zea mays
  Clone ID: LIB3279-016-P1-K1-A4
atcggcgaaggatctgttgtgcgatctaactaagtccccttcgaatctccccacggtctaggctaactccgccgctcgccgtcggccccgctttcggttgctgcagatcgcgaccatgggaccccgcggcgtcgccctagcgctccttgccgcggcgctgctccaggccctcgcccccgcgtcggcggcggcggcggcggggggcctggtgcgggtcgcgctgaagaagcagcccgtcgaccagaacgcccgcgtcgccgcgcgcctctccgccgaggagaggcagcgcctcctcctccgcggcgccaacgccctgggctcggccggcggcgacgacgactccgacgtcatcgcgctcaagaactacatgaacgcgcagtactttggggagatc

SEQ ID NO: 5102 - DNA, 403 bp, Zea mays
  Clone ID: LIB3279-016-P1-K1-A5
gaaggagtgcgcgcagcaggccggcagcatcgaaggctacggccaggccttcgtcgtgtcggaggaccagaagctggactgggcggacatgctcttcctcatcgtgcggccgagggaggccagggacatgcgcttctggccgacgcgccctgagtccttcagggattccgtggacgcgtactccttggaagcttcgaagctagcgtaccgcctgctggagttcatggcaaggggcgtgggtgccgacccggcgtcgctgcagagcatgttccaagggcaggtgcagggcatgcgggtgaactactacccgccgtgccagcaggcggcggaccaggtgctgggcctgtcgccgcacagcgaccccaacgggctcaccctgctcctgcagatgagccacgacgtg

SEQ ID NO: 5103 - DNA, 410 bp, Zea mays
  Clone ID: LIB3279-016-P1-K1-A6
cccacggtccggccttgaggaccccccaactcgccggctgcagccatggtgaaatattcgacggagccaaccaaccccaccaagtcaaccaaggccatgggccgtgacctacgtgttcacttcaagaacacccgtgagacagcttttgcccttaggaagttgtcactcaccaaggccaaaaggtaccttgaggatgtgattgcccacaagcaggccatcccgttccgcaggtattgtggcggtgttggacgtaccgctcaggctaagtctcgtcactcaaatgggcagggacgctggcctgtcaaatctgctagattcattctagaccttctcaagaatgctgagagcaatgctgaggtaaaaggtcttgatgtcgatcccctctatgtgtcacacattcaagtgaacca

SEQ ID NO: 5104 - DNA, 464 bp, Zea mays
  Clone ID: LIB3279-016-P1-K1-A7
cttcgaccccggtcgtcccgtcctccgctgggcatcgaaagtcgaacgcctcccccctgcctccctcccagttccgtcgtcggctcctgcagcagcagcaagcaatggcggcttcctggagagccgtggcgctggcggtggccgcagtgggctggcttcttgccggtgccgcgcgggcgttcccggccgaggacttggtcgcgcggctgccggggcagcctccggtcacgttcaggcagttcgccgggtacgtggacgtcgacgccaaggccggcaggagcctcttctactacttcgccgaggcgcgggaggacgccgccgccaagccgctcacgctgtggctgaatggaggtcctggctgttcttcggttggaggtggtgctttcaccgagctagggccattttatccgcgaggagacggccgaggcctcagatcgaacaagaagtcatggaacagagcgtcc

SEQ ID NO: 5105 - DNA, 461 bp, Zea mays
  Clone ID: LIB3279-016-P1-K1-A8
cgaggtggaggctaaccagtacaccgctgcactgaatcccatcctcttccaggtcctgatcagtcctatgcttgggggaaccaccgaccagaaagttgtggatgagaaccttgagaagctgaagaaggtgctagaggtgtacgaggcacgcctgaccaagtgcaagtaccttgctggagacttcctcagcctcgccgacctgaaccatgtgtctgtcactctctgcctgttcgctacgccctacgcatctgtgctcgacgcctacccgcatgtgaaggcctggtggtctggtctgatggagaggccgtctgtccagaaggtcgctgccctgatgaagccatctgcttgaaacggttgccctgtcaatcggtgaatggaataagccaagtctgttctgggttgtttgcttgttcagtgatgtgtcttctatgacgaaagttgagtgcctatgtgtgagcatg

SEQ ID NO: 5106 - DNA, 462 bp, Zea mays
  Clone ID: LIB3279-016-P1-K1-A9
ccagcgtctcgcctcgccgtcagcagcagcagcagctgcacctccattccacggcttccgtcgtgcgcttcgtctgcacccacaaaggcgacggcgacggcagggggaggagatgaagctgaagcagctggagggcctcttgggtggcctgacccagttctccgaccccaagctggagctggagcagtatgcgacgggccctcacatcgcgtcgcggatgctctacatggcagagaatagtttcaatgacataactggcaaagtggtagctgacttcggctgtggctgtggcactctggctgtggcgagtgctttactggatgctgaacatgttcttggtattgatattgacccacagtcacttgaacttgctcaagaaaatgctgctgatctggagctggacatcgatttagtttggtctgacataaagaacttaaatctgaaaggcgtccatgttgatac

SEQ ID NO: 5107 - DNA, 239 bp, Zea mays
  Clone ID: LIB3279-016-P1-K1-B1
ccgaagcacacacaggtgttgctcatcacctggccagggcgtaacaaatggatgccagaggctggcctgcagtgggctttgggagctaacagtgattttattctttcttttgtccctagtttcttgttctccgcatcccccgaaatcacatgtttcattgtcgtaggaatagtccgtattatgaatgtacaataacagcataggccgtagggggaatgtagttgtgctgtttcagttcc

SEQ ID NO: 5108 - DNA, 425 bp, Zea mays
  unsure (1)..(425): unsure at all n locations; Clone ID: LIB3279-016-P1-K1-B10
gccatcccaggttgctccggccgcatccccgccgaccgccgaccgccgacgatgcctcccaaggccaagaaggacgctgcgccgtctgagcgccccatccttggacgcttctcctcccacctcaagatcgggatcgttgggttgccaaatgttggcaaatcaacttttttcaacatagtaacgaagttggctatcccagctgagaattttcctttctgtaccatcgaaccaaatgaagcacgggtgaatgttccagatgaacggtttgattggctttgcaaactttacaagccaaagagtgaggtgcctgcatatcttgaagtaactgacatagctgggcttattagaggtgcccatgctggggatggtctgggcaatgcattcctctcacatatacgtgctngtgatggaatctttcatgtcct

SEQ ID NO: 5109 - DNA, 336 bp, Zea mays
  Clone ID: LIB3279-016-P1-K1-B11
gaagaaagcagagagagagagagagggagaacaaggaagaaaaaaaacccagagaggtggagcaagaaccgaggcggatccgccttttgtccctcctgcccgagggctagcctgccgccgccgccgcgagagatcgagaggaggcgctgttcagttcagtcctgtgattccttcctacaggaggggggagaagccggagggggaagagatgatgcgggagacgtacatggacgtgctgccgccggtggaccacatagccgcctcacggagcggcggctggttcccgggcgcggcgcgtctctggacggcggcggagaacaagcagttcgagcgggc

SEQ ID NO: 5110 - DNA, 368 bp, Zea mays
  Clone ID: LIB3279-016-P1-K1-B12
gtaccccgcctcccggttcaaccaaatccctctcgcctcatccccaccagcgcaaagccgccctatcgtcctgtcgtgagaagcaatggcgggccgtggcaaggcgattggcgctggtgccgcgaagaaggcgacgtcaaggagctccaaggctgggctgcagtttcccgtcggcaggatcgctcggttcctcaaggccggcaagtacgccgagcgcgtgggcgccggcgcccctgtctacctcgccgctgtcctcgagtacctcgccgctgaggtcctggagcttgctgggaacgcagcgagggataacaagaagacccgcatcgtgccgcgtcacatccagctcgccgtgcgcaacgacgaggagc

SEQ ID NO: 5111 - DNA, 452 bp, Zea mays
  Clone ID: LIB3279-016-P1-K1-B2
ctcctcctggaactttgcctaatgggactggggctcctggtgctccaccaaggccaccggggcaagctcccccaccacccccgccacaaattccaccgccccctcctgcacctatgggaatgccccctaggattcctccaccacctattggggctgttcaacctccgccacctccagcacgagtggcaaatggtctgcggccaatgattccaccgccacctaacttcactcccggagcacccccaccgcgccctccaatgcaaggctttcctgggcaacagcagtagttgactgcttagcaggcaatgttccagtaattggcagtcagtaaaagtttcaagcttgtgttgactattgtttttcggcttaaaactttgtatgttgtctgggactatactcaaacggcagcttgttggatttttttgtatccacatttattcaagtgccttgtt

SEQ ID NO: 5112 - DNA, 400 bp, Zea mays
  Clone ID: LIB3279-016-P1-K1-B3
cccacgcgtccgcccacgcgtccggaacggcaaggagctcgacggccgtaacatcaccgtgaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtattgggtcaccgttcgcttctgtcaccgggttagtgtccgttctacctttggattaggt

SEQ ID NO: 5113 - DNA, 428 bp, Zea mays
  unsure (1)..(428): unsure at all n locations; Clone ID: LIB3279-016-P1-K1-B5
cggacgcgtgggtcccgaagtacgtcgacacagttactccccagtacaagccaaagtttgatgctgtgattgctgaattaaaggaggctgagaaagagcatcagaaggagtcagaaaggatagagaaggaacttgctgaaatggaggaaatgaggaaaaagatcagtacaatgacagcagatgattactttgagaagtaccctgaactcaggaagaagtttgatgatgaaatccgtaacgataactggggatattgaagagattggagagaactcttatgatgccatttccatgtccgtgaagaaccaataagtttcctgtggcctgaatggggtggtttccatagcatgtgcacggngtttgggtggaatgcctacagatcgactgtgtcaagctttcttgattccgtagaaacatgttttgtttga

SEQ ID NO: 5114 - DNA, 424 bp, Zea mays
  Clone ID: LIB3279-016-P1-K1-B6
ccgagacgcagcgcgaggtgcggccccgtcccctcgccaccggaggagcaggacgacgaggtggcgccggcgcgaggtagtcgcgcgcctggaagagcggcggcatcagagtcgcaggcggaggcgaggaagtgaggggagagccctatagccaccgccgcggggcgtcctgctcgctgcacgcactcccaccattttgtccgaactcgaagctcagactcgtgctgtcgtgcacttcccctcccctagcatcccaagctcctcactgagaaaacaggagatgggaagagacggggaacagactaggcgccggagccgcaagagatcccgcgacgccttccccttctcgtcggattccgattccttcgactccccatcctcttcgagcagtagccctgagcgacggagccggaacagtaagcgg

SEQ ID NO: 5115 - DNA, 449 bp, Zea mays
  Clone ID: LIB3279-016-P1-K1-B7
ctgccttatgatgcagatatggaagttgctggtgcagctgattttctctcgagtgcttggcagtgcaagtgctcatatgaaacacaactgaacgcactgctcaaccaatatggcgtgcgcactgaagcagagcttgtgacagagcatatatggtcgcttcccaagtacagcagcagaaggcagggggacataaaggagaggttgaagaatgcatactatgctcttcacaaggagtttaggagcattttcgaaagcattgtgacagatcaaacagagatctctgatgatgagaaaaatcggttttacgagatgaaggcctccgcttggtaccaggtaacctaccatcctgaatgggtccagaagtcaagggaagtgttcaagtctgactgtgaggacatgccagcaaggcttagctttgcatggatcgcggttgagcacctagcacggat

SEQ ID NO: 5116 - DNA, 449 bp, Zea mays
  Clone ID: LIB3279-016-P1-K1-B8
cggacgcgtgggtgccccccgagctgcagaagctgctcaccttgctgctgcagaagttccagccggagtggcaggcggatgccgccaaggatcaggaagccgcgctgcattccagcgcggcagagtgccaatcgaaccaaaatggagacacgtcagagcaccgagatgctgctaatgcagagcttcagaacggtgcagcacctgttaagggttctctagaatcaggacagaaagaagtgaagaagtctccgttagctaaggattctttggacaaaatgctgaaggacttgttctcaaccagggaccaaatggcaactgatggcaggaacaccggtcacgaactcacgatggggtagctggcagcacttagggcctgtatggctaatccattgctcatcagtaatttggcatatcaatgcttcgttggtttccttcgatctagatcactg

SEQ ID NO: 5117 - DNA, 454 bp, Zea mays
  Clone ID: LIB3279-016-P1-K1-B9
tgcttactcccatttgtacttctgagttctgtcttagttgttcttactggtgtttgaaaccattgcttatgttatacttgagcaggtgtgttcactgagctgattcagcaaatgcaagtgaaaggtgtacaggtggaagagctttactctctcgatgtgggctctcttagtcaactgcggccagtatatgggctaatttttctcttcaagtggatacccggggagaaggatgaacggcctgttgtcagagatcctaacccaaaccttttctttgcgcaccaagtcatcactaatgcatgtgctactcaagctattctctcagttctcatgaatcgccctgaaattgacattggcccagaattatctcaattgaaggaattcacaggagcttttacacctgatctgaagggcttggctattagcaacagcgaatctatccggacatctcataaca

SEQ ID NO: 5118 - DNA, 428 bp, Zea mays
  Clone ID: LIB3279-016-P1-K1-C1
atcgccgtccccgaccgcagcgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgcaagagcctgttgttcctggttcgttcctgagagctagagcaattggccttatgcccatgattga

SEQ ID NO: 5119 - DNA, 410 bp, Zea mays
  unsure (1)..(410): unsure at all n locations; Clone ID: LIB3279-016-P1-K1-C10
atctaccggaggcaagatcataaaaaaactgagtgagttagatgagctgtcccggacaatctttttggtgtgtgaagaggaggcagaacttgcattggttgcagcaaaaagtggcatcaaaacattcagcagtgactggttcatgagctgtgtcatgaaacaggaacttgaccttgaggcccctcagtttattgtatctctatgatgtgcctacagttcaagtcctcctaactcctaatatatctctttctttggttgggatataaattgtttctcctggttcttcgtggatatacaaattttctcatttccttagttacaaaagctgaagtagtgtcaaactagttatcatcctgtgacgatgatgacctgtttaaatggaaaaggntgcggtggagctattccaattt

SEQ ID NO: 5120 - DNA, 427 bp, Zea mays
  Clone ID: LIB3279-016-P1-K1-C11
ggtagaaagatttaccttggaggaaagaacactgtaacggtcagtgctggtgatatccttcagattttcacgcccggtggcggtggctttggctgtccttgatggcacttcctgcagacgcggaccttcctccatttgtttcctacctttgtacaccagtagctctatttagatcgcgattaaaataaaacgtaataaaaccgccaacaactggagattccttatgctattgttgctccccgaggcattggatccgaatgcagcatgaatggtgctattgtttatcagatatcatttatgtgaaaccagcaatcccaaaattggtgatgaatgatgcttgctctttcttcttgttttgatattagtcggaaattgccacgctaatcttttatcgtttatataaacatgccctcgtatgccttctcat

SEQ ID NO: 5121 - DNA, 409 bp, Zea mays
  Clone ID: LIB3279-016-P1-K1-C12
cgcctccatttcgttttcctcactctctcctccagctcagggtccggcggcgaagggaaggcaagatgtacaccgcgaggaagaagatccagaaggagaagggtcttgagccctccgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgcctgcgcaaggccttcaggaagatccatgtcagactcgtcagggagctggagaagaaattcagcggcaaggatgtggtaattgttgctacacggaggattgtgaggccacccaagaagggttcagctgttctgcgccctcg

SEQ ID NO: 5122 - DNA, 378 bp, Zea mays
  Clone ID: LIB3279-016-P1-K1-C2
cccacctctagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggcct

SEQ ID NO: 5123 - DNA, 281 bp, Zea mays
  Clone ID: LIB3279-016-P1-K1-C3
gccttgcagatgagttgatcaacgctgccaagggctcttccaacagctacgccatcaagaagaaggacgagattgagcgtgttgccaaggccaaccgttgagtggagcttgtatcctggtgcacttgcactagaactacgtttctggcagtcgtatttttttcttgtgtttttacccatgtttagactttgagacctatatctaaggttttggttctcagtgaacaatgaaaattactgtgaaatgcagttgttttggtgcagaaatgcgcactgagataa

SEQ ID NO: 5124 - DNA, 330 bp, Zea mays
  Clone ID: LIB3279-016-P1-K1-C4
gtctggaagaatgatgaatcagttccgaagctatggatggagaagcttcggcttagcgcagagacggtgatggagaatgaaaccgacctaaaggggaaaagactgcttagtcctcgacagattactccttagtcaatagtaaatgtcaaggacatgaatgtaattttacccaggctgcgtcctgtgcctataaatagatgaacagtaacacaatattgttcacgctgatttgtaatcactcgcacgtcgctcttggattcttacattttgtcaagccgaaggtacaaatgtaattcaatattattaatgtttgttcatgatcatataatg

SEQ ID NO: 5125 - DNA, 395 bp, Zea mays
  Clone ID: LIB3279-016-P1-K1-C5
ggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccaagcccgcggccgtcatcagcgcgccagctgccgggacgaccaccaaaacaaggacggtcaaggacgcgctgccgcaggaggtgccgtcctcgccgatcctgccaccgtccggttgggccgtcgaggacctgctcgagctgacggactacgaatccagcgacaagaaagactcgtctcttgtgctcaaggagctggagt

SEQ ID NO: 5126 - DNA, 406 bp, Zea mays
  unsure (1)..(406): unsure at all n locations; Clone ID: LIB3279-016-P1-K1-C6
cggacgcgtgggtgtgggttcctccttccagcttgtgtttgcaccaattgatgagcatgggccagatgatgctccattgatggcttatggctttcgtgtcataccacttgatgtgaaaacagatggtgtatcctctggtaggacgctagatttggcatctagtcttgatgtgggctctgctgcaccccaagcctcaggggatgcatctccagatgactgcaatttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgngcataggatgctttctggcttccct

SEQ ID NO: 5127 - DNA, 414 bp, Zea mays
  Clone ID: LIB3279-016-P1-K1-C7
cgtccatcggagttgcacatccatgtgagttggcagaggtgtttgatgtgatgtgggcatttgtgttttatgtaatagatagcatcatcctcgctcgttgtgccgccttcgtccacacaagcgacggagctaaggttacgagaactagcccggtggcaccatgttggtctaccaggatctgctatctgacgacgacctccagtaggactccctcccctacaggcaactcaggaacggcgtcacagacgtcgaggacaagtgcactatcaaatacgcgatctttgccgagtgcatataatcttgccgagagcaaaataaagcaaaaggctatcggtaaggaggcagtattctgagtgtcgtcctctcggcagagatagacacctggtaaccggtggtggcacacggtgtgatcgc

SEQ ID NO: 5128 - DNA, 360 bp, Zea mays
  unsure (1)..(360): unsure at all n locations; Clone ID: LIB3279-016-P1-K1-C8
cggacgcgtgggcggacgcgtgggcggacgcgtgggcggacgcgtgggattcgtgcatgtcatcgaatcattggtttttgtgccgattatgattgggattctcttttttctatttgagttctatgatgatcaattgcttgcgtttcttgttttgactcttgtatggttatgcgagctattcacgatgatcagtgtgcggacatccatatcgatgcagttctttccacgcttcttcttgctgtattttttggttttccatatctacttcttctcatatacctatggcttctcatatctggctttctctgctacggcagcattcatgcagcacctgattntatatttttggaaccgttttga

SEQ ID NO: 5129 - DNA, 332 bp, Zea mays
  Clone ID: LIB3279-016-P1-K1-C9
gtagagtgcgactgaccagcggggccaggtcatggagcaggagtctgagcactcgatcgtccatgtgagcaaggtcagcgggcctgcacctaacaaggtttgcaagatcaatggggcgcgcacctgtatcgtgcgcgtgctcacagtgatctcctataatcagatgtccactttgacgcaggcgaacaaaacgaagaacctgctttcgatcggactcagctgtaagaagaccaagcgccattaccgccactgtgaccaagcagcacgttcttctgaagaccgagcgggactagaagtgcttgaagtactccctcatgtggaagcatgctatc

SEQ ID NO: 5130 - DNA, 442 bp, Zea mays
  unsure (1)..(442): unsure at all n locations; Clone ID: LIB3279-016-P1-K1-D1
ctgagagcgatggcattctctgccctattccacagtacccactgtactctgcatccattgctcttcacggtggttcccttgttccttatttccttaatgaagagacagggtggggactcgatgttgatgagctgaagaaacaactggaggaggctcgatctaagggcatcactgtcagggcgcttgttgtcataaatccaggaaatccaacaggacaggttcttgttgaggaaaaccaaaagaaaattgtcgaattctgcaagaatgaaggacttgttcttctcgcagatgaggtttaccaggaaaatatatatgttgaagataagccattccactcattcaaaaaaattgcacggtcactgggatacactgatgatgatcttnctttggtatcattccagtcagtttctaaggctactacggagaatgtggaaaacgaggc

SEQ ID NO: 5131 - DNA, 402 bp, Zea mays
  Clone ID: LIB3279-016-P1-K1-D10
gccagtttgcgttcgccacccgtccaaaaccccccaaccaaagcccgctccaccatcgcgacaatggcggcgccgcctgtccagcctgtgccaaccgcggcggcggcggctgtgaacggggacgcgttccgtctgggcttcgtcggcgcgggcaacctggccgagagcatcgcccgcggcgtggcggcgtcgggcgtcctcccggcctccgccatccgcaccgcgccccaccgccgccccgagcgcggcgaggccttcgcgtccttcggcgcgtgcttgctccaaaccaatgcccatgttgtggacgacagcgatgtgatcgtcatctccgtgaagcctcagatcgtgaagcaggttctacttcagctgaggccacggctgtcagaaaaaaagcttctcgtg

SEQ ID NO: 5132 - DNA, 400 bp, Zea mays
  Clone ID: LIB3279-016-P1-K1-D12
gcctgagttttgacagattgcagcagaacatcttgttctgctccacttacgtcgagtggaattggttcaccctgtggttgtgtatatcctatgcaaattcagcttgatcttggtgtggcgccgtatcaattgtttccaagaattgatgaattagaaatcgaggtggcagcaggtacattcttgaaacagagtcaagttcggataatgggtgctgggagtagtcttcaagatcctgaaaagacaacagtgtccattgttttggtgccattatggccagaaatttgataggacttcagccttactgattagcaacagatttttgcaaagaaaggtgccaatatactcattcacttattggggattatgtttctacatatgtttattatccaggccttgcttt

SEQ ID NO: 5133 - DNA, 450 bp, Zea mays
  Clone ID: LIB3279-016-P1-K1-D2
ttaaaaggtgatgaagtaactgggaagcaggtcgctgctggaactggtgagtttgaagacctaaaatgtggtctggtcttgaaaagtattggttacaaatccttgcctgtacaaggtttgcctttcgacaaaaacagaggagttgtgccaaatttaagaggaagagtcctgagcagcgaatcagagattgcgacagtagaaagaggcctgtatgtggtaggatggttaaagagaggaccaactgggattgttgcaacaaatctccactgtgctgaagaaacagtaggtggctagcatccttgaagatgataagaagggtgtattaaggcccccatctgattcgacgaagcatggaagggcaggactccttgagatcctagagcgaaagaatgtccgctttgtgccattcagtggctgggagaagataatttcgtggaaaagatgcagggg

SEQ ID NO: 5134 - DNA, 448 bp, Zea mays
  Clone ID: LIB3279-016-P1-K1-D3
cttatttgaatgtccatgaaggtcctcatctaattagcttcagaccttctgctcgaaatgtaccgctgcaagcatcaatgactgtgacagatgagcctggttattatgaagatggggcctttggtataagattggagaatgtacttatttgcaaagacgccaatgctaagtttaattttggagataaaggttatttggcatttgaacatataacatgggctccgtaccagaccaagctgatagacaccgggcttctgacccctgttgagatcgactgggtgaacacgtaccactcagactgccggaagatcttggagcctcatctgaacgagcaggagaagcaatggctgatgaaagctactgagcccgtagctgcaagaggctgagccttttcgtcaacgttgcatgccaccgagcgccaggctcatcttcttgcgtgcatacatat

SEQ ID NO: 5135 - DNA, 441 bp, Zea mays
  Clone ID: LIB3279-016-P1-K1-D4
gttggaaacaagaatctttgccagagtgagacattgcaagatatgggcatggatcaatctggtcaacccactttattctgcgaagcatcaatggcaacactactgagaggacttgcaatagctcccattcagcttagcccgtgtaccaacttctttatttttctggccattgatacagcctgaaggggcagccagcgatgacattgcattgggtattgctgttggtagcacaggaagaggcaaccttcctggttctacatcagatattcgagcagcgcttcttttacttttgattggtaaatgcacagctgatcaggaggcactaaaggaggtagaaggcaatggggttcttcaggggccttctggatgacacagattcaagggtagcatatactattctgctgcttttcttttgaagagaatgatgacagatgaactaga

SEQ ID NO: 5136 - DNA, 429 bp, Zea mays
  Clone ID: LIB3279-016-P1-K1-D5
gccagatcttccgccccgacaacttcgtcttcggccaatccggcgccggcaacaactgggccaagggccactacaccgagggcgccgagctcatcgactccgtgctggacgtcgtgcgcaaggaggccgagaattgcgactgcctccaagggttccaggtctgccactcgctgggaggaggtactggttcaggaatgggcaccctgctcatctctaagatcagggaggagtacccggatcggatgatgttaacattctctgttttcccgtcgcccaaggtttctgatactgttgtggagccctacaacgcaacgctctctgttcaccagctcgttgagaacgcagacgagtgcatggtgctcgacaacgaggctctctatgacatctgctttcgcacgctcaagcttccacaccaacctttggtgatct

SEQ ID NO: 5137 - DNA, 452 bp, Zea mays
  Clone ID: LIB3279-016-P1-K1-D6
ctagaactcattcagtttgatgccatgtttgatccttatgttaaatgtcggtctccaccaaagatacttgtcatcttgaatcctcgatctggacatggtagatctagcaaagtttttcatggaaaagtggaacccatatttaaggtatgtctagctgagtagaagcatgcatcttatctcaagattggatctgtgctgtcgcttctactaggaactttggtatgatctagtcatgcttcccaagatcatatttagtcgggtgtttcatacaacctaagatgtttataaatgagttgtagacaaatttataagctttctagaaattcttggatcacctcttttggatgcctaaatctccagttatggagttttgaagtgagtagtcgaattccgtccaaatttgacagcattatcatttaatactgattgaccttttaagtgtctaatctcat

SEQ ID NO: 5138 - DNA, 336 bp, Zea mays
  Clone ID: LIB3279-016-P1-K1-D7
cggacgcgtgggcggacgcgtgggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcatcaccttctccacggaggaggcgatgccgaacgccatcgagggcatgaacggcaaggagctggacggccgcaacatcaccgtcaacgaggccca

SEQ ID NO: 5139 - DNA, 442 bp, Zea mays
  Clone ID: LIB3279-016-P1-K1-D8
tcggaagcgctggtgtgcctgccacctacaccgaaattcggctggaagaagtgcccgagatgggctatgatccactcggcgtcccttcgcgtggtgaaatctgcatccgggggaaatccctcttcgctgggtactacaaaagtccagaactcacaaacgaagccatcgttgatggatggtttcatacaggtgacattggagagatgaccccagacgggatcttgaaggtgattgacagaaaaaagaacatatttaagctgtcacaaggggagtatgttgcggttgagtacctggagaaagtgtatggcttccctccactcgttgaagatatctgggtatacggggacagtttcagatcaagtttagttgcagtagtcaatccacaccaagaaaacacaatgaagtgggcagagtccaatggctacaggggtttttttgatga

SEQ ID NO: 5140 - DNA, 342 bp, Zea mays
  Clone ID: LIB3279-016-P1-K1-D9
gtgagttgggacttgggagccgacgctgtcggggtgatccagtcgccgccgacgccggcgaacgcgcccgcgcccgagcctccctctacgcggacgcgggaggacccttccactcccagagccgggcgtgtccgatcgtgagtccatggcggaatccatcgtctccggcgccgccgccccgccgccgggcgcgccctcgttctcctacctggccgtgttctccaactgcccgctcgtcgccgcggtgctcgccttcgccatcgcgcagtccatcaaggtcctcaccacctggtataaggagaaccggtgggacgcgaagcagctggtgggctccggcgggat

SEQ ID NO: 5141 - DNA, 456 bp, Zea mays
  Clone ID: LIB3279-016-P1-K1-E1
cggacgcgtgggctcgagccctcgccctctcctcaaacacaagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaaaaaaaacgctcaagctgcaggaagtactgctcattactacgaggatgagactgcttctact

SEQ ID NO: 5142 - DNA, 290 bp, Zea mays
  Clone ID: LIB3279-016-P1-K1-E10
caggttcatcaagaccgccgcctacggccacttcggccgtgacgacgccaacttgacctgggaggtggagaagcccctcaagttcgacaaggcatcggcttaaggttgggagtgttcactgtggacatgaggactaccttcctctggctctgctgttacctgcaagcattgctgctgctggatgtgtgtgcttgatcagtgactgtctgctgctccatagaagatgaacggagagaaggattatgaataagggcttaggcaatcgccgctgcaactgcaacccattccat

SEQ ID NO: 5143 - DNA, 441 bp, Zea mays
  unsure (1)..(441): unsure at all n locations; Clone ID: LIB3279-016-P1-K1-E11
attgtcttcacgttgattcttgtttttgcgtttgctattgttgccctgcacccaaagatcaatggaagcttgttgcctgcatcagttattggtatgtactgtacatatctgtgctacagtggactctccagtgagccaagggattacgaatgcaatgggcttcacaatcactcaaaagctgtgtcaactggtagccttacattgggactccttaccacggtcctctctgtggtctattctgctgtacgcgctggctcctctgcaactgtgctctcgccaccagactcaccacgtgggaccgacaagccattgcttcccttcagcaaggcagacgaacaagaagataagaaggatgtgccgaggccggtgacatactcctactctttctttcacctcatcttctccctggccagcatgtactcngcaatgctcttgactggc

SEQ ID NO: 5144 - DNA, 444 bp, Zea mays
  Clone ID: LIB3279-016-P1-K1-E12
ctggtttcagacgcaaccccgcgggtcgcgggatcaaggagccagagagcgggacgcagcgagcgttccgccggagatcgagaccgtagctagggtttgaggcgccgggctgcggtggacgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccgtgggacggtggcacgttcaagcttaccttgcagtttacagaagattacccagacaagccaccaactgttcgatttgtctctaggatgtttcatccaaatatatatgctgatggaagcatctgtttggatatcctacagaaccagtggagtcctatatatgatgttgctgcaattttaact

SEQ ID NO: 5145 - DNA, 280 bp, Zea mays
  Clone ID: LIB3279-016-P1-K1-E2
gcggctacggcggtggcggtggaggctacggcggtggtcgtggaggctacggcggcggtgggggatacggtggtgcaaaccgcggcggcggctacggcaacaacgacgggaactggaggaactgagcggtggggtccgctgaggcctagttatcttgttcgcttctgctaccgtgttcaccctagtctagagggggtttatcttcgtctgtggtcgtctcgtgtccgtatgtttcgtttcgtgttcgttgttgttgttgcccatctgtgtttttgaccgc

SEQ ID NO: 5146 - DNA, 413 bp, Zea mays
  unsure (1)..(413): unsure at all n locations; Clone ID: LIB3279-016-P1-K1-E3
gcaccaggcgatgcaaaccagtcggttcacattgttgctgatgagggtttggaggcgtatctacctttggctgatatggttgacgtgtctgaagaggttaagcggctctccaagcgcctctccaagatgcagtcggagtatgatgctcttgttgcccgactcaattccccaagttttgttgaaaaggcccctgaagatattgttcgcggagttcgtgaaaaagcgtctgaggcagacgagaagatctctctaactaaaaatcgtctcacttttctgcaatcaaccattaccacttaaatacagtaatccacggngactctaccaggatgccattttgatcgatgacgcaggagaaaactgattgttaatagtttttggttgaaggatatgatagattggcaacgaagttgtgc

SEQ ID NO: 5147 - DNA, 232 bp, Zea mays
  Clone ID: LIB3279-016-P1-K1-E4
ctgcgcctgctttagcaatacctagttttcatcatcacaagttttgtttgtgatcgttgctgttatcgtgtgaactgttgagatctgttagcatgtgcacttttatctatttatttggtaccatcttgctatttcaccttttgcaatacaagaatgctggagtatatgttaaccttttggcattgttaaattgattttaggaagtcgtatagttagttttcttcagtatgtt

SEQ ID NO: 5148 - DNA, 357 bp, Zea mays
  Clone ID: LIB3279-016-P1-K1-E5
atgagattgagaagtctacctccagcatcttcccacttcaaaacgtcttcatccgcaaggtgaagatactcaaggcccccaagtttgatctcgggaagttgatggaggttcatggcgactacaaagaggacgttggtgtgaagcttgagaggcctgtcgagggtgatgaggctatgcaggaggttgctgctgccgagtagtttatttgctacttctttatctagacgaatctggacaggaggtcccttatgacgcgaacttcataaaattgtctggcgacatgttttcttctgtccctgccctaaactctaaacccaaaggttattcgtaacaggtgctttaagattatttttgttt

SEQ ID NO: 5149 - DNA, 364 bp, Zea mays
  Clone ID: LIB3279-016-P1-K1-E6
cgcacgccctgaaggtcggcgtcctcttcacctgcctccacctctgctcgggcttgctcaagacctacgcgtcctccggccgcatcgccgccgcgcggcagctgttcgacgaagcgcctcgccggaacgtcccgctatggaacacgctggtgtccgcctacgcgcgctgcggccacccgcgcagcgcgctggccgccgcgtccgccatggcgcgcggcggcggcggcggcgcgggggcccggccgaacgtcgtcacggtggcgatcctgatgtcggcgtgcgcgaagctgaagaggccggcgcccgggcgggaggtccacgggtacgcggtccggaacgtggccgtgccttgaacttcacgcgc

SEQ ID NO: 5150 - DNA, 424 bp, Zea mays
  Clone ID: LIB3279-016-P1-K1-E7
cggctatcctgcaccaccgccatactaccatggtcagtatccaccatactatccacccccaccaccatacggtggctacatgcctccaccgcgcatgccctacccaccacaatatccaccttaccagccgatgctagctcaaccagcacaggcacaggctagttcatctcggcaaccaccgcatgcaggtggagggcagcagcagccgcctgatggccctccagctcagcagcagccacagcagccaattcagaactgaagtcctgtcaagatgttgggtattggtactgctctaactgctcggcaggagaatgcaacccccgtgggtcaccagctttcgtaatttcttaatttggggttaacaagaaaaactttgttgatttgctatcaacgttggaagaaaaccgtgagatataccggatgt

SEQ ID NO: 5151 - DNA, 349 bp, Zea mays
  unsure (1)..(349): unsure at all n locations; Clone ID: LIB3279-016-P1-K1-E8
cggggctcccatccgcggcctacccgacgccgttcgtcgctccgggtgaggagtcctcccgctacgccatcattgtcggcggagccaacttcgggtgcggttcctctcgcgagcacgcgcccgtcgcgcttggggccgctggcgcacgcgccattgttgcggagggctacgcgcgcatcttttttcgcaactccgtggccactggggaagtgtaccctctggagctcacggacgttggggcctggaaggagtgcaagacaggggatgtggtcaccgtggaccttgctaactccgtttntattaaccacacctctggcaaggagtacaagctgaaaccaattggtgatgc

SEQ ID NO: 5152 - DNA, 371 bp, Zea mays
  Clone ID: LIB3279-016-P1-K1-E9
cccacgcgtccgcacgaaaaccctaaaccctcgctacccggcggcggctacaagctcttcgtcggttcagcaccatgaggccaccggctagaggaggacgtggtgggaggggtggcaggttcgatggcggcggccgtgggggcggcggcggcggccgtgggtttggcggtggtagaggcgggagaggggacaggggagggagaggtggcaggactcccagaggcggccgtggcggcggtggcaggggtggccgcggcggtggcatgaagggcgggagcaaggccgtcgtggtggcgcacaagcacgccggtgtcttcatcttcaagtccaaggaggatgcgctctgcaccaagaacatggtcccgggagag

SEQ ID NO: 5153 - DNA, 436 bp, Zea mays
  unsure (1)..(436): unsure at all n locations; Clone ID: LIB3279-016-P1-K1-F1
aaaatcactttgcgtgcagcatcgattgggtcggaaatcgagggtttggtaagcgagatcgccgccggtgacagctgacagggacgagatggacgccggcggaggcggcgtcttggtcgccgttctctgcatgctgctggtcttcgccatcttccccctcctcctctggcgccgccgctccgatgccgccaccgccgataaccaccgcgtcccgccccagcccctccaggaggatcaggtgctgcacggtcgcgcggcggcgcgacggatgcgtcggaggcctggggctgccggagcaggctcctctactgcgtcaactagccgcaatgctgtagaggacgacgcggagagtgacgatgaggaggtccccgaaggtcgcaacgttcccagatccttcaaaaaggagaagaaaggcangagcgagagatgcaacgtc

SEQ ID NO: 5154 - DNA, 273 bp, Zea mays
  Clone ID: LIB3279-016-P1-K1-F10
ctgacgcgtggtctccgtgacaagcacaccgacgctcgctccgaatgagaggacaggaggaggagcctgcgagcagaggaagcatctgctatggaggcgcggaggacggacagagatctatctggagagcttaacgctcgcggaatgggccgctcacgcattcgaggccggcgtctaatccagggacagcctctcggctaaggctagtcatggcgactacgtgaagaagccggactgcgtgccagggatggacccacgctcgttcccgatgat

SEQ ID NO: 5155 - DNA, 452 bp, Zea mays
  Clone ID: LIB3279-016-P1-K1-F11
agaacattgctgtcattgttggcacagtcacagatgacaaaaggatccaggaggttccagcaatgaaggttactgccctgaggttcacggagacagcaagggccaggattgtcaatgctggtggcgagtgcctcacatttgaccagcttgctcttcgtgctccacttggcgagaacacggtcctcttgaggggccccaagaatgcccgtgaggcagtgaggcactttggcaaggctcctggagtgccgcacagccacaccaagccgtatgtgcgctccaagggaaggaagttcgagaaggctcgtggcaggaggaacagccgtggattcaaggtttaaaacaaattgtggccctccgtgttgccatcagcatagtgcaaccgttgtgtttgatcagtcgacagtaattagtcatcactctgtaccgagattagtagcacaatttgttgtcct

SEQ ID NO: 5156 - DNA, 426 bp, Zea mays
  Clone ID: LIB3279-016-P1-K1-F12
ctaatcaaaggttcaaaggatttacaaaatgaagacatgtttctagtctagataccatgcagttcgtctgtgacaccaaagagaccataaattacaaggtggccgtttttaacatcgggaccaaggaaccaggcttctgggaaccgcagattcacaaaagataaaacaccgtgcatcaagcgatacaaacacacagaaagcctacttcgctgttctagagtgcttgataagccagtcgatgacgacgtctatgttcacagaatccttacacgagatcatgtagcaacaaacctcacggtcctttatcaattccagtccaagttgatcaaccaaggcctgcttcgaaagcgcttctgacttgtcaattttgttgccaaggacaagcaagggaatcccagccaaagactgtttcgtcagcagatcatg

SEQ ID NO: 5157 - DNA, 393 bp, Zea mays
  unsure (1)..(393): unsure at all n locations; Clone ID: LIB3279-016-P1-K1-F2
gccgccgcagactcctccttttcgatcccttcgcaaagcgccgccgtcgccccatccggcatggctccgaagaaggataaggccccgcccccgtcgtcgaagcccgccaagtccggcggtggcaagcagaagaagaagaagtggagcaagggaaagctaaaggagaaggtgaacaacgcggtgctgttcgaccaggctacctacgacaagctgctctctgaggtgcccaagtacaagcagatcaccccctccatcctatccgagcgcctcaggatcaatggctccctggctcggagggctatcaaggacctgatggcgcgtggcctcatccggttggtctcggttcactcaagccagcagatctacaccagggcaacanatacctaaggatgg

SEQ ID NO: 5158 - DNA, 377 bp, Zea mays
  Clone ID: LIB3279-016-P1-K1-F3
ctctctcctgatctagcacacttggatgagataaagaacttgcagcgtccaactgatgtaccagatcaaggtctactgtgtgacttgctttggtcagatccaggaaaagatgctcaagggtggggcatgaatgatagaggggtctcatatacctttggtgctgacaaggtttcagaattcttgcaaaagcatgatcttgatcttatctgtcgtgctcaccaggttgtcgaggatgggtatgaattttttgctgacagacagcttgtcaccatattctcggcccccaattattgtggtgaatttgataatgctggtgcaatgatgagtgtcgatgaaactttgatgtgctcattccaaattctgaaacctgctgagag

SEQ ID NO: 5159 - DNA, 389 bp, Zea mays
  Clone ID: LIB3279-016-P1-K1-F4
cgcaggagaggtcgaaaccctagcttttgcggcggcggcggcggagagaagatgatctacgacgtgaactcccccctcttccgttccttcctcagccagaagggcggcgccgacaagaggaaaatggaggagcataaaccaaaggagcagaggcccaaggccaacgagaacaagcctgtgatgaacgaatgagtatctccagaagctttgttcaatgtgcaaccaagtccgatgtccgtttgctctggttagcttaaaaccaacgcttccaataatcctattggtgtcttagtttccccttatagtgttatttgctcggcttgaacatggcaaacggaaatgaaacttgaactacctatggtactgtcatcaatttgagacccccatga

SEQ ID NO: 5160 - DNA, 459 bp, Zea mays
  Clone ID: LIB3279-016-P1-K1-F5
aaattgtgaaggttagaactagttgtgagatattggaggaaaccaatgagagttagttgtgctcattgtcgttgatactgaaacaaagctgaatgcttcaatctagcttgcatgattgcattatatataagcaataagtgttgtgattcttcggttgttccatgatttgttggtagagttcaagaagacatgtttctgcttcgtatttagtttcttgaggaaaaaggcagctcggatcaaattatcggatttgaaaagtaaatttgtagtcaaatcaccatgtagctagtatataatgcaaagtataaattaattaataaaaatactttgcattcatgttgagttttgtttgttgcaatttatgcttgaaatagaaaatttaactcatctctaaattagacttgaattttcaatttaaaatagaaagcaaaaaaatagaaatataagctaatataatag

SEQ ID NO: 5161 - DNA, 443 bp, Zea mays
  Clone ID: LIB3279-016-P1-K1-F6
gctttgttttatttttgtggaggagagaaccccgtgttttgcgtggagaagaaggcaagccgctcgacgctcgtcgatgtgcggagcgatgcacaaaaccgaatcgccatcgtcctcacaaacaccgtttggttttgtttatggaccgagagatgctgatcgtgcaagtgatgtggtgccaaccaccagatgcagttggtggacgtactgaaggatggtggacttaaccagtggatgctcgccaagcgagtacctcccccagcaaacactacctaagtgttaaattaaaggtacctccttgctttagttgatggtgtgacttggcctccatccctgccaccgggatagatggtcgagtgggttactgcttccgcaggagaggaccaggaggagtagcgtggccaggcttcgccatgttactcggttttctccgttagttattt

SEQ ID NO: 5162 - DNA, 400 bp, Zea mays
  unsure (1)..(400): unsure at all n locations; Clone ID: LIB3279-016-P1-K1-F7
ctgaaagataaagcaggttcttctagtgatggattctatgagtccagaaaagaatgggcggggagaagacactttctgctagctttcgaaggttcagctgaaggattgtacatagtaattcggccagctgttggggaggcttcgagggaaatgtctttggttgagcttaaaagcaagtacaggaaggtctcatctgttgacaaaattagtaaaggctggcaagaagagtacgactcttcatccaagcagtgtatgcacgggccaaaatgcaaactcggaagcaattgcacagtgggtagaaggttgcaggagattaatatattgggtggtctaatacttnctgtatggngtgcagtagcaaaggcactggctaagcaggcacggcagattcacaggagaa

SEQ ID NO: 5163 - DNA, 319 bp, Zea mays
  unsure (1)..(319): unsure at all n locations; Clone ID: LIB3279-016-P1-K1-F8
ggaagccgctgcataggtgtatcaagtggttgatttcgtctcagttgattcctgcctggtcgtaggcctataattgtgttcttcgctatggtcttgctgatttcgtctagttctggttgtgtgtgcttgcttttctgtagccctcatagttgtgacgagcttaataaatgtctgtgtgctccagttgtggtagttgacaatagagttctttccttgtatctgtgtctagccaatagttttggatggttgttgactctccttttgtggtgattgttaagccatatatcgaactctnttacctaaaaagaaaaaaatatat

SEQ ID NO: 5164 - DNA, 398 bp, Zea mays
  Clone ID: LIB3279-016-P1-K1-F9
ccaccacggcctcgaggacttcatgatgcgcttcatacagctccacgcgacgcacgtcaaggaggccgtctccggcatgtcgtccccggtcgccgcggtcgtggtggactacttctgcaccaccctgttcgacgtcgcgcgcgagctcgcgctgccggcgtacgcctacatgccgtccggcgcgtcgatggtcgcgctcatgctgcggttaccggcgctggacggggaggtgtccggggacttcgaggcgatggaaggaacggtcgatctaccagggatgccgccggtgccggctcgtctcatgccgtctccgctgatgaggaaagacccgaacttcgcgtggctggtgtaccatggcaaccgcttcatggaagcccgacggcgtcatcgtcaacacg

SEQ ID NO: 5165 - DNA, 281 bp, Zea mays
  Clone ID: LIB3279-016-P1-K1-G1
gcggctacggcggtggcggtggaggctacggcggtggtcgtggaggctacggcggcggtgggggatactgtggtgcaaaccgcggcggcggcatactgcaacaacgacgggaactggaggaactgagcggtggggtccgctgaggcctagttatcttgttcgattctgctaccgcgttcaccctagtctggagggggtttatcttcatctgcggtcgtctcgtgtccggatgtatcgattcgcgttcgttgatgttgatgcccatctgtgtttttgaccgc

SEQ ID NO: 5166 - DNA, 448 bp, Zea mays
  unsure (1)..(448): unsure at all n locations; Clone ID: LIB3279-016-P1-K1-G10
caacctacccctgcaagccattgccctcgcctatcgcctcgtgcaagtccaagctcccacgactccaccgcgaccgggagagagtcagagagagacgcccgcctccagatcgtccggcggggatggcggcgtcggtctttccagcgctgctgctggccgtagcggcggtgcttctcctaccggtggcagaggccgtgtggctcgagctcccgccgtcggggaccaagtgcgtctccgaggagatccagcccaacgtcgtagtgctcgccgactacgctatcatgtacgagtcccaccccagctcgcatcccaccgtcgccgtcaaggttacatcaccctatggcaatactgtgcatcataatgaaaatgctacaacgggccagtttgcattcaccacttcagaagctggaaactaccttgcatgtntctggatagacagcgtggagaa

SEQ ID NO: 5167 - DNA, 449 bp, Zea mays
  Clone ID: LIB3279-016-P1-K1-G11
aaaatttgtgcttgggcgtatccgtcaatacacgcaccgagaggaggaagcccactacgcccgtctctctctctctctcctccctggctctcgtcttcctctcctcccccaccgagttgccgccccctcgctttcaccccacgcggaagcaagaattcgtcgtcaaattcccaccttgcgcgtgtttctgtggatttccttttttttggccgcttccttgctcctatgggcctttgatccggggcttggatcttgggaaggggaggtgtggtgggccgccgccggcgatctggcggggaggatatggccggcgggaaggagccgatcgaggtcaggttccggctcttcgacggcacggacatcgggcccaccaagtacgatccctccaccacggtctcctcgctcaaggagttcatcctcgctcggtggccgcaagataaggatataac

SEQ ID NO: 5168 - DNA, 458 bp, Zea mays
  Clone ID: LIB3279-016-P1-K1-G12
gcagtccctgcgcggcatgatcattcgtcacccggacatgttttacgtatcgttcaaaggggatagggactcggtcttcctccgtgaggcgtacaaggactcgcagctggtcgagaagaaccagctggtgctacttaaggagaaaatgagggctcttgtggccgtaccacgcttccccagaagggccgcagttgggactggcgaggaggctgagggaatgaatggatcattgcagtcgcgggaccaagtgagtgacgaggaatacgacgatgaagatgaggggctctctgatatggaagatctgattagtgagctttctggtggcaaatcggatgctgactacgagtggggtgatggctggtttggtgagaacgatgactcaccgccagactttggagacgacgaagtcaaggtcgccatgaaaattgctgatggttctgccaacggcagcgcacctg

SEQ ID NO: 5169 - DNA, 384 bp, Zea mays
  Clone ID: LIB3279-016-P1-K1-G2
ttttattgactgaataaaggaacctgattcagctaatgaggttgtccatactgctctactagcagggttttgttatattgcttgtcataccatgtggatctcccccatttgtgaggttcttgtcctcgtatgatgaaatttgctgcagctttagagcctgtttggttcgtggctaactgtgcacactttgcttaagtttagtcgtttaaattgaagaactaaccttagacagaaaagttagacaaagtgtgacaatttatgcagagaaccaaacatacctttagtattccttagtctggcactctggccttatgtgcattcagcattgttggttgttctatatacccttaacacttgatgcaccaagagatgtttaaaatggat

SEQ ID NO: 5170 - DNA, 362 bp, Zea mays
  Clone ID: LIB3279-016-P1-K1-G3
cccacgcgtccggttgtctccagtttccatgcagagcagaaaagatcagctagcgagagaagcaatggcgtcggctcctgcgttctgcgtcgcgctgctgctgctgctggcttccgccgctgccgtccaagcggtgccgccccaggccggcacgtcgtccacctgcagcactgacctcctccgcctcctcccctgcctgcccttcatcgagggcaccgccaccgtgccggcggacacctgttgcgccaacctgggcagcatggtgcacgacgagccgcagtgcctctgccaggctctcagcaaccccagcacggcccccgtcgccgtcaacatgacgcgcgtgatggccatgcctcggctct

SEQ ID NO: 5171 - DNA, 421 bp, Zea mays
  Clone ID: LIB3279-016-P1-K1-G4
cccacgcgtccgccaagccaaccagccagtcagaagaggaaccggggagcggcagctgcagcggccgagggcggagcacgcgaggcatggatagataccaaagggtagagaagcctcggaatgacacgccaatcagccagaatgagatcagaatcactactcaggggaggatgaggaactatatcagctatgggatgtcgctgcttgaggaaaatggacatgatgagattagtatcaaggccatgggacgggccataaataagacagttatggttgttgaattgatcaagagaagggttggaggtcttcatcagaacactgctactgaatctgttgatatcacagacacatgggaacctttggaagaaggccttctcccactagagacaactcgccatgtgtcgatgatcactgtgacact

SEQ ID NO: 5172 - DNA, 433 bp, Zea mays
  Clone ID: LIB3279-016-P1-K1-G5
cccacgcgtccgacgcagcccaacccgttcccaccaaaccagcggcaccacccatggcttcggcggcggcgagatccggtctccggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccctatcttcacatccgcaacaaggagttcccatggggccctgatggcttgtttgagacgaaggaccaccactgagccctgattagcacaccttcaggagctggtgcacgcttaaaagagttatatggttgtttcagtgattttccttttccctgagacctatttgctgc

SEQ ID NO: 5173 - DNA, 438 bp, Zea mays
  Clone ID: LIB3279-016-P1-K1-G6
cattcccagaaaaaaaaaatgatggtgacccgttcgcgtcggctcgccccgccaccatgacccataagcgccacgccgccaccggcttgcgcacgggcggcaccatactgcacgcgctctccgccgcctcggccgcccacctgcacgcgcacgccctgaaggtcggcgtcctcttcacctgcctccacctctgctcgggcttgctcaaaacctacgcgtcctccggccgcatcgccgccgcgcggcagctgttcgacgaagcgcctcgccggaacgtcccgctatggaacacgctggtgtccgcctacgcgcgctgcggccacccgcgcagcgcgctggccgccgcgtccgccatggcgcgcggcggcggcggcggcacggtggccccggcgaacgtcgtcacggtggctatcctgatgtcggcgagcgcgaagctga

SEQ ID NO: 5174 - DNA, 189 bp, Zea mays
  Clone ID: LIB3279-016-P1-K1-G7
catacccataaaaaaaaaatgatggtgacccgatcgagtcagctcgccccgccaccgggacccataagcgccactccaccacctgcttgctcacggtccgcaccatactgtacgcgctctacgtctcctcgatcaaccaccttcacacccacgccattaatgattgcaagctgtatcacctgtctccac

SEQ ID NO: 5175 - DNA, 364 bp, Zea mays
  Clone ID: LIB3279-016-P1-K1-G8
ggagattattataacagagggcgcgggagagggcggctacgtggacgaggtgggagagggcgtggtggctactacggaggtgggaggcgtggtggctacggttatgattatggctatgcccccagaggcgggtactatgaagagcaagacgaatactatgatgagcccgaggaatatgctcctccccctggccgcggacgtggcagagggagaaggggcggcatgccttggcgtgggcgtggaggccgcgggccaccgcgcggtggccgagggagctactactaggcgcgagaaatgcgacgtgccgaatgcgtgtgcttattagttatctgttagcgtttgctgcagtgctcttctatggagc

SEQ ID NO: 5176 - DNA, 442 bp, Zea mays
  unsure (1)..(442): unsure at all n locations; Clone ID: LIB3279-016-P1-K1-G9
aaaaaaaaaagcaaatttgccgtctgcaaaacccctcccacagccgtcgccgcccgccagcccgcctgcgagagaagtccgcttcatccgttcgccgcctcaaggacgagatggacacatcaagccctgcagcacttgtcaatgcacagatgctgaacatgtttgttgggcgaagagtgcgcacggttgttcaagtccaacacaatgaaggtggagtgcttgtcgggcagtccaccgatgggcaccagttgtgtgtcaaaagtgccatggacgtccccgtatcacattttatggaggtttatggaattgctgaaaacagccagaccatccgtgctgaagtttgcacagatnttggtcccaactttgatcccaagggttttgatgagttgtgcaagctggcgagtggcaggttcaagcaccctgttctgtagagataatcatc

SEQ ID NO: 5177 - DNA, 436 bp, Zea mays
  Clone ID: LIB3279-016-P1-K1-H1
cgaaagccccccaaaccctcgcaccctaaaacagcggcgcacaagatgtccgacgaccccaccaacggcggcggcggtgatcgcgtggaggacgtcgtccgcaccgagggtgaaacacaacctcgtgatgatggcttgtcgaaatccaaggatagggacaaagatagagaaaaggacaaggacagagatcgtcgcagagaccgtgacagagatcgagggagagacagggaccgtgatagggacagggacagggatcgggacagagacaaggatcgccaaagtaggcatcaccgtgaaagacgggaacagcgagaccgtcctgatgatcacagagtccgtgattctgaaagaagaagagaacgcgacaaagatgggcatcgtaggcatcgttctcggtctcgttcaggggtagagatcggagatctaggtcacgttc

SEQ ID NO: 5178 - DNA, 462 bp, Zea mays
  Clone ID: LIB3279-016-P1-K1-H10
gaagatggatggacgactgtcactgctgatggtagctgggctgcgcagtttgagcataccatactggtgactagggacggtgcagaaatactgacgaaagtctgagctattctcctgcccgataattattgtcagaattctcagctatggttcctgtcccaaggcatcctggtcatgtccgttgctcgccgcaatactcatttcagagttttgagatctgctgcaggccgacatacgggaaaggtttcccccatgtagcagcaacttgcaggtgataggtgagggcacacacacacacagagacacggctgcatctctgtgattaacacattactggtctcctgcagcctgctgtagtggtgttgctgtgcctttggattctagaagacattctgtatataaaacagcactcctaacagttcagtctagaacctagaagtagaaactgtttttgtatgatcc

SEQ ID NO: 5179 - DNA, 338 bp, Zea mays
  Clone ID: LIB3279-016-P1-K1-H11
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtc

SEQ ID NO: 5180 - DNA, 245 bp, Zea mays
  Clone ID: LIB3279-016-P1-K1-H12
gctacacctacgatgaatacatatgggctgctgtttcactctacctcgacgtcatcaacctgttcctgtctctgctgcagctgctgagggcagccgatagctgagctcgtcaagctttcacttggatcttgttctcacatacatttgtgtatatcacaaactctgtaatggtcatggatactccaatttataactatactctgtcggtgttaccttggttcaaatggtatgtctggctttaacgg

SEQ ID NO: 5181 - DNA, 339 bp, Zea mays
  Clone ID: LIB3279-016-P1-K1-H2
ggacactgagaagccaaggatgaggggtcccaagagggcctccaagatcagaaagctgttcaaccttaacaaggatgatgatgtacgcaagtacgtgaacacataccgcaggacattcactaccaagaacggcaagaaggtcagcaaggcacctaagatccaacggcttgtgacacccttgaccctccagaggaagcgtgctagaatcgctgacaagaagaagaggataactaagaagaagtctgaggctgctgagtaccagaagcttcttgcccagaggctgaaagaacagagggaccgccggagcgagagcttggccaagaggagatccaagctttc

SEQ ID NO: 5182 - DNA, 398 bp, Zea mays
  Clone ID: LIB3279-016-P1-K1-H3
gctgctccttcccctcatcgccataccgctcatcgtcttcctcgtcctgtcccgccgaagggatgaccagcggcgcttcccaccggcgccgtgggcgctgccggtcatcggccacctgcaccacctcgccggcgcgccaccgcaccgtgccctgcgggaccttgcgaggcgccacggcccgctcatgacgctccgcttctgcgagctccgggtcgtggtcgcctcgtcgccggacgccgcgcgggagatcttgaggacccacgacgtggacttcgcgtcgcggcccatcgggccgatgctgcagctcgtgttccggggcgccgagggcctcatcttcgcgccctacggcgacgggtggcggcagctccgcaagatctgcaccctcgaactcctcagcg

SEQ ID NO: 5183 - DNA, 456 bp, Zea mays
  unsure (1)..(456): unsure at all n locations; Clone ID: LIB3279-016-P1-K1-H4
cctcacgccgccgccgccgccgccgccgccgtcgccgccaccacatccgtagcgcccagccgccggagaagaggagggagccagcaccagccaccatgggtcgcgtccgcaccaagaccgtgaagaagacctccaggcaggtgatcgagaagtactactcccgcatgaccctcgacttccacaccaacaagaaggtgctggaagaggtctcgatcctcccctcgaagcgcctccgtaacaaggttgccggcttcaccacccacctgatgcgccgcatccagcggggcccagtccgtggcatctcgctcaagctgcaggaggaggagcgggagcgccggatggacttcgtcccggagaagtcagcgctcgaggtcgaagagatccgcgtcgacaaggagaccatggagatgctcgcggcactcggcatggccgatctnccggcgtagagcgcaagct

SEQ ID NO: 5184 - DNA, 466 bp, Zea mays
  Clone ID: LIB3279-016-P1-K1-H5
caaagcctcaacaaagctgatggactggacatatgtggcaaagtggttgtaccaagcacgagaggcttgtttgagaccatagtgggactttgtgagccgacaaacttagtcgaggtgagctggatcaacgaaacctgatggttgggagcagtacattgtctcagatacggtgccatgaagaatggcattcttcacatcaagtggatgaatgggccagtcttgtgagtgagccaatgagagtactgtgcgaattgtagctgacatcaccactaggctgactgtttcttcctccacgttgctgcataagcatcgtttcatcaggccttgtgacacgatttcacgatgaccttggagagtgagggtatttgctgggaatctctgttcaacaccagtctaagggtttacttttgccacaacgtctctatgcggacgccatacttcaccaggctagtataacaatgtgcaa

SEQ ID NO: 5185 - DNA, 407 bp, Zea mays
  Clone ID: LIB3279-016-P1-K1-H6
gcctccgctcaccttgcctcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagagaaagggctcgttcctcgacaagggcgaggtcgctgaccgtgtcgtctccgtcgtcaagaacttccagaaggtcgaaccctcaaaggtgacacctagtgctcattttcagaaggaccttggacttgatagcttggacactgtggagatcgtgatggcgtttgaggaagaattttcctttgagattcctgacaacgaagcagagaagattgactccatcaagacagcggttgatttca

SEQ ID NO: 5186 - DNA, 394 bp, Zea mays
  Clone ID: LIB3279-016-P1-K1-H7
gcgccgtggtgtggagcaaggggggattcgccttcaccgtcgatcgccgcgtgcgcctgtcggcatatccgccactacactagacgagcaaactactgtggatcatgaggcccagcagatagaagtagctgagcaggagctcattgaaggttgtccctattgcaactattgctcaggagaagatgaaggaaatgcgaaggatttctagaagttttaggactttgaggagttctaatctagactagcggcgaccgccagtcgactgcctatgaaagccttttcttgctgtgtttcgttaagcacttcgatttatatttaagttaatgactatatggatgtcttgggcatcatgatgtaataaagttatacttattttcactattatttgagcaaa

SEQ ID NO: 5187 - DNA, 447 bp, Zea mays
  Clone ID: LIB3279-016-P1-K1-H8
ctcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgccctcggtgtgctctccatggccaacgccgggcccaacaccaacggctcccagttcttcatctgcaccgtcgcgaccccttggctcgacggaagcacg

SEQ ID NO: 5188 - DNA, 393 bp, Zea mays
  Clone ID: LIB3279-016-P1-K1-H9
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggctgctggtactgtggtggccgtggaggc

SEQ ID NO: 5189 - DNA, 408 bp, Zea mays
  Clone ID: LIB3279-017-P1-K1-A1
gcgcctcaacccttcctctcgggcggcggcgccggcaaggcggcagccaaccggagcgggagctgcgatgaagaagatcttcggcgccaagaaggacaaggggccgcccccctccatccaggacgccaccgagcgaataaacaagcggggtgagacggtggacgagaagatcaagaagctggacgaggagctagccaggtacaaggagcagatccgcatgacccgccccggcccgtcccatgaagccatcaaggcacgcgccatccgactcctcaagcacaagcgcatgtacgaggagcaacgcaacatgttgtacaaccaaacctacaatctcgaccaagttggctttgctgccgatggcctcaaggatgctcagcagactatgaatgctttgcttgccgcaaacaa

SEQ ID NO: 5190 - DNA, 432 bp, Zea mays
  Clone ID: LIB3279-017-P1-K1-A10
gtggactccatacgaccatgcctacccccatcctcctccttcgccatcgacgaagctgaagcccaatccatcatgcgaggcgacaaccttggccacttgctgctccactcactcttgcgtcgcgtggacacgatcgagtacacccttccctgccggttccggtcctcacctccggcttgccgaacggtacgcttgaactcacgcgcgcgtcgcatggtaagctaccatgagcaagaggtggacgacgacgaattggagacagaatactcgccctcccctcagttgtcatggccatggcgatcagcgcacacgtgtttggttttgttttattttccttaaatttggtgtggttgccaagagaaaataggagaagataaaaaggtaccaaccattaaagtgcttgaagatagcttctcatctttgacttgcttc

SEQ ID NO: 5191 - DNA, 265 bp, Zea mays
  unsure (1)..(265): unsure at all n locations; Clone ID: LIB3279-017-P1-K1-A11
gtttactccatacgacctttcctaccctttttttaatcttacaccanccaccaggcgggagcctttaacagtgatgcgaggacccaaccttccccactcaacaatccaatcaaactttcatctcccggacacaacctataacacccatcaatgccggctaattcaatgacctacggcaagccgaactctacccttgaactaacacacgcgtaccaagaaacactaccaagaccaagaagtgaacgacgcccattaccacacaaaa

SEQ ID NO: 5192 - DNA, 251 bp, Zea mays
  Clone ID: LIB3279-017-P1-K1-A12
agcctaattgactcaatccgcagatgatggtatggctcgcttctacctagtggtttttgccaaattgatcgtttacggtattcatccccaatgtacaaactaccttatttgttcattactgtcgccgagcaccgactgtttgtacttcgttcgctccgaggaataagaataaagcactgctagacttcccattgcgaagctgaataaatattgtaaagccatttgtcgtgctgaacttcccgttccgttcc

SEQ ID NO: 5193 - DNA, 390 bp, Zea mays
  Clone ID: LIB3279-017-P1-K1-A2
cactcacgtaccggtccttacttgctcgacccacgcgtgcggcggatggagtcggagggaaccgaaaactcagggtctcgaatttcctaggagcggaggcgatggctgggaagggaggaaaaggattgctccgccccaaaaccaccggcggccaatccggcggaaaaggccaggggaaaaaaggccccattttaaggtccttccgcgcgggccttcaattttctgttggaccaatccaccgtcagctgaagcaaaggactcaagccaatggccgcgttggtgccactgcagccgtctactctgtcgccattctggagtacttgactgccgatgtttttgagctggccaggaacgctatcaaggatctgtaagtgaagcgcatcacccctc

SEQ ID NO: 5194 - DNA, 374 bp, Zea mays
  Clone ID: LIB3279-017-P1-K1-A3
acaggatgtgctggccaccctgttgaataatttgaaggtgcaggagcggcagaaccgtgtctgcacaactgtagcaattgccatagttgctgaaacttgctcacctttcacagttttacctgcccttatgaatgagtaccgggtcccagagctcaatgtccaaaatggtgttctgaagtcactctctttcctctttgagtatattggtgagatgggtaaagattacatatatgctgtcactcccttacttgaagatgctttaatggatagagatctggttcaccggcagactgctgcatctgctgttaagcacatggctctaggtgttgctggcttgggttgtgaggatgctcttgttcatctgcttaactatg

SEQ ID NO: 5195 - DNA, 256 bp, Zea mays
  Clone ID: LIB3279-017-P1-K1-A4
atctcatgttccggtcgacccatgagcttggacggaagccaccacaggtgcattaacgggatatatcgcgtgtgcatgactgatcgactctcctacacctctttcgcactctgttctttacttcctgagaactcatggagctcaattgacatagcctacagatcgaggtcgtagtactggtctcggtcgagcagtgtgtgctctgacaatcgtcgtcatggcggctgatgacatacgctcgtgtctgtgtataggc

SEQ ID NO: 5196 - DNA, 347 bp, Zea mays
  Clone ID: LIB3279-017-P1-K1-A5
ctccccactccctctcgtcgccgtcctctcccgttcgcaacgccacgctccccaccgccgaaatggccccgaagcgaggtggcagggcaccggtgccggccaagaagaagacggataaagtgacgaaccctctgttcgagaaaaggccgaagcagttcggcatcggcggcgcgttgcctcccaagaaggacctgcaccgattcgtcaagtggcccaaggtcgtgcgcatccagcgccagcgtcgcatcctcaagcagcgcctcaaggtgcctccggcgctcaaccagttcacccgcaccctcgacaagaacctcgctaccaacctgttcaagatgcttcttaagtac

SEQ ID NO: 5197 - DNA, 424 bp, Zea mays
  Clone ID: LIB3279-017-P1-K1-A6
ctttccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaagggctcctatgta

SEQ ID NO: 5198 - DNA, 389 bp, Zea mays
  Clone ID: LIB3279-017-P1-K1-A7
ctgaattctgcactcacacaatcgatgtgtgggaacttgaaggatttcttcaccgttggaattggttgggtactatttggtggacttccttttgatcttcttaatgttataggacagggactaggctttctgggctctggattgtatgcctactgcaagatcaaaggaaagtagatgctgatgtctagcggtatcaactggtggtagacggtggtgtgacttggtgtttcattcatggccagtgtgcttaacaaaagtggcgttgtttatcctgtttgctcctacatatgggagagaaattttgtaggtttcctgtatgtattagacttcagccctaatgaacactgcaaaactgaaaaggaaatagagtataccgaatttttactggt

SEQ ID NO: 5199 - DNA, 400 bp, Zea mays
  unsure (1)..(400): unsure at all n locations; Clone ID: LIB3279-017-P1-K1-A8
agatgagaaaggccctattattcaagcagacttgcaaaggtggtttggtgatgattgggataaaaaagctcatgtaaaagtctctaccgatgggtgcaccaatgactttttaatggttggtctttccacaaaggacatgtcagtgatcaaagccgattcaatagatgttttatgtgattatatcatggcaatagaagacgatacgacactagagtaagtgctcattgatttatctattttatgtgtatcaactacttagattcttgatatagactttttgccatgctacattacacgatgacatgggtgtgtagtttcaatccttttaagatagaaatatctgtcaaagatctgcanaaaatattaaagataaatcaagatattattctaagatgttttg

SEQ ID NO: 5200 - DNA, 399 bp, Zea mays
  Clone ID: LIB3279-017-P1-K1-A9
caaggaaggagatcccttgaaaccagctgtgacgggcgtcttagtgttcgtttccactccagatccaattggcaacaagtactatcttggccctgctcctctgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgctttcctgaaatcacatgcccctcttgtgcacctgtccgcgcttccagaaagcaccgttgtggactcgagatagcgagagccttggacgttggacctctactcggaatttac

SEQ ID NO: 5201 - DNA, 257 bp, Zea mays
  Clone ID: LIB3279-017-P1-K1-B1
atcttctttctccttgggggggggggggggggggggtacaaagagatcaaaagaagcgttggtggcgatgcttttctaatgaactatcatggcatggttgccaaggcacgttgtttgaaaggccgacaaggcgacaacgcttttatcgagttaaatatccagcatgggtcgcttcaaaccaaccaacaaatcaatcataggaaacaattaaccaataagcaacagcaaattggctactgcagctagatgcatccacc

SEQ ID NO: 5202 - DNA, 372 bp, Zea mays
  Clone ID: LIB3279-017-P1-K1-B10
tttttttttttttttttttttttttttttttttttttttttttttttttttttttttttttttttttttttttttttttttttttttttttttttttttttaaaaaaaaaaaaaaaaaaaaaaaatctttttttttacaagaaaaaaaaaaaaaaaactcttaaaagggttttttttttaaggaaaggaaaaaaaaaaaaaagggtaaaaaaaaaaaacccaatttttttttataaaaaaaaaaaatattggaaaagggaaggaattgggggggggggaggtccctaaaaaaaaaataattttaaaatgggggggggccctttaaaaaaaaacaaattataatgctggaggacaaattaaattttttttatt

SEQ ID NO: 5203 - DNA, 234 bp, Zea mays
  Clone ID: LIB3279-017-P1-K1-B11
caaaatcatgcagctctttctactgggtgataaacgttctacaggttccagttgcgggaagtgtgttcttgtgggaggccatgcagttatgtagggagagtcatgcacgacgtatgaatgggaacctggaatgtgtgtgctttgatgcctatcattgttgactgttgttgaatgacatgtttgaaggtggataggtcagatcacagaatgtttctcatgaaagtttgttcaagg

SEQ ID NO: 5204 - DNA, 367 bp, Zea mays
  Clone ID: LIB3279-017-P1-K1-B2
ctccaccctccagcgcctccaccctcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaagctcgagtcctactggccggcgcttttcgctaagctcctggagaagcgcagcgttgaggatctaatcctctccgttggatctggtggtggcgctgctccaggtgctgcttccgccccagctgggggtgctgcagctgctgctgcccctgctgcagaggagaagaaggaa

SEQ ID NO: 5205 - DNA, 432 bp, Zea mays
  Clone ID: LIB3279-017-P1-K1-B3
ctgactgtctccctccgtccctcgaagcttctctggtttcagacgcaaccccgcgggtcgcgggatcaaggagccagagagcgggacgcagcgagcgttccgccggagatcgagaccgtagctagggtttgaggcgccgggctgcggtggacgagatgtcgacgccggcgaggaagcggctgatgcgggacttcaggcgcctgcagcaggacccgcccgccgggatcagcggcgcgccgcacgacaacaacatcatgctctggaacgccgtcatattcgggccggatgatacgccgtgggacggtggcacgttcaagcttaccttgcagtttacagaagattacccaaacaagccaccaactgttcgatttgtctctaggatgtttcatccaaatatatatgctgatggaagcatctgtttggatatcctac

SEQ ID NO: 5206 - DNA, 252 bp, Zea mays
  Clone ID: LIB3279-017-P1-K1-B4
ctgattactactcttccttactccaactttttttacttaaataaggctcccctttgggcggggattcaaatgatcatggatccattcacattcacccttttcacctacatcctgaccacaccatttttttaaaacgcccttctcctgagcacaatatatccccccctctaaaaaatcctttttttcaagatctccaatggcccctttaagaacccccacccccactctttacttctccgctagctctctaaa

SEQ ID NO: 5207 - DNA, 430 bp, Zea mays
  Clone ID: LIB3279-017-P1-K1-B5
cccacgcgtccggtcgccatcaacctgcccgcggacaaagcgttgcaggtaggcccacagtacaaggagtacgccggaagcttcgccgtcgtgccgggctccggcgccgggaagacgcggaaagtgaagctctccctgtgcatcaccgaagtgctgttcgatatcgacgctgacggcgataaaaccgtcgacgtcgttatcgtgccgcgcacaaatgctaagatcacgctcaacgctcgccccaccatcaagaatcggaactaggagctaggtgctactagtgctcatcaagcacactgtacgtacgtacgtatgtactcgatcgcgtggtcattcatcgaccatcatcgtttatatgctgtcacgcacagtgcgggacggccagtgttgcattattgtgtgttttatttcgcatggattaggatcgagc

SEQ ID NO: 5208 - DNA, 134 bp, Zea mays
  unsure (1)..(134): unsure at all n locations; Clone ID: LIB3279-017-P1-K1-B6
ggtcgccgtattaaacccttaggaagaaaccccaccgtttttggccgccgccggctgagcggtgacggcatccaaatccatggcctcccgccaggcgctccacatnttcacgccctcccggcgggcgatgcaca

SEQ ID NO: 5209 - DNA, 435 bp, Zea mays
  Clone ID: LIB3279-017-P1-K1-B7
aattccggggcgacccactcgttcgtttcgtcgaactcgagggtaggaagaaaccccaccgcttctggccgccgccggctggccggtgacggcatccaaatccatctcctcccgccaggcgctccacatcttcacgccctcccggcgggcgatgcacatcctcacgtcgtcccgcggcatcgcctcgaccccgcacctctcgtacttcggctggtttgataagatcaagcccaccatcactggcaagaagcccgaggaggcctccgcggcatcctccttcacccttatccagttcgcaaacacgatggagaacgcgtgcaagctgtggacgtacaagaacttggttgccgggcgctccatgctgcccaccgtcgtgagcgtattagggaagcccccgctgtgctgcgctaccctcgtgccatcgaccccaccggc

SEQ ID NO: 5210 - DNA, 393 bp, Zea mays
  Clone ID: LIB3279-017-P1-K1-B8
cccacgcgtccggccaaaaccccaatcgcacaggagagaccgagagagaggttttccatccatggctcccggcgtcgcttccgtgctggtcccgcaggagcccgtcctcctcaaggacatcctcgcctcaccgtccccctgcgggaacaccgctgtctccgcccgccacctcttcggcaacggagtcgcgccgccacgctcctcggacgacggcatcaaggacgccgttgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctc

SEQ ID NO: 5211 - DNA, 430 bp, Zea mays
  Clone ID: LIB3279-017-P1-K1-B9
cccacgcgtccggaactcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatcaaggtggatcgtgtcctttactcctctgttgtttacccacataactatggtttcattccacgcacactctgtgaggatagcgaccccatggacgttctcgtactgatgcaagaaccaagtggtccctgggtgttttctgcgagctcg

SEQ ID NO: 5212 - DNA, 403 bp, Zea mays
  Clone ID: LIB3279-017-P1-K1-C1
aaaacactgagagcacagcccaaggctaatgatcaatacttgcccccatttgtgatagttgatgacagcggcaaagctgttggacctgtattagatggtgatgcagttgtcactatcaacttccgggctgatcgcatggttatgcttgcgaaagcactagagtatgcagattttaacaactttgaccgtgtacgtgtccccaaaattcgatatgctgggatgcttcagtatgatggtgagttgaagcttccaagtcgctaccttgtttccccaccagagatagatagaacatctggggagtacttggtgaagaatggcatccgcacctttgcttgcagtgagacagtgaaatttggccatgtcacatttttctggaacggcaaccggtcgggatactttgatg

SEQ ID NO: 5213 - DNA, 415 bp, Zea mays
  Clone ID: LIB3279-017-P1-K1-C10
agttggtccacgaagagatttggctaatcaaaggcagctgagatccagtcaatgaaggttttgtcttacctcgagcgaagagaaggcttttttatgcaccgagaggtttctctcggttttgctgtagaaatatttatcatgcatcctatattatatattcggttactttatgaccaaggtaagtaagctttggactatactgattctataaatacccttgtaggaatgcttgacacagagaacgccttgctctatcataaggtaccagatttaaatcaaaaaccaaatttctaagaaaaaaacgaacggtaaccttatccatcagctttagtaatttatgtgtttatcttacttgcaacaaatactatactgagactaccaaactatgaatgttgtttatgtgacatgtaaatga

SEQ ID NO: 5214 - DNA, 429 bp, Zea mays
  Clone ID: LIB3279-017-P1-K1-C11
cccacgcgtccggtcgtcggctatcgcaacagcagcgcctcttccctgtcgccctgactcctccctagcagcagaaaaccggcggcaagtcttcggtggcggcgagggaaggccaaggctttgcctgagagaatgcaagacccaagggatgatgatttcttggcgccaaagttgcataagaagaaggttgtctaccggccgcagccatcaggccatctgaagggtgaacctgaactgttgcggagagagtttccgcaatcatcaggcatggtccaaaagccacccaaaagaagcttgaagggtgagcctcgcacgcccccttccgacagggggaccccggattccctgccggaatctggtcctaccgacgaataccgtgcgttaaggaggaagtacctgatgctggaggaagagaacttgcactggaca

SEQ ID NO: 5215 - DNA, 425 bp, Zea mays
  unsure (1)..(425): unsure at all n locations; Clone ID: LIB3279-017-P1-K1-C12
acgcgttcgtggcccgtggcacggtcatactggccgagtacacggagttcaccggcaacttcaccaccatcgcctcccagtgcctcatgaagctccccgcaagcaacaacaagttcacctacaactgcgacggtcacactttcaattacctcgtggaagacggattcacatactgtgttgttgctgttgaatcggtggggcaacaaattcctattgctttcatggatagggttaaggaggatttcacaaaaaggtatggtggtgggaaagctgctactgctgcagctaacagcctcaatcgagagtttggatcaaaacttaaagaacacatgcagtattgtgtggatcaccctgaagaggttagcaagctggccaaagtgaaggcgcangtttcagaagtcaatggtgttatgatggaaaacatg

SEQ ID NO: 5216 - DNA, 405 bp, Zea mays
  Clone ID: LIB3279-017-P1-K1-C2
caacgtccaaaatccagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcggatgcggtgtgcaccatggccgacatggtgaacgagaagaccgtgcagtgcacggacccggccgggcagcttccgtgccctctggtgtcgccgacggacc

SEQ ID NO: 5217 - DNA, 414 bp, Zea mays
  Clone ID: LIB3279-017-P1-K1-C3
gcatggtcaacaagttgttctggatgagtccttgaggaagcatatacagtttctggagcaacaaggaatagccggtgtgagtcatcacagcctcctattctctaaaactgcaaccctgcccactctgagtgagaatgatgcactggacagcaaacctcggggcatgcccatgatgccccagcaatattacaagggatcctcatctgactatgtcgccaacggggcatcttttgcgctgaagccaaaggatgaaagtttcactgttcgaaactacattccaagtaacagaagcgcagagagtcctgaagagataaaggcaagaatcaacccggctttcacagaccctctccaacgctgtgcttgtgtcgaagctaccagatggtggtgagaagataaggaggcagataaatgagc

SEQ ID NO: 5218 - DNA, 265 bp, Zea mays
  Clone ID: LIB3279-017-P1-K1-C4
ctacgaacccaatcgaggtcaagtaaaacccaagtcctaaatccgaacccgccaatggcgtttcctgtgcgtagctacccccacacctcgggcgggacgacaataacagttcttcctatttctactaaaacatgcaacacctgcgccatctctagagtgaaaaatgtatgtcactaggacacgcaatacctcatggtcaatgcccatgtatgcacccaagcaaatattacataggtgatccttcattctgactatagacgaacaa

SEQ ID NO: 5219 - DNA, 431 bp, Zea mays
  Clone ID: LIB3279-017-P1-K1-C5
ccacaacccgcctgctagcctagcgcaaccagcaagccgctcgccacgcgtgcgatgccgtgtttggccggttggcccccaacgccgttcggccgccttcctcgccgtcggtccacgcgtactcttctttgctagactgctccccttctccatcgatcacttgcctccactacgcgcaagatgcaaccgtgcctacgacctgctagtacctagcttcctccccctctctatgcgcgccactccaggcgtcgagctcgcctctgcgggaccgtagcccccacccctcattggctctctgcgcgagcgtgatcgtgcctccgcatcccatgttcaatggatccctaaaggttgtgcttctacgaagatccaaaattccttggactaaaagcttcagcttccaatagtcgttaagggccttgtactacgaactc

SEQ ID NO: 5220 - DNA, 418 bp, Zea mays
  Clone ID: LIB3279-017-P1-K1-C6
cccacgcgtccgctggccaccaacgcgtcggggcgcccgtacccgcgcttcgcctgcgcacttcgacccctacggcccgatctacggcgaccgggagcgcgcccagatcttcgtctcggacgccggcgtcgcggccgtggcgttcgggctgtacaagctggcggcggcgttcgggctctggtgggtggtgcgcgtgtacgccgtgccgctgctgatcgtcaacgcgtggctggtgctcatcacgtacctgcagcacacccacccggcgctgccccactacgactcgggcgagtgggactggctgcgcggcgcgctcgccaccgtcgaccgcgactacggcgttctcaaccgcgtgttccaccacattacggacacgcacgtcgagcaccatcttttttacaccatgccgtactaccac

SEQ ID NO: 5221 - DNA, 430 bp, Zea mays
  Clone ID: LIB3279-017-P1-K1-C8
gagcggccaacccaacccaacccaacccaccactgcctccctccccgttccccaggccccaccccgaccggctggtcctcctcctttccccgcgccatcctcgaggcatcgccggcgccgcaacttcgttcaggaggaagcccgcacccggccccgatccgatggccaacagcaacctcccgcggcgtatcatcaaggagacgcagcgactgctcagcgagccagcgccggggatcagcgcgtcgccctcggaggagaacatgcgctacttcaacgttatgatccttgggccggcgcagtcgccctatgaaggtggagtttttaagcttgaactctttttacctgaggaatatcccatggctggcccaaaggttaggtttctgaccaagatttatcatcccaacattgacaagcttgggaggatatgcct

SEQ ID NO: 5222 - DNA, 406 bp, Zea mays
  Clone ID: LIB3279-017-P1-K1-C9
cccacgcgtccggtcctcaccgttgtgttcccctctcagtctcggggcttcttctcgcgggcacctccggctgcttcctttgccaccgcagcaccagcgctgtccatggagcccccgccgctctcctcgttgcaggaggagggggaggaggggcctaccgtcgaggactcgtccgtcgtctccgccgacgttgtgccgcctcgccccgccacgcacagccactcgctccacaagtacgcgccgctggactggtccgcctacttcgacgaggagcgccgcgtagccatccccgacaccgacaacgttttcaatgcgtacacgaccggatcggaggggcccgtcgtgttctgcttgcacggaggcggttattcggggctttcatttgctctagcagcaagtcaaatga

SEQ ID NO: 5223 - DNA, 430 bp, Zea mays
  Clone ID: LIB3279-017-P1-K1-D1
ataaaccaaggtaatccttcctaccacaaatgcgagaggctgcttcgtatccgtgacttggacttactgagtcgccaggtcacagttcgaagcagcctttccgcgtttacggaaggaaggcttgccccggtttatctcttcttcagacctcactcgtcactggttctgcccctagtattttttctagaagtctaaaaataatttgtatccaaacagggtctaaaagggttaaaaaactggataagcattgttttgcatcatacttcaccaagaagcccgaggaaatagtcgaactgcagatatgtgaaattcgttcataatttgtccttgctatcactgttgtcacccctgaaaagttctgtttggactttaaagtgattaatccaatgttacacaggtgcggtcacatgtgttgctgtatggcatgctc

SEQ ID NO: 5224 - DNA, 385 bp, Zea mays
  Clone ID: LIB3279-017-P1-K1-D10
agaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcaggaatgtgctcacaaacttctggggcatgaattttaccaccgataagctcagatctctagtaaagaagtggcagacattgattgaagcccatgttgatgtcaagacaaccgacaactacatgct

SEQ ID NO: 5225 - DNA, 420 bp, Zea mays
  Clone ID: LIB3279-017-P1-K1-D11
ggagcctgagagccagccatggctcggattaggaccgaatgccgtgaattccagcctgaacctcagctagtacacaacaacacagccataataagacggcacagcaacggcacccaccatgacctggagtttgctttgccactagatcgtgttcagaaaccataaatattcttagttatcgtgttttagtgttcgcttatgtcgtggttctacgccctcttgtcgcatagttctggatgtaaagaaaagtagccagtcatatgaccatcaccgggagtcgaagagaagtttttggggggtgttaacacacggcgactctgaattggccatgctaaggaaaacgatagtgcgatgtgaagtatatgtattttctgaaagccaaatcgtttgggtctagccctgatgtatgcagaacaagtg

SEQ ID NO: 5226 - DNA, 382 bp, Zea mays
  Clone ID: LIB3279-017-P1-K1-D12
agttatttcatgagtctctcgaatcaggcactgaaagtgagagttagagaattacaaactgcataaccaagtttttcttcaagcacgatgctaaatgtctatgggtcttaacatatggcatgttctatgaattgtgggctattagaggaaactcaaaccacatccatgagagtttgcagaagttgttagctatgatgtgtgcacttgtgttttatgtaatatgttgctccattctgtctcactgcgccacctcctatctcgtctccttcgtccccacgagcgagtaagctagtcttgctagtatcaacccgacgacatgttggtctaccaagatctgttctactgggttgaaagaaattgtgaacttaaaaacggcattctt

SEQ ID NO: 5227 - DNA, 139 bp, Zea mays
  Clone ID: LIB3279-017-P1-K1-D2
ctttttcactttactctttattctttcaccaacaattatcctgatctaacataccatttgaccattaaaagctcaagcaaccactctaccatcacccatgggaggatttactttacaccaagtgagaaagccattcttt

SEQ ID NO: 5228 - DNA, 411 bp, Zea mays
  Clone ID: LIB3279-017-P1-K1-D3
cggacgcgtggggccagggtatgcacaatgtgcctcctgtggcagctgggccaggccatcactatacaaagccccgaggaccaggaggccctaaccggtatcctccgggtgggaatcaggggggaggctacaatccgaaccgtggaggtcagggtggtggctatggcagtggcccatatccccagcaagggcgagggcctccttatcctggaggtggaatgggtggaacagctggtccacggggcagcggtggcagtggctatggagctggaggtccaaactaccaacagggtggtccatatggcgcgtccggtccaggccgaggatcaaactactcccagggtggtggttcccgcaatcagcagcagtatgggaactggcaataacgtggcattgagatgtatgtatatg

SEQ ID NO: 5229 - DNA, 392 bp, Zea mays
  Clone ID: LIB3279-017-P1-K1-D4
tcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccggccccggtgtgctcttcatggccaacgccgggcccaacaccaac

SEQ ID NO: 5230 - DNA, 428 bp, Zea mays
  Clone ID: LIB3279-017-P1-K1-D5
gcacgatctctactgcatgctgctggtgaaccattctgtatatctaatgctgtgttcgcaatcatcagaggtcataaacgtgcccttgatgttacttctgttgtgcagggaaaggcaaggttctttagtgtcctgatgcttacatggggtctggtggctgatgttgatattgaatctgagaagtataggcgggtgggaagtgctcgccttgatttttatcaccaggatacgaataagttggtgatccagtggaccaaactaccggttacgaaacaaacgggtttagcacgggatttcaagacgactgtagaacctgctgtaatggtgagacgtgtggctatctgggcccgtcggagatcaaagaagctggtcttagatggagatcactggatgggccattcgtttcactctggctcggcattgttcct

SEQ ID NO: 5231 - DNA, 427 bp, Zea mays
  Clone ID: LIB3279-017-P1-K1-D6
cggacgcgtgggtctgaagctagtggaactttgtaaaggcctcatagtgttaccctgcctcgcctcctcggtagaggtgtatgggaagtcacgatcccttggcagatgggtaacatgacttgtgggtaaagggtaccacctctgcagagtgtaaaactggtatactagccgagctcacggtcatgagcagctcaggactctctgatgattaacttatggaactaaattcaatttgtcatatgcattgcatcgcaggtgatgttgttacttttgttctactacttaattgggttggtatttacttatacttagtaattgctaataaaattttgaccaactttaaaagcaatgctcagctctcaccatcctctttggtaagccttacacttcacgtgagctcccacctttggcgagttcatgcacatta

SEQ ID NO: 5232 - DNA, 414 bp, Zea mays
  Clone ID: LIB3279-017-P1-K1-D8
gtcgatggtgcgatcgggtcacttttcttggatcttctatctggaagtggaatgttcaccaaacaggagatcgatgagattgtggagatcggttatctcaatgggctctttgtgcttgcacgatcaattggcctgatcgggcataccttcgaccagaagaggctcaagcagccactctaccgtcacccatgggaggatgtactgtacaccaagtgagaaagccattctttgcaaggcataataaagtattattatcgcctagagcttccagttgcctagcttccagttgcctgtacacttcattaaatcgagcacttgcaaaaaagaaagccagagagaggaagacgaacatcactagtcagcactagattgtgtgttttatgttgagttgcaaattcaggtcctgatttttgt

SEQ ID NO: 5233 - DNA, 419 bp, Zea mays
  Clone ID: LIB3279-017-P1-K1-D9
cccacgcgtccgctctgagaaaaatgcctgaacgaccttcaggtgatgttccttttgatgactctgaagtggatacatcaatcggaaagccaattatgggaccaaacgaagcttcatcttatccagaacaggctcaggcatgccttgctaatgatttcttgagaaggtttgatattgatgatagatcggtagtctcacatatatttcatcattggggcaagaagcaggcatttcaaaatccaaagagattacttgaaaagatcagttttgtaattgatgaacgcctacgtggtaaaggatacaagcgcaaggatgtcttgcgaaagctgaaatcgttcctaagcggtgatgaagcattgggctacgcacaatatgttatcaagtgggaacagattcctatagaaaagcggaatcatttg

SEQ ID NO: 5234 - DNA, 417 bp, Zea mays
  Clone ID: LIB3279-017-P1-K1-E10
ccatgatcagatgatcatgttagaagcagctaaagctacaacagagactgttgatgcattgagaactggagctgcagctatgaaagcaatgcaaaaagcaacaaacattgatgatgtcgacaagatcatggatgaaattaacgaacagactgaaaacatgaaacaaattcaggatgctttgtcagctcctcttggagcttttgctgatttcgacgaggatgaactggaagctgaacttgaagaactggagggagcagagttggaatctcagcttcttgagcctgttgcagctcctccggtgcatccagtgcatgtcccagccaacaagcaaccagctcgccctgctccacagaaagttacagctgaagatgatgaacttgctgcactgcaagcggaaatggcattgtgatcaggaac

SEQ ID NO: 5235 - DNA, 281 bp, Zea mays
  Clone ID: LIB3279-017-P1-K1-E12
ttcggagacatcgtgaaataagagcgtcgctgatctgtgatcatcgtatttgggggtatgcacctgtagcaaccgatggactgaactgtgctggattatgctgttggatcacctgagtatgtgttacatgtcggttttgatgtgacatcctatcgtttcgatgtgttttgtggaagtgttgttgcaagatttcaacagtcacgacttggttttgatatgcagtcagcagcagctcctgagttgtgattgctcagctgcggtccttttctttaaaataaaat

SEQ ID NO: 5236 - DNA, 418 bp, Zea mays
  Clone ID: LIB3279-017-P1-K1-E2
gcacagtgcacacactcgtctcatcggagaaaagtagatccgggttagggttttagacggcgatgggtgcggcgggcgacgagaaggctgcgatggctgcgtccgctgcagccgcgggtgccggtgccgccgagggcgagggcgcggtggactccaaggaccttcagcagcagagcaaggcgctcgacaagctcactgatcatgtcgaggaccggcagctcgattcatcccgtgtccaatccgccatggcagcacttgcttcatccaaggaggctgactggaacgcgatgaggctgagggagaaagaattggctgctgtgaagatcaaccctgccgatgtcgaaattatcgctactgagcttgagctggacaagaagatcgcggagagaacgctccgtgagcacaagggtgatgccgt

SEQ ID NO: 5237 - DNA, 321 bp, Zea mays
  Clone ID: LIB3279-017-P1-K1-E3
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcacc

SEQ ID NO: 5238 - DNA, 354 bp, Zea mays
  Clone ID: LIB3279-017-P1-K1-E4
gctttttctactcattcggttaggattcgtcttacagaggcactccctaattcggggtcgcataacaaacggatcgatattacaacaaaccatattacaaaccacatcttcgtattccgcctcaccatgggcttgatgactaccatcagactgaaaacatgaaacaaattcaggatgctttgtcagctcctcttggagcttttgctgatttcgacgaggatgaactggaagctgaacttgaagaactggagggagcagagttggaatctcatcttcttgagcctgttaaagctccttcggtgcattcatatcatttcccaaccaacaagcaacaaacttttcttttctctacaa

SEQ ID NO: 5239 - DNA, 402 bp, Zea mays
  Clone ID: LIB3279-017-P1-K1-E5
ctttcccttctatccttcctaccccctgatccatcccattcggacaccagcgacagcgatgggctcacgctacgaggtggaggtcaccgtgggctccgcccgggacctcaagaacgtcaactggcgcaacggcgaactcaagccgtacgccgtcgtctggatcgactccggtgccaagtgctccacccgcgtcgacctcgacaacggcgagaacccgacgtgggacgagaagctcctcgtcccgctaccgcccacctcccgtctcgacgacgccgtcctctacatcgacgtcatccacgccaacgccgccgagggcgtcaagcctctcgtcggctccgcacgccttccgctccgagacgttctctacgacacctgtatagggggcatgggctcgcgcaatct

SEQ ID NO: 5240 - DNA, 430 bp, Zea mays
  Clone ID: LIB3279-017-P1-K1-E6
cccacgcgtccgcccacgcgtccgcccacgcgtccggtacatccaaaggcgaggtggctgttttactgcaatagagttaaacctttaatgtaaagataaattgatgtaaaaattgagcagcttggacctaaattattgatctactgacttaaggatttattacaaaaggtcagaggtgaatttatgtgatgtgcttgtgcataccaatttatgttctctcaaaatttgttccttcagatctcccatatttttgtcaatttggaaatatagaagagataataatctaatgctcacaaacagaagttcatattatgcttctaagagttattatgttttaattttgtactcctaggttataatatgttttatcttgtgtttttttaccacttattgcttggaccatgtaactctctagcttaaggtcatgttt

SEQ ID NO: 5241 - DNA, 426 bp, Zea mays
  Clone ID: LIB3279-017-P1-K1-E7
gagacaccgcgtgcgaaccaagcagaccacaacaagaagaagcgtagtcgtcgccggaaggaaaggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaaca

SEQ ID NO: 5242 - DNA, 289 bp, Zea mays
  Clone ID: LIB3279-017-P1-K1-E8
cggacgcgtgggcttctccgttcgcccgcccgcccgcccctcccctctctctggcgggccgcccggggagaaggagggctccgccgctcccggcgaagagcgcgccattgccgccgccgcgctgactggggaagatggttgtccaggagttcacagttgatctcaacaagccccttggtatccaggttggccatcttgaggaacggtaccaggaatgggttcaccaaccgatcgccatcatggaggttccacgctttttcggaaatgatgttctggagttcttgcctcg

SEQ ID NO: 5243 - DNA, 53 bp, Zea mays
  Clone ID: LIB3279-017-P1-K1-E9
ctgactcgtggtcttatccattcgctcgaccacaccaccatcccttctatctg

SEQ ID NO: 5244 - DNA, 426 bp, Zea mays
  Clone ID: LIB3279-017-P1-K1-F1
gataaagctgagagagatggaggcagatatggtagagacgatcactctccaagccgtgatgggcctgatgatcagatgtttgatggtttccgtggacggccctctaatgctccttttgttgctgaattcccccctccaccgatattgatgccagtacctggtgctggtcccctaggaccatttgttcctgcacctccagagatagcgatgcatatgctgagagagcaagggccacctcctccgtttgaaccaaatggcgcaccacatggcagcacaggaatgctcgggccaatgctgggtggttcagcaccgattatagctatgcctccgaatttccgccatgaccctcgccgtctgagaagttataacgacctcgatgcccctgatgaggaagttactgtccttgactacaaaagcttgtagggt

SEQ ID NO: 5245 - DNA, 426 bp, Zea mays
  Clone ID: LIB3279-017-P1-K1-F10
cccacgcgtccgcggacgcgtgggtgtcaagaaaacagggctcctgtggatcctcgaaggcagataagctgctaggaagtggaacagctgctgatattcttctttggagggatgaaaagagaaccttttcatttgtcacagtattgtttctgcttttctactggttcctgctttcagacagaacttttgtttcatcagctgccaaatttcttctagtgctctcgcttgctctctttatccatggtgtgctgccttcagaagtgtttggttttacagtcgagaaggtcacatctgatcattttgaagtatcacactcagcattgaggaattcacttatgtgtgtggcttctgcatggaatgggagttttcataaactaaggcttttagcagaaggtgaagactggagtttacttttgaaagtatttg

SEQ ID NO: 5246 - DNA, 428 bp, Zea mays
  Clone ID: LIB3279-017-P1-K1-F11
gaaaattgcttgagtacagatgggacctgaagacataagatggaaagaggatgactctgggatagaccctgtggtgtatctgcgcagccgaggtgccccaagtagtggggtcaggaagccaacaggtcgcggtgggcccatgccaggttctggaagaggaagaggattaccgaagaacatgtctaggaaagattttccacctccacaaaatggtgttggcaagagaagttccgatgacattgatatccttcatactgagagcctaataaaagaggtggagaaagtttttagcgttagcaatcctgatccacaggaagtagaaaaggcaaagaaagcactgaaggagcaagaacagtcattgattgacgccatagcaaggcttgctgaggcatcaaatggtgaaagtgatgggctcaatcgtgggcgaa

SEQ ID NO: 5247 - DNA, 421 bp, Zea mays
  Clone ID: LIB3279-017-P1-K1-F12
gttcaacggtgcgcccttggctccccctcccctaccactgtagccgttttaggggctacagtgcgcccctattctcttcaccggcttcctcctcctcctcctctcccctcccgatttcttctctgtcccgctaaatggatgggcacgctactgcgccggatttctccccagccggttccttcggccacgcgaccgcgcgctcggaaaactccgctgacagcgaaggaggcgaaccaagggcgacgtattcgccgccggagaaggtaagcgtcgatccgccgtgtcccgcgattcgtttgtcttccgggcggcgagcaacagtgggggtcgtcctcgcggatctgccttcaagctttcgcggattcgccttcaagcttcgcggatcccacacgaaacctccgagttctgtcgccaattcgat

SEQ ID NO: 5248 - DNA, 433 bp, Zea mays
  unsure (1)..(433): unsure at all n locations; Clone ID: LIB3279-017-P1-K1-F2
ggctgagcggactgctgggtgaccggaaccggcaggtcatgtacatactgctccaggcgctgttcacagtggcaacaatggcactgaccgtacctatattcctgtcctaccggatgcacgtggtgttcctgatactcaaggtgtgcgcgtcgacatggaacggtggcagcttcatcttggaggtgatgcctcggcaagtagtgcagaagcagctgaagaaactggacatgaagcctatggaacaggggagctcgacacaaggtgcgccaggtggtgatggtggcacattgggtaaccaccaccagcacacatccgaggagcatatccaggagtgaggaaattgaagctggatgtaagattagattttgatgttcactgacacaacctttgttgtcatcgagtgcgctntgtgttggagtttttctttagttct

SEQ ID NO: 5249 - DNA, 434 bp, Zea mays
  Clone ID: LIB3279-017-P1-K1-F3
cgctcgtggagttcttcgtccgggaagcagaggccctcaacgcaaaggctggacattatcaaaagccagaagatgttccattcttccctcaagatctaccctcacctctctttcctacaaagccttccccaaaggtcttgcacccttttgcttcattggtcaccgtgaatgatgcaatatggaaaatgtattttgatgaattgctcccgttattcactgttgatggtgatgatggcagctatgcacaaacagttgcactggatttagcgtgtctgcaggttctatcacaaagaattcatattggtaaatatgttgctgaggtgaagttcaaagacgctcctcaagaatatagtcgactaataaaagaaaggacagcaattctctgatggatatgctgacattcaaggctgtggaagagaaggtcaagaagagag

SEQ ID NO: 5250 - DNA, 424 bp, Zea mays
  Clone ID: LIB3279-017-P1-K1-F4
gtctgagctctccctcctccgcgtagccaaggtcaccggcggcgcacccaacaagctctccaagatcaaggtggtgcgcacctctatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctttctctgaagacggagagggaaaagaagcgtgagaagtacttccccatgaggaagtatgctatcaaggcataggtcagaactgtgagatgctgtgctttgcatatcatcggctgtgttttaatttttggtttgtatggacatttgttgtggctcggaagtacgatgtattcctctgttgccttataaatggctagattg

SEQ ID NO: 5251 - DNA, 432 bp, Zea mays
  Clone ID: LIB3279-017-P1-K1-F5
cgagcaggaggcggacaaggtaagcagcaatcgcaggaaccctagcgccgccgcacccgcaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatttcaacgctgtcattctcaagaggcttttcatgagtaaaaccaaccgaccaccaatctccatgcgccgccttgtcaagtttatggaaggaaaggagaagaacattgctgtcattgttggcacagtcacagatgacaaaaggatccaggaggttccagcaatgaaggttactgccctgaggttcacggagacagcaagggccaggattgtcaatgctggtggcgagtgcctcacatttga

SEQ ID NO: 5252 - DNA, 432 bp, Zea mays
  Clone ID: LIB3279-017-P1-K1-F6
gagaaacttcaactcaaaagtaaagatgctaatgaatcattacgggcacacatgtccactgaagcagaattagctgatagaaatagcacacttgaagcagctatccattctcttgaaaccaaccttagcagtgttattcaagagaaggaaggtcttgaggagcttatgaaaggacatgacgaagcgtcaaatcaagttagtaacaagtctcgtgatatagcagtcaataacagtgatagagtattgaaggatcaagatgggattttacagcttagggtcttgcaggcagatcttgaagagcaagttgataatttgaaatctgcaaaagatgagactgaaattttaaacatgattcttaggtcaaaattggaggagcaacacactgtgatgtcattattgctccagaatcagaggcatgagttgataaattca

SEQ ID NO: 5253 - DNA, 347 bp, Zea mays
  Clone ID: LIB3279-017-P1-K1-F7
cccacgcgtccgcggacgcgtgggctaagccacttatgcagctctggaaggactgcactgaggtcaagtccacaaaagcttcttcaggtcacttcataatttgagggcagcgatcatcatcacaagaaccacaaccgaaaaactcaccacctcaggctgggggagagtatgagatggaaacaggtggtctgccgatggatttaacagatggcattgaaaaactcagggcaaacatgagtgcaaaatatgacagagcttacaatattcttcacagtgaccatagtgttactcctggaagtcctgggttaagtcgcaggtctgcttcaagctctggtggctctggatcg

SEQ ID NO: 5254 - DNA, 375 bp, Zea mays
  Clone ID: LIB3279-017-P1-K1-F8
ttatttgaagcatcacgagagtgtgtatggcttcgtaaaatggtaaaccatatactcacaacatgtggtattggttcaattgaatcactgaccattaataaacatattttttctaaactgttttatccccaggaacttcaggaaaatgcagataaaaacatcttacagacaaagtcttgtgataatcttgctgatttattcacaaaatctctaccatattctacgtttcagaaatatgttgaggggattggaatgagaagacttaaaggattgcaaggatcagggggagttattctccgtgatatttaacctgttttgggccataatattacactcttttctttgtatgagctttggcttgatgagttttctcat

SEQ ID NO: 5255 - DNA, 400 bp, Zea mays
  Clone ID: LIB3279-017-P1-K1-F9
ctctaaaatagaagaggatgttgctaagctcagcggttctgcagccaactaagaagctacaagtgaatgccgaggagagcagcgatgacttggctaacccaccgaaggtagaggagaagcttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgctggataagattaggttcctttcccttactgataaggaagttctgggtgaaggggacactgcaaagcttgagattc

SEQ ID NO: 5256 - DNA, 437 bp, Zea mays
  Clone ID: LIB3279-017-P1-K1-G1
cagaatgtgtctagcaaatctttctttttattcgtcctgaactccgttgcgtcatgagacggacatcactaaattacagaataagcacaacatataaaacctagcaaactaaatagcacaccaaagcctacagaaacagagcgctgaacaggctcagcggattagaggcactggggacagaacagaccaagcacatccagcaccgtaggaaaaccacagctacgacgaactcaggccttcttgaggatatcatctggctcacggagcgtaccaaacatccagtccatccagacggtgtagtgaccatagttgtggcggtaagtcgtatggtggatggtgtgataccccgctcccatgactggccataacttgccgtgaatgcagtcgtggatgtttgtccgccacacgccctccaagaacacgagagcgatgtgcgg

SEQ ID NO: 5257 - DNA, 263 bp, Zea mays
  Clone ID: LIB3279-017-P1-K1-G10
cccacgcgtccggggatggaaaggagcttttaagacccacttgcctccggaaacaaggagccgccttacaattggtgttggctccaattttgcttgccagttccttcggaggatgctcggtatgttatttacgtacagctttatctttctgttagcattgctatgatgagaaacaatatagtgtgcctcggtgtaatattcatgttccttggagctgtatgttttgtacttttgtatataaatagttcaagttccacgaaaaa

SEQ ID NO: 5258 - DNA, 421 bp, Zea mays
  Clone ID: LIB3279-017-P1-K1-G11
gaacagaagccatcaaaagcgaggctgcgagagcggagagagagagtgagggaggcgccgacgccgagtcctttcttcatcctgcatctgccgctgtttccgacaggatgtttctcacgaggacggagtacgaccgtggggtgaacaccttctctccggagggagcgggtgttacaggtcgagtacgccatcgaggccatcaagttgggatccactgcgatcggtttgaagacaaaggatggtgttgtcctcgccgctgagaaacgtgtgacctcaccactgctggaaccaagcagtgtggaaaaaataatggaaattgatgagcacataggctgtgccatgagtggacttattgctgatgctagaacactagtggaacatgctcgtgttgaaactcagaatcatatgttctcatacggag

SEQ ID NO: 5259 - DNA, 410 bp, Zea mays
  Clone ID: LIB3279-017-P1-K1-G12
cccacgcgtccgctgcaacctgtttggaggatggcaagctgaagacatctgactgctccttgcaggccactccatccaaaccaaacgatctagctctcgcagatctcgtggagaagaagctgtccagctcgatagagcagatcgagaagatggtgcggcgaaacctgaagagaacttcgaaggccgctcagccttccaagaggaccatccagaggcgcgtcctgatgtccatgcgatgagctgagaaagctatctgctctgccatggcttcccttgtctgctgctttcttagcggcaaccggcaagtcgtaaccaaccatttacgccagttttgcctgaaggaggggtggggtcgtgggggctcctggttctctgcttgaggaccccggggtatgcgccttactactagc

SEQ ID NO: 5260 - DNA, 418 bp, Zea mays
  Clone ID: LIB3279-017-P1-K1-G2
cgcttgcgtcacacgcacactgacggagagtgatcactgatttctggtcatggcaaccggaactgaggaagttgctccggtcgtcaccgtctccgaggagccggcgccggaggcggcgaaggaggtggcggagaagccggaggaggggaagaagcccgacgaggagggtggcgaggggaagaaggccgcccccgccgccgagaaggagaagaaggcgaggaagccgcggagcaggaagcccaagtccgccgggccgcaccacccgccctacttcgagatgatcaaggaggcgatcctgtcgcaggacggcgggaaggtcggggcgagcccgtacgcgatcgccaagcacatgggggagaagcaccgggacgtgctcccgcccaattaccgcaaggtgctggcagtgcagctgcgcggc

SEQ ID NO: 5261 - DNA, 432 bp, Zea mays
  unsure (1)..(432): unsure at all n locations; Clone ID: LIB3279-017-P1-K1-G3
gagattcttgacgagattgtggatgttgatttggttcttaatttcaagtgtgctgatggctgtttcatgaagaagcaatcgagaggcaacatctgcgcccactgtggacagctctttgacgtcagcaattcagcatctacgaactgtagccccagcctcgggagctatacatggcattctcaggcagaacctgctggtgttttaggcctcgaagcctcaaggatggagaggatgcgcacatatgctgagcaggtaatggttagcatttagtcttggccttgctttatgccaaaggatgcatagaacagtatgcgcttcgcctttactgaccagtatagtgactctacagtagtacagtcaggccttactaaacttgtttctgtattaaaaaaagagaaccacanatcttcaattgcattattggtctaattt

SEQ ID NO: 5262 - DNA, 398 bp, Zea mays
  Clone ID: LIB3279-017-P1-K1-G4
tttatctctggggctaagcttcaattcggcatctgcccattcttcagtcttaatgtcattgccgccgagtacaacagtgactcaccggtgcatgcacaccaaggatgtcatcactaccagcaccatcaacgactacaatagtgaagagttagtcttctactctacacgggagtaccacaccaaccaaaatggctcattgttgccaccaaacagaatgtatagcctattatgtctggcacttagggactcgatagctttaagggcaagttatgcactcaagtgactatcatagggaagggaggccttccaaggaaagaaggtgcttgttgtcggttgtgataacacctttccaacaataatgttcacacgtacattgtttgttttaaaaaaaacaaaaa

SEQ ID NO: 5263 - DNA, 430 bp, Zea mays
  Clone ID: LIB3279-017-P1-K1-G5
gccgaggaagcagtgcgagaagcccttgcccaggaacccgagctgggacggcagggacagggcgcccctgccgaacccggcgatgccgatcggctccctgacggagctgcccacgcagccgaagcagaggccggggaaggccacggggagagggccgccggcgccgctgctcccgtgcagcgtcaccgagtccctggagagggagccgaggaccagcgcgccgccgccgtacgtgtaggagaagggagggcagggcctggggcacaggccgccggtgaaggccgtgatggcgcaccccgcagccgcgcacgggtcgaacctgttgtcggcgctgtggacgtccacgcagaagcggctcccgcagaggtccctcgcgttcgacgaggactcggacggcaggaacgtcgtggtcggcggctgcgtcacggat

SEQ ID NO: 5264 - DNA, 414 bp, Zea mays
  Clone ID: LIB3279-017-P1-K1-G6
tggacgcgtgggcggactcgtgggcaccaccgccataccagcgcgacagcgattccgtggtgttagaccaagcgagagagtagtctcagacgagaagaggtgaatatgagttccggcggcgagctgtgcaagcccaaggggtccaaggctgtgtcgcggtcgaccaacgctgggctgcagttccccgtcggccgcatcgcgcgctacctcaaggccggcaagtacgccgagcgcgtcggcggtggtgcgcccgtctacctctccgccgtcctcgagtatctcgcggcagaggtgttggaactggcgggcaacgcggcgcgcgacaacaagaagaaccgcatcgtgccgcgtcacattcagctcgccgtgcgcaacgacgaggaactcagcaagctgctcggagctgtcaccatc

SEQ ID NO: 5265 - DNA, 433 bp, Zea mays
  Clone ID: LIB3279-017-P1-K1-G7
cccacgcgtccgcggacgcgtgggctcgccgcaggccgccgggcgccgccgaggggggcggagcaagatgttcttccacatcgtgctggagcggaacatgcagctgcacccacgacacttcgggccgcacctccgcgacaagctcgtttccaagctcatcaaggacgtcgagggcacctgcagcgggcggcacgggttcgttgtggcgatcacgggtgtggaggacatcggcaaggggctcatccgggaaggcacgggatacgtcaccttccccgtcaagtaccagtgcgttgtctttagacccttcaagggcgagatcctcgaagctgtcgtcaccatggtggacaagatgggcttctttgcggaggctgggccggtgcagatcttcgtgtgcaaccatttgattccagacgatatggagttccaatcaggt

SEQ ID NO: 5266 - DNA, 413 bp, Zea mays
  Clone ID: LIB3279-017-P1-K1-G8
cccacgcgtccggcaggattcagcggccatgggcggcggcaacgcccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaactagtaagcagcagaagcatatgctctgctcagctaaaagacaagtactacatatatatatatatacgctgtgtgtcaattaatgggttctaggctgctgctgatgcggctgcttcgttcgtgttgccccgtctgattatgtactgtaacccttg

SEQ ID NO: 5267 - DNA, 387 bp, Zea mays
  Clone ID: LIB3279-017-P1-K1-G9
gctgaattcaatgaagatgacttgtgcaaattgcttccatatgtcagtcgtcgtcgtcagacacctgaactttgtcgattgcttgggttgtcgcagaaaatgccaggtgtcattgaagttctggtggaaagtggaagacctattgatgcaattaatttggcttatgtgtttgagcttactgaacaatttgaaccagtacaccttcttaaagcatatctaagggatgttaagaaaatgtcacacgccaggaatgtcaaaacttctcctggagcacagaatgagatgaatgaacgtgagttatctgcgctgaaatctgtcattaagtgcattgaagagcacaaacttgagcagcagtaccctgtggatccacttcagaaaagggttttg

SEQ ID NO: 5268 - DNA, 315 bp, Zea mays
  Clone ID: LIB3279-017-P1-K1-H1
cagaaatttccggaattcttccacgtactcaatttctggaacctcccgtacgtcctcatgacctgcacaagccgacgcttgttctcatcctctagctgccgcccttgctttccatggcggcgcttcctgctgctggcaacagcaccgaccgccctccctgctcgccgttcctattctctggcgctcgcccctgccccagccatggacgccgtcgacctcgacttcctctggccgcggcatccgtcctgctccccgctccatacatttctccctcctatggcgcactccttcccctagtcgcccatggccgcgccc

SEQ ID NO: 5269 - DNA, 300 bp, Zea mays
  Clone ID: LIB3279-017-P1-K1-H10
ggctcgcgatctaaacccacacatgccgtttgtttcggggagacagcttacattaggtccctacgaggaggaattcaggggttacgtctgttcaaggccagcagcagcctgagcggcagaaacctgtcccacagcattctagccataccggccaacactctgctcctgcaactggaatggaagcctctgcctccagcaatggtgatgcgtactcaaacaactcactcgagagagcaccatgtacttccgcaccatcttcttcatctgtgggtggtctccttcaaggctcactgagttaca

SEQ ID NO: 5270 - DNA, 360 bp, Zea mays
  Clone ID: LIB3279-017-P1-K1-H11
gtccggtttcttttttgcagagagcttgcataagttccctaggagggggaattcaggggttagttctgttcaagtccagcagcagtctgaggggcagaaacctgtcccacagaattctaaccagagtggccaaaattctgctcctgcaactggaatggaagcctctgcctccggcaatggtgatgctacgtcaaacaattaactaattgtgcaccatgtactttcgcaccatcttcttcatatggtggtgggctcctccaaagctcagttagttacagacaagaccattcaacacgcggtggcaatggtatctataatggaggaaacaatggtccagctgccaaggccaactcaacgaac

SEQ ID NO: 5271 - DNA, 388 bp, Zea mays
  unsure (1)..(388): unsure at all n locations; Clone ID: LIB3279-017-P1-K1-H12
cgttgcgtgccgccgccgcctcgccgacgagcaccctaagatcgcctcgttcggggacctgggggacgccgtgttcggcgcgcacggtcggttcgccgtggacgtgatgctggtgctcagccaattcagcttctgcgtcggctacctcatcttcatctccaacaccatggcgcacctctatccgattaccgccgcggcgtcctcatcctccgcgctcctctcccccaaggcgctcgtcatctgggcgatgctgcctttccagctcgggctcaactccatcaagacgctgacgctgcttgcgccgntcatcatcttcgccgacgtcgttgacctcggcgccatgggcgtggtcctcggccaggacgtcgacgtctggctcgccaagccc

SEQ ID NO: 5272 - DNA, 432 bp, Zea mays
  Clone ID: LIB3279-017-P1-K1-H2
cccacgcgtccggcggcatggtggtctccgacgcgctcgagcccgacttccccatcatctacgtcaaccgcgggttcgagagctccactggatacagcgccgaggaggtgcttgggaggaactgccggttcctacaatgcagaggaccatttgctcagaggaggcatccccttgttgatgcagcagttgttactaggattcggagatgtttagatgaagggactgaatttcatggtgatctgttaaattttagaaaagattgttctccatacatggccaggctgcaattaacacccatatacggagacgatgaagtaataacacactatatgggcattcagtttttcaatgattctaatgttgacttggggccatcttctggctctgtgacaaaggaacttgcaagatctacatggattgcacctggcaaca

SEQ ID NO: 5273 - DNA, 305 bp, Zea mays
  Clone ID: LIB3279-017-P1-K1-H5
actctgtacgtccacagctgcgttcgatgtatgtgcatattcaaggcccgttgatggatgaacttttgtagttgtggtccataggtgtacgtatgtgggacgggcataaaaaatatgattttgatctacgtgctttgttattggcgaacaggcgagtgagtgaagagagaagccatgcctctttcgagtgaggcaagcgatgaacgagtagatgctgccattcaacacgggattcagggtctgcacctattgtttagatgagatcggcttcttgtatctacatcattgtagagaagttgtttaca

SEQ ID NO: 5274 - DNA, 350 bp, Zea mays
  Clone ID: LIB3279-017-P1-K1-H6
gccgacgagcactataagatcccttctgtttcttttttggagaaagccgtgttcggcgcgcacggacggttaatcgtggacgtaattctgttgatgaccaacttcagtctgtggggcagatacctgtcccacataattctaaccagagtggccaaaattctgctcctcgacggggatggatgattctgcgtgctgctatggtgatactacgtcaaacaattcactcaattgtgcaccatgtacttgctcaacatcatcaagactctgacgctgcttgcgccgctcagcatcttcgccaaacaagaccatccaacaagcatgggcgatggtatctataatggaggaaacaa

SEQ ID NO: 5275 - DNA, 412 bp, Zea mays
  Clone ID: LIB3279-017-P1-K1-H7
caagccatggcgtccatgaccggcctctcgcagggcgttctgcccagcaggcgcgccgccaacagggccaggacggccgccgtcgtcagggcgtccgccgaggcgcatgcgcaggcgggccgccgcgccgtgctcgggctggtggccactggcatcgtcggcggcgccttgtcgcaggcggtgcacgccgagaccgtcaagaccatcaagatcggagccccgccgccgccctccggtggactccccgggactctgaactctgaccaggcgagggacttcgacctccccttgaaggagcggttctacctgcagccgttgccgccggcggaggcggtggcgagggtgaagacgtcggcgcaggacatcatcaaccttaagccactcatcgacaagaaggcgtgggcgtacgttc

SEQ ID NO: 5276 - DNA, 406 bp, Zea mays
  Clone ID: LIB3279-017-P1-K1-H8
ccatccgaacgcctctcggccctacaagatccctttgggcaccattggtgctatccttatgatcatcccacctggtctcttgatcattgtggtgatggcactcgcgtcctacaaggtgatggtggtgagcatcctagcgatggtcttcggattcgtgctgcagccgtgtttggtgtacgtggagaagaagcggtggttaaggttctccatcagtgcagacctgcccgatttgcctgatgtgcaggaaattgctgaagatgatgctgtcccactcgtggtctaatattcggccattgtgctctggaggtgttgttcccaatcgagacatcctaggatggaatgtgacacactgggattcacgaccttgtatctcctgaatgagttccaaagccagaggtcttagaca

SEQ ID NO: 5277 - DNA, 405 bp, Zea mays
  Clone ID: LIB3279-017-P1-K1-H9
cttatgctcttccatcgaagagcttgacctaacgatcaagatgctgaatgatcgaatggtacatgaaagcatacctttatctgaggagaagcgtctagtgaaagaaattaaggaccttgaaaaaactagatcgaaagtcatctctaatgctgctaacagggctaaactgcaaggtacagtggttgaaaaagaggctatacaggaccaggtcaaaatcatcggggagggcattgatggaataaagaaggaaagacaggcagtaagatctaagattaaggtcctggaggatgagctaaaacttgttgatgctgagattggattgcttcaagaagatttagatgcagcaactgccagaaaggataaagcatatgaatcgttgcaagaattgagagcagtgcgtgatgc

SEQ ID NO: 5278 - DNA, 271 bp, Zea mays
  Clone ID: LIB3279-018-P1-K1-A1
gcatctctgttgactgtgtggctactagtgaagtcagcatctcgttgactctagatccatcaaaactatggagtcgtgaattgatccagcaggaacttgatcatgtcgttgaagagcttaaaaaatttgcagttgttcatctgctgcaacgtagatcgatcatctcactgatagggaatgtacagcgatcgtcattgattcttgaaaaggcattcaacgttctgcgaagaaatggtgttaatgtccagatgatctcacaaggggcgtccaa

SEQ ID NO: 5279 - DNA, 272 bp, Zea mays
  Clone ID: LIB3279-018-P1-K1-A10
agaagttagagcctagatgatggctgcttctgttggcgtgaaagctcgagtgctcctaaatggtcgtcgtattagctgatacgacatcgaaccgatgcaatagataatattgtttacacgtgtgagtccaaaattgttggctctgggtcggagcagttaacgcgagaagtgtattttatcacttctgagtgcaaccttttttttattatttttccgagcttatgcctcttgcatatgttgtagattctcgccgagaagggagtagtagtatt

SEQ ID NO: 5280 - DNA, 272 bp, Zea mays
  Clone ID: LIB3279-018-P1-K1-A11
aaggctgatgatggaaatgaattatataatgtcttatggagcagcagcaccttctgttaggttgcttagaaaatatggactacttgatattttgctgcctttccagtcagcatatttgtctgagcagatgaaaggtggttcaagtgacagacatctgatgcttatgaaattactgtctaatcttgataggttactctctgcggaccggccatgccatagctctttgtggctggcgttgttggcatttcacagtacattggttatatatccac

SEQ ID NO: 5281 - DNA, 274 bp, Zea mays
  Clone ID: LIB3279-018-P1-K1-A12
caaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggtgtttcagctgctgtttcaaagactgctgctgctccaatcgagcgggtgaagctgcttattcagaaccaagatgagatgattaagtctggtaggctatcagagccgtacaagggtattgttgactg

SEQ ID NO: 5282 - DNA, 272 bp, Zea mays
  Clone ID: LIB3279-018-P1-K1-A2
cggacgcgtgggcaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcattgacttcactgccgcctggtgcggtccatgccgcgccatcgccccactgttcgtcgaacacgccaagaagttcactcaggtcgtgttcctgaaggtggacgtggacgaagtgaaggaagt

SEQ ID NO: 5283 - DNA, 272 bp, Zea mays
  Clone ID: LIB3279-018-P1-K1-A3
cccagttcgtctattaaaggggaaccagtgaaccacccgatgcaacttgcgtagagagttgggcgcagagaatccccaagcaaacaaacagggtagagggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagcct

SEQ ID NO: 5284 - DNA, 274 bp, Zea mays
  Clone ID: LIB3279-018-P1-K1-A4
gttgctgcttgagcggctgcgcaacaagcggctcatgttcgtgggtgactcgctgaaccgcaaccagtgggagtccatggtgtgcctggtgcagtctgtggtgccctggggccacaagacgctgcacaagttcgtcaacaacggatcgctcaacgtgttcacggcgcatgattacaacgccaccgtggagttctactgggcgcccttcctggtggagtccaactcggatgacccgcaggcgcacagcgtcatgaaccgtgtcatcgcctggcgc

SEQ ID NO: 5285 - DNA, 274 bp, Zea mays
  Clone ID: LIB3279-018-P1-K1-A5
caagcttgggcgggcctccctcagctcggccaagagcccgaccccctgctccggcaccagcgccgccaccgccatggatatggaagtgtacgagcgcctcaccgccgaaaccagtcactaccgtggcacgcgtttcgatgcgctgatcgggctcgacgaggtggagcctagtgacgaggaagaggatgaggaggaagaagagcgggcggcgggtgccggggctggagacgagctgctctgcccgttctgcagcgaggagctggacgcggtgggg

SEQ ID NO: 5286 - DNA, 270 bp, Zea mays
  unsure (1)..(270): unsure at all n locations; Clone ID: LIB3279-018-P1-K1-A6
cagatggatatcanccttttatccaggaatccacagaatacaggaggcgcgtaggactggagccgaagcagattcctgattgggtcggaaagctccgccttattaggattccatgctgcacatccgaatagttgtggctggggtctggaatgaaagaccaaatgtaacatggggctgggagaagtaactatcgccattgcggactgtgtgtcttttaacagccttattaactgtttggagtgtgtgatttgcgggatgatgtcaaaacct

SEQ ID NO: 5287 - DNA, 269 bp, Zea mays
  Clone ID: LIB3279-018-P1-K1-A7
ggaattttgtatgaggtgagttgaaggagtaattgactctttatgataactgggtagcttcaacaggaacgccggggcttggtggcattttgttcgtctgttttcttctagaagagaaacaaggggaggcaagaaaacatttaggaaacaccttttcgttaatttgattttttatttccatttttagatttagctagtctgtacactgttgttggaaatgggtccgctgttgttggtcgatgcttgtggtggccaataatactacaccc

SEQ ID NO: 5288 - DNA, 225 bp, Zea mays
  Clone ID: LIB3279-018-P1-K1-A8
cttgcacttacaatgaacattagctatcgatctcacctgctccgagtaagaagagatcaatggcgtgcgagcagggagtcgtgacctcgtgccagaggacggctgagtttgacgcacacatgaccaaggaccaggaagccggggggctggatgacattgacttcactgccgcctggtgcggcccatgccgtgccatcggcctactgttcgtaggacaccccacga

SEQ ID NO: 5289 - DNA, 270 bp, Zea mays
  Clone ID: LIB3279-018-P1-K1-A9
ggaatcatgagtgcccgcatgttcataattcatacccacatgccggtgttacatcaagatttgtcttcccaactactatgtacagccctagcatgtcagcagcagctgtcaacatatatattcctcagactcaaagctttggactgggcagtgtgctaccaccatctttacataatcaagtttccacaggaattatcgatgagagtagcagcagtgtcaattttggtgatagtgctattggattcatgaaaaggaaaaatgcagtagttg

SEQ ID NO: 5290 - DNA, 269 bp, Zea mays
  Clone ID: LIB3279-018-P1-K1-B1
gccgccgtcatgtcgaagcgaggtaggggaggttcggctgggaacaagtttcgcatgtaactgggtataccggtggcggccacggtgaactgcgcggacaacacgggcgccaagaacctgtacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagcc

SEQ ID NO: 5291 - DNA, 274 bp, Zea mays
  Clone ID: LIB3279-018-P1-K1-B10
gcagcatatgcagctccaagggctcttgtctctatatcagctggtctaaaagattttggactacttgagtctaacaggctactggttacagcatgcataatttggcacgccagaatgatcattccctttattggagactatgttctgaattggccattatatgggagagaagcatgggggggtagcatcttgggctcatccattttcaacaaggcaaaagcacttaccggaagggtgggacctttaagcaaaaataacatgtgctaaaagcaca

SEQ ID NO: 5292 - DNA, 274 bp, Zea mays
  Clone ID: LIB3279-018-P1-K1-B11
cgccctctcgccgggccgtccgattccgccatggcttccgatgagagcaaaaattcaaaaccagagaagccatcttcagcagctggtgcaggcctccccaatccgtttgatttttcttctatgagcaacttgctcaatgacccatcgataagagagatggctgagcaaattgcaagtgaccctgtgttcaaccagatggctgaacagcttcagaaaagtgctcagggtgctggagaacagggtattcctgcattggatcctcaacagtatatgg

SEQ ID NO: 5293 - DNA, 268 bp, Zea mays
  Clone ID: LIB3279-018-P1-K1-B12
cccgtcctgtccttccacccggcggcttaaaccctagttctcactcccatcgccgcttcagctccgccgctgcagatggagttctggggtctcgaggtcaagcctggttccactgttaagtgtgagcctggatatggctttgtgctgcacctttcccaggctgctcttggggaatcgaagaagagtgataatgccttgatgtatgtcaaaattgatgatcagaaacttgccattggaaccctctctgttgacaagaacccacacatac

SEQ ID NO: 5294 - DNA, 272 bp, Zea mays
  Clone ID: LIB3279-018-P1-K1-B3
cttgcttcgtgcagttatgatggccgtgtcattatttggaaagaggatgcacgaggcaattggtctcaagtccatgtgttcagtgacaacaagtcatctgtcaactccattgcatgggctccgtatgaggttgggctttgccttgcctgtgcatcttcaggtggaagaatatccatcttgacgatgcgagctgatgggggttgggatactgcaaccattgagcgagcacatcctgttggtgcgactgccatatcctgggctcctgcaacaga

SEQ ID NO: 5295 - DNA, 276 bp, Zea mays
  Clone ID: LIB3279-018-P1-K1-B4
ccactcctctcttacccttcctctcccaacccacgcagcctcactagggtttagcggcggcggcgagatggtgcagcgcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctcacttgaggcctgctgagtacaaaaggtccaggttgcctaggag

SEQ ID NO: 5296 - DNA, 274 bp, Zea mays
  Clone ID: LIB3279-018-P1-K1-B5
caacaacgacctttgcaaatttgtacaagtggttctactggccagcaaggtgtcatatacggatccaaacatcctggccataaacatgagaaaatggagcaaccaatttggcttcttgctttagaaatcgcaactggtgttcttctggttgtttctgtgattactggtatagttactgcttccagaagttgcaagctgaagccttctataagaatatcatcatggaatcgatcgaaaagttggagcgacgagataacagtgttgattgattctg

SEQ ID NO: 5297 - DNA, 181 bp, Zea mays
  unsure (1)..(181): unsure at all n locations; Clone ID: LIB3279-018-P1-K1-B6
gcgcaagcttgcctngtgtagaggcaagaacctatctagatcaatatggtggtaaagatgacgtttggattggaaagacactctacaggatgcctcttgtgaataacgacacatatctagagttggcaataagggatttaaaccattgccaagctctgcatcagcttgagtgtaatgggct

SEQ ID NO: 5298 - DNA, 271 bp, Zea mays
  Clone ID: LIB3279-018-P1-K1-B7
cccacgcgtccgcgcccaccagcagctgcccccttgctgtcgccgcctctccgcgcgaccgatctaccgccgccgccaccatgtcgctgatcgccggcgaggacttccaacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagct

SEQ ID NO: 5299 - DNA, 272 bp, Zea mays
  Clone ID: LIB3279-018-P1-K1-B8
agtggctaagactatactgaacaaggtgaaggaaaaaagtgatgacgaaggtaaaccattgcccgctgaatttgatggaaaagaaaacccggtggcaaactcaaaaaatgacaagtctgattctggtgtcgaccggagtcgagaaagagagagatcaagagggcgggaacgtgatgccaggggtagggattctgatcgtgatagcaggggtcgcgagtctgatcgtgagagggaccggagacgctgctctagggaaagaagttcaggacact

SEQ ID NO: 5300 - DNA, 270 bp, Zea mays
  Clone ID: LIB3279-018-P1-K1-B9
cccacgcgtccgcccacgcgtccggcgggtcgtgctggtcgttcagcgcgtctggagcgctggagggtgcgcactacctcgcaactggcaagctggaggtgctttcggagcagcagttcgtcgactgtgaccacgagtgtgattcatcggagcctgattcatgtgattcgggttgcaatggtgggctaatgacgacggcattcagttatctccagaaggccggtggccttgagagtgagaaggattacccttacactgggagtgatggca

SEQ ID NO: 5301 - DNA, 273 bp, Zea mays
  Clone ID: LIB3279-018-P1-K1-C1
cccacgcgtccgcggacgcgtgggctcaaatccaacgatcaatctttagatcatcccacctcatcatcaatcactcaaatggtggtgacagagtgttcctgttgcctgtggctttcatgtcgagcttctcgttctttcccatgtggaacaacacgagcctactgagacaccgcagttggtggctacctccttgactccaaggaccgcacgggggcctacaccgtggggtttagtgggtgtcaacggtaggtagaaccccacgatcggtagcgt

SEQ ID NO: 5302 - DNA, 267 bp, Zea mays
  unsure (1)..(267): unsure at all n locations; Clone ID: LIB3279-018-P1-K1-C10
ggaaggcatgtcgtgtttggccaggtcgtggaagggatggatattgtaaggctgatcgagtcacaggagactgacagaggtgaccgtccgaagaagaaagtagtcatcagcgagtgcggggagcttccagtggtctaagcgttactcatctgttgtccgtttcacttctgacggatgacgatatccccccccccccccancntnctcttgcaccttgtnnnttttatcccaaaaatttttcaacatttgtacctaatattttcaaca

SEQ ID NO: 5303 - DNA, 275 bp, Zea mays
  Clone ID: LIB3279-018-P1-K1-C11
cggacgcgtgggtcagagcagccgcatccacaacctgcctctctcgtcccctggcggcgtccgcggcaggatggcggaatctacggcgaggacggtgaaggatgtcaacccgcacgagttcgtcaaggcctactccgcccacctcaagcgctccggcaagatggagctccctgagtgggttgacattgtgaagactgcgaggttcaaggagcttcctccttatgatcctgactggtactacatcagggctgcatccattgcaaggaagatctacc

SEQ ID NO: 5304 - DNA, 270 bp, Zea mays
  Clone ID: LIB3279-018-P1-K1-C12
atctggagcgcaaaggatacacacacctgagctgttgaccaagcgtgcaacagagtgtggaatagatgtcagcactatctcgacctacattgaagtcttcagctatggcgcgcctccgcatggtggtttcggggtgggtttggagagggtggtgatgctgttctgcgccctaaacaacatcaggaagacctccatgttccctcgcgacccgcagaggcttgtgccgtaatttactgtgtccaatgccctgagtttgcagcagagcgtact

SEQ ID NO: 5305 - DNA, 274 bp, Zea mays
  Clone ID: LIB3279-018-P1-K1-C2
cgcgcttcgccctctcgctccagccgcttcacagcgccgccgctcgcctctccgaccgccgcgagaatgccgttcaagaggttcgtggagatcgggcgcgtggccctggtgaactacggcaaagactatggccgcctcgtcgtcatcgtcgatgtggtcgaccagaacagggcacttgtggacgcccctgatatggtcaggtgccagattaacttcaaacggctctcacttactgacatcaagattgacatcaaacgcgttcccaagaagtcaa

SEQ ID NO: 5306 - DNA, 277 bp, Zea mays
  Clone ID: LIB3279-018-P1-K1-C3
cttcgtcccagatctcaagcccgccgcagagaacgacaggacccaaaccccaactccacaatgaggccgtcgctgatgagatccacctcccagctcctccgccgccggagctactgcctccgcatcacgggcatgcccgagcggaaggtggccatcctcggggcggcggggggcatcgggcagccgctgtcgctgctcatgaagctcaacccactggtctcctccctctcgctctacgatatcgctggcaccccaggtgtcgcggccgacgtctacc

SEQ ID NO: 5307 - DNA, 276 bp, Zea mays
  Clone ID: LIB3279-018-P1-K1-C4
attgatgatgagggtgatgaggtcatggtggacgtagaagaagctattgaaggacaacctgaagtcaatggagtttccaatcagttgatcaaaactctgaatatcactaaagatggctcaagcagaagcattgatgttctctctgattcaacagcacaagaatcatttttggaggcggtgaagcccagtggtcgtatcaatgcatgcttggccgtagggaaagatatgctctacttgtatggaggaatgatggaagtgaaagatagagaaattact

SEQ ID NO: 5308 - DNA, 276 bp, Zea mays
  Clone ID: LIB3279-018-P1-K1-C5
accgagcagagcagaacaaacgagcccgcgtcggccaaggcgaaggaccgccacgagaactcgccggacagcgccggccgcgcgacgagactctcctcgttcattcccgacgcgcgttccagtccagtagccgtcgtggcgcctgctcgcgcagcggcggcggcgccttcttgcgaaggtgacaggagcacgccgccgtggtcgtcctctgccacctcgcccaacgtgtcgcagccttcgctcagggacatacaacagatgcagcagaagaggcac

SEQ ID NO: 5309 - DNA, 265 bp, Zea mays
  Clone ID: LIB3279-018-P1-K1-C6
accgagcatagcagaacaaacgagcccgcgtcggccaaggcgaaggaccgtcacgagaactcgccggacagcgcgggccgcgcgacgagactctccttgttcattcccgacgcgcgttccaatcgagtgttccgtcgtggcgcctgctcgcgcagcggcggcggcgccttcttgcaaaagtgtcaggagcaccccgttgtttcctcgcgacccgaagaggcctaacgtgttttatactgcgttcaaggacctgcatttgatgcat

SEQ ID NO: 5310 - DNA, 272 bp, Zea mays
  Clone ID: LIB3279-018-P1-K1-C7
ggaaaaactggcacatgtatgactacattgtgaaggaacttccaaaagttttaagtgataactttgaacagctcaacacttcacaggcatcaatttttgggcactcaatgggagggcatggcgcgctgacaatttacttgaaaaacactgataaatacaagtcggtgtcagcatttgctccaattgccaatccgataaactgcccttggggtcagaaagcattctcaaattacctgggctcaactaaatcagattgggaggaatatgacgca

SEQ ID NO: 5311 - DNA, 272 bp, Zea mays
  Clone ID: LIB3279-018-P1-K1-C8
gacaagacctaccctgctgggttcatggatgtcattttcatccgcaagaccaatgagaactacaggctgctgtacgataccaagggccgcttccgacttcacccaatcagggatgaggatgctaagttcaagctttgcaaggttaggtctgttcagtttgggcagaagggcattccgttcctgtacacgtatgacggtcgcaccatccggtaccctgacccgttcataaaggccaacgacaccatcaagatcgatctggagaccaacaaaat

SEQ ID NO: 5312 - DNA, 273 bp, Zea mays
  Clone ID: LIB3279-018-P1-K1-C9
cggacgcgtgggcggacgcgtgggcaaatcttggtcctacattggacaaagcacaagctgcaaagatacaggagcaggaaggcctacttagagcagcagtaaattatggtgaaggattacgggtacctggagatcagaggcatccacaatctcttcctatccatctgatagaagtgcttcctttaggagacggtgcacaaaattttggtgatagttctggtagttatcccaaaaatatgtcaacatttgcacctaatagtgtcaacagccagg

SEQ ID NO: 5313 - DNA, 273 bp, Zea mays
  Clone ID: LIB3279-018-P1-K1-D1
gttggacttcgttgtagccaatgccattggaacaagtcctctcagatcatgatagcgaagacgaggttgatgatgacattgccgactttgaggatagacggatgctcgacgattttgttgatgttacaaaagatgagaagcttattatgcatatgtggaattcatttgttcgaaagcaaagggtgctagccgatggtcatataccgtgggcatgcgaggcgttctccagatgccatggacaacagcttgtacaaaaccctgccctgctgtggt

SEQ ID NO: 5314 - DNA, 274 bp, Zea mays
  Clone ID: LIB3279-018-P1-K1-D10
ctatgctgggagaacaggtcgcggggccttcagggcagatgacgtggattcgcggcgggccgacatctctcgattcacgtaacatcgcagaggcaatcgatggcagtttgcgcaggctgggtgtggactacatcgacctctaccagatacactggccggatcggtatgttccaatgtttggggagacagagtatgatccgaactgccagtacacgtctgttccaatggaagagcaactggaggctctcggaagagcaatagatgctggcaaggt

SEQ ID NO: 5315 - DNA, 274 bp, Zea mays
  Clone ID: LIB3279-018-P1-K1-D11
ctgttcccgagcccgacgccttgccgcccctgccctgctaggctgctacagaggaggagaacccccagattttcccacccccatggcaacgcgcgcgccgccgcagtcttcttcgaccggatccgtgacggtgacgatcgacccgtccccctcgtcgtcgtcctcctccgccccgcccgcgtcggcgccggccccggccccggctcctgagtcggtggtgctgcgcctgaagcgccgggctaagaagaaggtgtcgtggaaggaggggacggtg

SEQ ID NO: 5316 - DNA, 275 bp, Zea mays
  Clone ID: LIB3279-018-P1-K1-D12
atgcctgcaacaatgcgtgcaatacatccgatttactttgccaaatgtttgacaaaggtaagcgataaataattatttgaagagtgcagacaccacaaaccagcagcacttggaatagtgaaaatggtcaagctgataaagatgctattaacgaaaggacagacccagtgggcagtggcccgttctggtggctcccacatgagtagggtctagacaaggaataaccaaggcaagctttactcctgcattttgcagagaggctgcattgaactagg

SEQ ID NO: 5317 - DNA, 220 bp, Zea mays
  Clone ID: LIB3279-018-P1-K1-D2
gcaaagaaaattactcattttaaaagagcaccgattatccgatcgaacacaaggccacaagggactaacagcaattatagagcaccacggcgctggcacagatggacgtatccagtcacacgggccattgctgctgatatacgacacgagacacgagaggatagcagggccctgacaagacccaaatgggaccatgtcgaattattgccgcatgcacaga

SEQ ID NO: 5318 - DNA, 271 bp, Zea mays
  Clone ID: LIB3279-018-P1-K1-D3
caagctcaaagaaggctaagactgatgacgacgatggctcgaagtccgaggtcgatgatgaggatggcggtagtgacgaggaaaacgacgacgacgagtaaatagtatctccgctgtcgtgaggtagcaaatcgattgttaggtccccaattagctcactggtttgctatctttaatgttaagttgtttggaacaggtgtttatgaaggggatctattagtttcgtgaggttgttagtttagtgcattagcaaagaaaaagccgaatgctg

SEQ ID NO: 5319 - DNA, 273 bp, Zea mays
  Clone ID: LIB3279-018-P1-K1-D4
tccacgcgtgcgtacaacttatgagaccatgtatgtgtccgatcctgactttgatccaccgtatgatgctaggaaagctgctgaatcagatgctgagtcaggcatataggtagccattaccgttcacaagactgatggcagggctgacggaagggctgactcaagggagtccactggagatcctgctgatactactgatgatgctaccggtgcagcctacggcgagacctatggggtgcaagagaaggcgccagggaagtcagcaggaaaagc

SEQ ID NO: 5320 - DNA, 276 bp, Zea mays
  Clone ID: LIB3279-018-P1-K1-D5
cccacgcgtccgctccctctccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcg

SEQ ID NO: 5321 - DNA, 216 bp, Zea mays
  Clone ID: LIB3279-018-P1-K1-D6
gcgtcgagaaagtgtggaagaaccaccaagagctgttgcggcggaagacagctattctgccagattgattctatggaacaaaacgcaaggtcgtgggcgtggcaggaaaggagagatcaggatggcacgtgatcttacaaatttgcgtactgttactaagcacactggtgattgatgagattgtgatgaccagcttgatctaatgtctgtttgaac

SEQ ID NO: 5322 - DNA, 274 bp, Zea mays
  Clone ID: LIB3279-018-P1-K1-D7
accgtcactcaacacagcacaggcagttcgagagagagagagagagagagagagataaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggca

SEQ ID NO: 5323 - DNA, 273 bp, Zea mays
  Clone ID: LIB3279-018-P1-K1-D8
gtttagagacaaggataggaaaaagaaggatgagaaacatagagactttggttcaagagaaggtgagagaaatgatcgtcggaccggtatccagcttggaggtagtggagttgagcgaagagaaatgcaaagggaagagagggatgctgaaaaatgggacagggaaagaaaagattccttgagagacaaggaaggcaatgatagggaaaaggattctgctaagaaagatccatctatggtaatggaaaaggataacacaatagttgaaaaact

SEQ ID NO: 5324 - DNA, 271 bp, Zea mays
  Clone ID: LIB3279-018-P1-K1-D9
gtcgtcttcatgcatgcgtggttcgtggtttcccctagctccatacgagcagtagttgggccttgcacgtaccgtacgtctagctagctatatatatagcttgtgttctactgctttttagtttaattacctgcctgcattggagagttggatctgtttcatttggtggtgtttgctttactattaggtcagtatctgtttgtggagacttggtgtttaatttatttagccgtttgtgactggttgtagctagcggtggtgcggtggtgat

SEQ ID NO: 5325 - DNA, 272 bp, Zea mays
  Clone ID: LIB3279-018-P1-K1-E1
cagagttgcacggtcgccaactcaaggtggcaccgaagaggactaacgttcctgggatgaagcaaccccgcggtcgaggtttcaatccgtaccatggccacccctacatgaggccgtatggttatagtccttatggttatgggagattccccagattccgccgcccgcgaagaccttatttttgaagctcggttcccatttggcagaacatgggcgataatcggccgcgttctgttatttcatagcttattcgggacgttcccatgcatgtt

SEQ ID NO: 5326 - DNA, 274 bp, Zea mays
  Clone ID: LIB3279-018-P1-K1-E10
cccacgcgtccggaggggaggcgcgacaaaaagggcgccgcgcccccgcatcgcccccgacgccggcatctctccctcgctctccttctcccgatctgatccgaagcgcggcgtcgacgacgacgacctaagggcacgatgcattcgaccaacctgctgctggaggagcccatccggatggcctccatcctggagccatccaagaccagtttcttcccggcgatgaccaagatcgtcggcacgctcggccccaagtcgcgctccgtcgacacca

SEQ ID NO: 5327 - DNA, 273 bp, Zea mays
  Clone ID: LIB3279-018-P1-K1-E11
cccacacatccggagcggtcgaccccaatgtcactgaagatatgttgaaacaagttttcaccccttatggggacgtagtccatgttaagattcctgttggcaaaagatgtggttttgttcaatatgctaacagatcttcggcagaggaggcattggtaattctgaaaggcaccttggttggagggcagaatgtgaggctttcatggggtcgcatcccttcaaacaaacaagttcagcctcaactggactccatccagtgtgccggtgctaatg

SEQ ID NO: 5328 - DNA, 273 bp, Zea mays
  Clone ID: LIB3279-018-P1-K1-E12
gtacgggttcacgttcgccacgacgttaacggggctgcatttcgcgaccaccaccgtgatgaccctcgtgttccggtgggtcggcctgagccagccgtcgcagcttccgttaccggacctagccaagttcgtggtgttctccaacctgtccatcgtggggatgaacgtcagcctgatgtggaactccgtcggcttctaccaggtagccaagctgtgcatgatcccggcgtcgtgcctcctggaggtggtcttggaccgcgtgcactactcccg

SEQ ID NO: 5329 - DNA, 275 bp, Zea mays
  Clone ID: LIB3279-018-P1-K1-E2
cgaccccgtgcagcgcatggtgttcatcctgcagggcaagctccggagcacgcagccgctgaccaagggagtggtggcaacgtgcatgctaggggcgggcaacttcctaggcgacgagctgctgtcgtggtgcctgcgccgccccttcgtggaccggctccccgcgtcgtcggccacgttcgagtgcgtggaggcggcgcaggcgttctgcctcgacgcgccggacctgcggttcatcaccgagcacttccgctacaagttcgccaacgagaagc

SEQ ID NO: 5330 - DNA, 275 bp, Zea mays
  Clone ID: LIB3279-018-P1-K1-E3
cccacgcgtccgctcactccggcctccagcttttcctttgcgccccagggccggaagagcccacacaccaccaccaccactagatagccagcgacgatcgagccgcgcgccggtggacgcgcacatacacgcggtagcttccttctcaagcctagctagccccatcctgcgcgcaggcggcggcagcgagaattgacgtgcgacgacgagcttgtgcttgctagctagagagcgaggatgtcgagccggaggccgtcgtcgcgtggcaacatctc

SEQ ID NO: 5331 - DNA, 274 bp, Zea mays
  Clone ID: LIB3279-018-P1-K1-E4
gtggttagacgacaggaagaagaagattgggaagctgctggactcgaatgggcttgatatgaaaatggcgtacatgctcgacacgcaggagtctgcagaagccaagtacaagaagtgggagaaggaacctgctccatatgggtgggatgttttcaatcaaaagaccttgtatgacgcatacaagaagaggaccaagaacatagaagttgacatggagtcttacaataaagccaaagaagctgatcctgaattctaccgcgacgcctcaagtctc

SEQ ID NO: 5332 - DNA, 275 bp, Zea mays
  Clone ID: LIB3279-018-P1-K1-E5
cccacgcgtccgcgacccgccgcctgtagcccttcccgtctctggagtctggaagcttcttcctcctcgcctccgactccgtcatggccggcggcaacctgttcgggcgggcgctgagctacgtagtcaacgagctcctcgtcgagggcctcgccaacaaccgtgcattccagaggttcgctgtgaagaccaacaggactcttgagagcctatcgtctaaagctaaggaagtgagggaggagttatcggaacaattgaaggaagctcgtggccag

SEQ ID NO: 5333 - DNA, 297 bp, Zea mays
  unsure (1)..(297): unsure at all n locations; Clone ID: LIB3279-018-P1-K1-E6
ggcgcggacgcgtatgcgaagcgccacctctaaaccttaccgtgtatggagtctgacagcttctacctcctcgcctccgggtccgttatggccggggcaaacctctcagcttccgttaccggacctagccaagttacgtgttgtnttttccaacgctcctccatcaactaatccgttgcataggcaaactgtgttgttggagaataccatacatggactattgaggggccttttatgcctatagataagaaactcgtgcctcctggaggtggtcttggaccgcgtgcactactcccg

SEQ ID NO: 5334 - DNA, 271 bp, Zea mays
  Clone ID: LIB3279-018-P1-K1-E7
cgccgccgcaacaaccatttccttctctagccgccgcctccgatcccctcccgaggctacagaaccagttcatccaggcgcgaatggcggcggcgaggagcctgcttctgaggcacctccgcttggcggcggccccgtcagcggcgtccgtgaggccgacggcgtcgttgcatgaggccctgtgggggcagcggtggatgtcttcggaggatgccaagggctctttcctggataagagcgaggtcactgaacgcatcatcaaggtcgtcaa

SEQ ID NO: 5335 - DNA, 271 bp, Zea mays
  Clone ID: LIB3279-018-P1-K1-E8
cccacgcgtccggcttctcctccccctccggttcgggttcgggttcgtgaggttctccggggttcggtttcgtgggtgagcggatcgagatggcggcgtcggatgttgagtaccactgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggc

SEQ ID NO: 5336 - DNA, 272 bp, Zea mays
  Clone ID: LIB3279-018-P1-K1-E9
cggacgcgtgggctggtgctccgcctcaggggtggtatgcagatttttgtgaagacattgactggcaagaccatcaccttgggaggggagtcgtctgccccaatcatattgcaaaacccaaaatccaggccagggagggctttcaaccgaaccagcagcgcctgttctttgtggcaagcaacttgaggatgggcgtacccttggcgacttccacattcaaaaggagagcacccttcacctggtgctccgcttgcgaggtggtatgcaaatct

SEQ ID NO: 5337 - DNA, 274 bp, Zea mays
  Clone ID: LIB3279-018-P1-K1-F1
cttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgt

SEQ ID NO: 5338 - DNA, 272 bp, Zea mays
  Clone ID: LIB3279-018-P1-K1-F10
cggacgcgtgggcataaatagagtgaatggtgaagatgactacatatttgagacttctcctttagagcagaatttaagatggaactatgcaccggaattgctgggtgagcctagtctttctgactcaaatgaaacaccaaagcagctgcctatagtcatcagtgcaaaacgaaccggcaacatagctcgctttatgaaccacagctgctcacctaatgtgttttggcaaccagttctctatgatcatggtgatgagggatatccacatattg

SEQ ID NO: 5339 - DNA, 274 bp, Zea mays
  Clone ID: LIB3279-018-P1-K1-F11
cccacgcgtccggcggaaggagggagagacaaccggcgatggcggcgtccgcgaggcccggggatagggcgaccagcttcgccgtcgcgtgcagcctcctcagccgcttcgtccgccagaacggcgtcgcggctgccgagctaggcctcaggatcaaaggcgaggtcgagcagcagaggacgccggcgacaactaacttgctccccggagcggagggcgaggaggtcgaaaggaggaaggagaccatggagctgttcccgcagagcgtcgggtt

SEQ ID NO: 5340 - DNA, 273 bp, Zea mays
  Clone ID: LIB3279-018-P1-K1-F12
cggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccg

SEQ ID NO: 5341 - DNA, 274 bp, Zea mays
  Clone ID: LIB3279-018-P1-K1-F2
ccgccttctgctccacagaggcactccctgcttccgcggttatggcaggcgtaatggtgagcgcaggaggaagtctgtccgtggttgtattgtgagccaagacctatctgttatcaacttggtaattgttaagaagggtgagaacgatctgcctggtttaactgacactgagaagccaaggatgaggggtcccaaaagggcctccaagatcaggaagctgttcaatcttgcaaaggatgacgacgtgcgcaagtacgtgaacacgtaccgcagg

SEQ ID NO: 5342 - DNA, 275 bp, Zea mays
  Clone ID: LIB3279-018-P1-K1-F3
caggaaagctctgcgctacttggatctttgctgggagaaagaagagatagatgaagataagagcacagcactgcggaagaccaagtcaataatactcactaatagctccgcatgcaaattaaagttaggagattcaagtggggctttattagacgcagattttgcactgcgtgaaagggagggaaatgctaaagcttttttccgacaaggacaggcacacattgcacttaatgacattgatgcagccgtggagagctttaaacaggcattggagt

SEQ ID NO: 5343 - DNA, 276 bp, Zea mays
  Clone ID: LIB3279-018-P1-K1-F4
aaacccgcatccataaacaagaaaaagaaaagaaaacccccgctgccagcgacagaagaagaaggggtcccttctccttggttgcgttgcgcctccctcctgtctgcgtgcgtgcaatcgacgcagaggcgcgggcgctcgcaccaccacaaccacgacccgatggctttcatgcgctcccgctcaaatgcatcttctggcatgggagttgctcctaacattagggagacattcgtcgagcttcaaatgaagaaggcattccgatatgttatcttc

SEQ ID NO: 5344 - DNA, 275 bp, Zea mays
  Clone ID: LIB3279-018-P1-K1-F5
ccgcttcctcccgttagactaggttaggctaggctagggtgtcgaccagctcgcggtaatggtggccttcaggttccatcagtaccaggtggtggggcgcgcgctgccgacgcccggcgacgagcaccccaagatctaccgcatgaagctctgggccaccaacgaagtccgcgccaagagcaagttctggtacttcctgaggaagttgaagaaggttaagaagagcaacggtcaggtcctggccatcaacgagatcttcgagcgtaacccgacga

SEQ ID NO: 5345 - DNA, 274 bp, Zea mays
  Clone ID: LIB3279-018-P1-K1-F6
gctgggaatattcagaatcaatgtttggatttgtgtttagtaaatttaatcactgggtcagcactgaacgtcatggttcagcagctgcttgtttctgttggctcccctagcaatgctcttgtgctcaagattccaattcagggtgttgtggatgcacttcataggaaaacactccagggcacaggtctgaatgaagagcaaatgagacaggctagcgtcgcagacaatggtcatcgtcagctaaacaagatacttgttgacttggatcaagata

SEQ ID NO: 5346 - DNA, 272 bp, Zea mays
  Clone ID: LIB3279-018-P1-K1-F7
gttacagtcctccgtcgtcgtggcgctgtaggaggccgccgaggcgtacctggtgggtctattggaggacaccaacctttgcgccatccacgccaagcgcgtcactatcatgcccaaggacatccagctcgcgcggcgcatcatgggcgagagggcttgagcgcccgtcgtgctgctcgtcgttgtagtgttactagaagtagatggtggctttcgtttcgtggcttccttatcctgtaggagtaatgttctagatgtcttggcttcagtgc

SEQ ID NO: 5347 - DNA, 274 bp, Zea mays
  Clone ID: LIB3279-018-P1-K1-F8
ggatgagttctcaaagttgagaagatggtggaaaggtgtcaatatattaaataaagcatacataatcttgccgatccatgggatggcgcactggagcttggtaatcatttgcattcctgcaaaagagagtatttcaggaccaatcatacttcatctggactccctagcgatgcatcccagtactaagatcttgaacacagttgagagataccttgaaaaagaatggtgccaattatcatcatgggaggattttaaaaataatatacataagcaa

SEQ ID NO: 5348 - DNA, 274 bp, Zea mays
  Clone ID: LIB3279-018-P1-K1-G1
ggcgccgtcgccgccgcaggaaccgtgggagattgtttttaggtgctaattgagaggacaggtggccaggtagggtttagccgccagaggagtacatacagaaatgcttccctggtgcctggcattcatcaattcctgcctcaatttacttgatcatgatcatgtaccaagtagttatcttaacatcagctcattgtcataaatttatgttatctcacattcttcgttgaaaaaggaaaacaccgcatccatctcttgcggtttgtgtagcatc

SEQ ID NO: 5349 - DNA, 271 bp, Zea mays
  Clone ID: LIB3279-018-P1-K1-G10
cccacgcgtccgcccacgcgtccgtccaaaacgcttatgttaacatctcgattgctcgaatttgtgatgaagattgttgtgctgattgttctggcaactgtttatcagcgccagttccatgttcttgtgcaagaataacagggggcgagttctcctatacacttgagggcctgcttaagacagcattccttgatgaatgtaccgcagtgaataatttcctacaagagcaccataggttctactgtccagtttgccctcttgaaagatctaa

SEQ ID NO: 5350 - DNA, 274 bp, Zea mays
  unsure (1)..(274): unsure at all n locations; Clone ID: LIB3279-018-P1-K1-G11
cccacgcgtncgtccacgcgtncggccgcagcatcgtcgccatggttctcctcaaaaactccttatgcttcaagggccggtgcgccatgcgggggcggcgctcactgcgcggcgccacgcggcgacgtcgacggaagagtacgcgcgccggaactacgccgataacaactccgagtacaacacggtcatcggatcgctcgtcgctcagcgcaagcccctaccttctgcgtgatgcttacgacgacatgatgcttgatggcgtgaagcctgagcg

SEQ ID NO: 5351 - DNA, 272 bp, Zea mays
  Clone ID: LIB3279-018-P1-K1-G12
tatcctacaggtgatttctgttgatcacagtcaatcattactcttgtagcacaggacatcaaacattggtattcagtcctatcaggagttcctgaatctggatccaaggaatcgtcccttagtggattgataacctcctcctgtgaccatttttcaaggccatgtgatttagttgcttcctcaaacttctgccttacataagctccatttctcatgtcagatgtatttacctctatcacattgaagccttgttctctggcgcatgcaaaaac

SEQ ID NO: 5352 - DNA, 252 bp, Zea mays
  Clone ID: LIB3279-018-P1-K1-G2
tttgcattggagcagttggaagccaactctggcccagttgaagtttctgagttgactggcccggatgtcatgggggagaagtgtgcttctgctgccatttgttttgtatcattccttccagacatcctcgattcaaaggcagagggaagaaacaagtaccttgagctcctgctctcggttgcctgtgaagtattaacagggtccatacatttttgtctggacagctgttgaaaagcaagctattttttaaac

SEQ ID NO: 5353 - DNA, 275 bp, Zea mays
  Clone ID: LIB3279-018-P1-K1-G4
cgcgtctctttcctattcgcgccgccgccgctgccgctgctgcaagcgccagctcgccgtcgtccgaatagtacactctaacgccgccatggggcgtatgcacagccgcgggaagggtatctcgtcgtcggcgctgccgtacaagaggacgcctcctacctggctcaagaccgccgcctccgacgtggaggagatgatcacaaaggcagcgaagaagggacagatgccgtcgcagatcggcgtcctgctccgtgaccagcacggtatcccccttg

SEQ ID NO: 5354 - DNA, 275 bp, Zea mays
  Clone ID: LIB3279-018-P1-K1-G5
agcgaaccgacggcggcgatggggatcggtgagcacttcgagggcgtcaagcatcactgggcgagcaacttcgccttcctcgactacttcaagaaggtctacggccgcgccgagcccctccccaagtggtccgacgccgacgtcgacgagttcatcgcatccgacccggtctacgggccccagcttaagggccttgcggagagtaaggaagtccgcgctcgccggggccctcgtcggcgccgcccacctcggcggcgtcgcgctcaagtactcca

SEQ ID NO: 5355 - DNA, 272 bp, Zea mays
  Clone ID: LIB3279-018-P1-K1-G6
cggacgcgtgggcggacgcgtgggcggacgcgtgggccgcgagctggtcacggacgccaacttcgactgctccgggaccgggttctcgctgcaggccatggactcgagccacgtcgcgctcgtcgcgctgctccttcgcgccgagggcttcgagcactaccgctgcgaccgcaacctctccatgggcatgaacctaaacaccatgccaaaatgctccgctgcgctggcaacgaggacatcatcaccatcaaggctgacgacggctccgacac

SEQ ID NO: 5356 - DNA, 274 bp, Zea mays
  Clone ID: LIB3279-018-P1-K1-G7
ggagggcatccctccagaccagcagcggctcatttttgccggcaagcagctcgaggacgggcgcacgctggccgactacaacattcagaaggagagcaccctccacttggtgctgcgtctcaggggcggcatgcagatcttcgtgaagactctgaccggcaagactatcacccttgaggtcgagtcttctgataccattgataatgtcaaggccaagatccaggacaaggagggcatccctccggaccagcagcggctcatttttgccggcaag

SEQ ID NO: 5357 - DNA, 274 bp, Zea mays
  Clone ID: LIB3279-018-P1-K1-G8
ttttccccactcccgggtctccagcattcctatcctctccccgcccgcccgtgccgccgccgtcgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaa

SEQ ID NO: 5358 - DNA, 171 bp, Zea mays
  Clone ID: LIB3279-018-P1-K1-G9
gcgcgcgcaccaccaccaccatccaccacccacacccccacggccccaccctgaccccgacccgatcccgatctgagcgtctccacccggtcccgctcccacctgtctccaacagaacaacagaatatgatcaatcaagacagccccgtgctagctcacccgccggggctg

SEQ ID NO: 5359 - DNA, 274 bp, Zea mays
  Clone ID: LIB3279-018-P1-K1-H1
tatcctacaggtgatttctgttgatcacagtcaatcattactcttgtagcacaggacatcaaacattggtattcagtcctatcaggagttcctgaatctggatccaaggaatcgtcccttagtggattgataacctcctcctgtgaccatttttcaaggccatgtgatttagttgcttcctcaaacttctgccttacataagctccatttctcatgtcagatgtatttacctctatcacattgaagccttgttctctggcgcatgcaaaaactg

SEQ ID NO: 5360 - DNA, 271 bp, Zea mays
  Clone ID: LIB3279-018-P1-K1-H10
ggaggggccgggcctgagcagagcaggccggaccagctatctctcctctgaggcgtcgaggggaggcggcgcccgagatgggggactccggcggctccgtcgtgtcggtcgacgtcgagcgcatctcctttggcggcaaggaacaccatatacaaacgaatcatggacctgtatctgttgcagtgtatggtgaccatgacaagcctgcccttgttacttatcccgatattgctttaaactatatgtcctgcttccaaggactattgttctg

SEQ ID NO: 5361 - DNA, 273 bp, Zea mays
  Clone ID: LIB3279-018-P1-K1-H11
cccggaacagagcgaggcgacgccgaggcacctcatctccggcgaagggaaatggcgaccgttccaggggatctgatctggcagattgtgaggaagaacaactccttcctggtgaagcagtttggcaacggcaatgccaaggtgcagttcaccaaggagcccaacaacctctacaatttacactcctacaagtactctggcttagcaaacaagaaaactgtaacgatccagccagctgctggaaaggactcggctgtggtcctctctactacc

SEQ ID NO: 5362 - DNA, 273 bp, Zea mays
  Clone ID: LIB3279-018-P1-K1-H12
acgctctctaccgtccgagaccccaagcaccagcgcggcggcgggggcgggggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcct

SEQ ID NO: 5363 - DNA, 277 bp, Zea mays
  Clone ID: LIB3279-018-P1-K1-H2
ccagcaagcaaaaattccccaatcctctcgtctccgcggctaaaatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcg

SEQ ID NO: 5364 - DNA, 255 bp, Zea mays
  Clone ID: LIB3279-018-P1-K1-H4
ctcttcctctcccccgcggcggagccataaaccctaggcctcgccgtcgtcggaggcgccgccgcgatgtcgcactttggaaggacgggtccgccggacatccgcgacaccttctcgctgctcgtcctcaacatcagcttccgaaccacggccgacgaccttttcccgctcttcgagcgctgcggcaaggtcgtcgacgtcttcatcccgagggaccgcaggaccggggactcgaggggttttgcgttcgtgcgg

SEQ ID NO: 5365 - DNA, 274 bp, Zea mays
  Clone ID: LIB3279-018-P1-K1-H5
cggacgcgtgggcggcgcgtgggtgcacgacgccactgccgtggtaacacgcgatccccgctcgctctcacgcgggtgcgagattcatgtggtctttgcgccaccgctttagggcttattcgtttctgtcggattgcaccagaatcgttccagctaatcaaagtttatataaattagagaagcaatccggtcaggaatcgttccaacccactaatccggcacaaacgaacaaggccttaggaaaattgctgctaaattgtgtgcgttaccctgt

SEQ ID NO: 5366 - DNA, 124 bp, Zea mays
  Clone ID: LIB3279-018-P1-K1-H6
cggtcgaccacgcgtccggactatagctacaccagaaattgaagataagactaactaggaaggtatgaaaaatcaagaacgtgatagaaccaggcgactatgtactgcatgacacctctattga

SEQ ID NO: 5367 - DNA, 271 bp, Zea mays
  Clone ID: LIB3279-018-P1-K1-H7
tttttaaccgtttgagactgcagttagttgtgatgtgctttgttgttcttacgatgaatgtgccggtctagtttcgtctgggttggcccctctgcttggccgcgtttgtcgtttagatctatccaaatatcatcgtttgttgatttcgaaattggggctgttttgctcatgatttcagttcaaacttcaccatgcttcatgttttggaattgtaattggtggctatgttaattgtctagacaattgtttagacttcagttcagatttgtgg

SEQ ID NO: 5368 - DNA, 269 bp, Zea mays
  Clone ID: LIB3279-018-P1-K1-H9
gcaacacacacggactgattcgaatgatgtaagagatcacaaaggttttcctaaaggggcatcaatgctgtgcgggacatacatcgcaggtggtcggtacctgtggcctgtgctggaagtcatgaaaagatgcctggaagcacacacggtctatgagtcacggctgatgattacatctccaccgggagcatgagaggcgttccttgttttgtggattccaactacgatgacccactagcgcggattgatgtgacacattgttcgtgctg

SEQ ID NO: 5369 - DNA, 211 bp, Zea mays
  Clone ID: LIB3279-049-P1-K1-A1
cccacgcgtccgctcttctcaccagcggagagaaagcaaaccctagtccccgtcgtcgccgccggcaaccctcggatctgcggcgagcgccacagcggttagatcgaatccacccagggggagattgaagcccctttgtctgggaatttcgcggggaagcaagcggttggtgatttggtggtgaaggaggctatggggtcgtcgtccaaag

SEQ ID NO: 5370 - DNA, 375 bp, Zea mays
  Clone ID: LIB3279-049-P1-K1-A10
agaaaatagagcctgctccgcagaccaataagcccaaaggcgccatcaaccgagagccttcgtcttccttcttcatcctttgctcctcttcaaacgctcgagaaagagagagagagacgaaaccctccttcgaaaccctagcatagccactgccttccctcacgctaggaaggggaagatatgggcgccgaggaggacaccgctgcacgccgagagcgtctccgcgccctccgagccgtcaaggacctcctcttcaccctcgacggcgccccaacccctgtcaccgacggagaacaccaaaatggcttccatgagatgggttaaaagccagaattaccaggtccttaagatgcacctggtgaggctggtaaagag

SEQ ID NO: 5371 - DNA, 374 bp, Zea mays
  Clone ID: LIB3279-049-P1-K1-A11
cccacgcgtccggtgaagtcttcgatgattgggaaatggctgctgatgcgctttatgtcgatgacagttctgtaaccagagttcaggtcccacaccgacactcccacaagctccgaccactgcagaaccttctcatgcagcgaaaccagaaccgattcaaagcaagacaagggcttgggcaccggatgacatatttcgaccacagagcttacccagcatctccaagcagaccagcttcccagcaagcattggtaaccgctggcaggatatgggaatgagtgctgcacagcagggaattctttcattgccgctgtcgtgccccatttgctgtgacgatcttgacctgacagattcgagcttctgtccctgtcctt

SEQ ID NO: 5372 - DNA, 332 bp, Zea mays
  Clone ID: LIB3279-049-P1-K1-A12
ccggtctcgagtctcgacagatcggcgtcgatgaccctaccactcgctggccctcccacgccttccccggatggccgagcccaccccaccgtccctacccttgtacgactgcgcagacgtgctcgtgggatcctacgccccctccttcccctacatccgcggctggtcattcccctccgactcgggcgctgccatgggttctgtagaggaacatctccagcccaaggtgtgcgtgcagacaagcaccttcgcggggcttgagcagatcctgccctggctcttctatcacaaggtcgtcggcgtcgcgcatttcctgctcttcgtggagggca

SEQ ID NO: 5373 - DNA, 223 bp, Zea mays
  Clone ID: LIB3279-049-P1-K1-A3
cctgattgttcatgccctgcaaaaaggaatcgcccaattacatggttggtttcggttaaaatgagtgatgttttaatggtgttattaatcaagggcctggatattctttttttttgcttttattgacattagatgtacacttgatttatggatatgttttgtgtcttgggttacattcttttctgtacacatatagtttcgtttgtgtttttcatttcatctg

SEQ ID NO: 5374 - DNA, 339 bp, Zea mays
  Clone ID: LIB3279-049-P1-K1-A4
cggacgcgtgggttgagtttcatctttaagtttccctttattatctgtttgagattttggagaaaaacaaatcaatgttgattttattgaatttacttgagataaggggaccatgcaagtatcggtgcaacagttttatttcagttgctagtttgtacaaaaatcagttatggtggatataatttagggtgttgagactaaagctcgacaaataaaattaatacagtaataataattaaggagatgtttgcgactactccgatccaccattttaagttctggtccaccaactacaccatgaagttgtttcatgatcgaagtttttagaggttttaaact

SEQ ID NO: 5375 - DNA, 359 bp, Zea mays
  unsure (1)..(359): unsure at all n locations; Clone ID: LIB3279-049-P1-K1-A7
cccacgcgtccgctcttctcaccagcggagagaaagcaaaccctagggcccgtcgtcgccgccggcaaccctcggatctgcggcgagcgccacagcggttagatcgaatccacccagggggagattgaagcccctttgtctgggaatttcgcggggaagcannnnnntnnnnnntnnnnnntnnnnnnnnnnatggggtcgtcgtcgaaggtggtgcggccggaggaggtgctggagtcgctgaagaacgacggcagcatcgacgcgctccgcatgaagatcatcgcccagctcaaggccaacgaagatatgaagaaaaacactatgatgatggtggagcaaagcaaggtactgaatac

SEQ ID NO: 5376 - DNA, 370 bp, Zea mays
  Clone ID: LIB3279-049-P1-K1-A8
cccacgcgtccgctcttctcaccagcggagagaaagcaaaccctaggccccgtcgtcgccgccggcaaccctcggatctgcggcgagcgccacagcggttagatcgaatccacccagggggagattgaagcccctttgtctgggaatttcgcggggaagcaagcggttggtgatttggtggtgaaggaggctatggggtcgtcgtcgaaggtggtgcggccggaggaggtgctggagtcgctgaagaacgacggcagcatcgacgcgctccgcatgaagatcatcgcccagctcaaggccaacgtaaatttgaagaataacactatgatgatggtggagcaaagcaaggtactgaatactcctggagctg

SEQ ID NO: 5377 - DNA, 238 bp, Zea mays
  Clone ID: LIB3279-049-P1-K1-A9
tccatgcgtccgtatttgttacctgtcgccagatagccggccctagggtccatagacaaacccggccaccctccgattttctgccagctccacactccctagatccgtttcttgcaccgggagattgtagcaaatacgctaaccaatttacctgtcaagaaggcggcggctgagccggctgccaacgaagccatatgcccatccttcgaggtgtctaaccagaaggagtctgcttcaa

SEQ ID NO: 5378 - DNA, 156 bp, Zea mays
  Clone ID: LIB3279-049-P1-K1-B1
cccgaaccaaatcactcccaccgtgtccacagcaaccagcacacattcacctttgtcggatcgaaggaaggaaggaaggggtgatgggtgacggtatggaggtccacaaaaaccggtggatcgaagagtgcaactaccacctcgagaacttatagt

SEQ ID NO: 5379 - DNA, 372 bp, Zea mays
  Clone ID: LIB3279-049-P1-K1-B10
tgagatgccagtcccttctccagagtcactaatatttgagccttttattgaaaccgatgaaattatcattcaaataaattagaggatggtagtgcccgccatcttgtatggaaaggtgaaaatgactggcttgaaataaccgttggtgtagttggcaaacgtggagaaatgcactcattaaatccaagtatcacagtgaaagaaagtggtgatattttatctcttgaggagaaatttcaaggtggcactggaatcaacttgacaccacctcctgcaacaattatgggcgaggatgctctgcagaggtgcaagaagagtatcgagaccatggcaaacgctctaggtttggaaggcttctcacgcattgatgca

SEQ ID NO: 5380 - DNA, 255 bp, Zea mays
  Clone ID: LIB3279-049-P1-K1-B11
cggacgcgtgggctcgcgctctcgtttcgtcgctacgctggcttccagtgccgggcttagcaactgtgctctgttgcactgcacccggcgcacgcagagatgcgccgagtcaggacgggtgtgaggatgctttgcggcgcggcgctgtcagtgcttctgcttctcgcgggcggctcggcggcgtcagactcacgctcgtagagccccgtcacgcctacggacgcggagaacacgctgcaggtgtcgcacgcgttc

SEQ ID NO: 5381 - DNA, 304 bp, Zea mays
  Clone ID: LIB3279-049-P1-K1-B12
cggacgcgtgggctaacagagcactgaagcagagcgagcgagctgtccggccaaaccctcacggccgcctcacaatgccgcgccatctcgcgctgctcctgcccctgctactgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtaccacgcgtccaagagctccctgagcgtggcctgcgtggcctctcctatgacaagggcctgatggtt

SEQ ID NO: 5382 - DNA, 370 bp, Zea mays
  Clone ID: LIB3279-049-P1-K1-B2
aaccgcccccgcaccacggccagaaccctagtcacttctccgccgcccactccgtggaggacgacgccatctcgacgccatggacatcgacgactcgccgctcagcgctgcgggggccgggttcctcgacgaggaggacggggaaggcgagatgttcttcgccccgcaccgcgcggcccgcggcggcgctggcgatgcccgcgggcccctccccttttccgggttcttcaacagcttcgacggcgccgattttgacgacgacgacctcgcctgagggaactcccacccggttcggtaacggatgttgttcgtggatcgggaatcgtgttatgtcaataccgtgatggggtcttttaattagcgcatcgat

SEQ ID NO: 5383 - DNA, 340 bp, Zea mays
  Clone ID: LIB3279-049-P1-K1-B3
ttttgtcgatgtcctcaaggagggaggcgtcctccctggcatcaagggcgacaagggcaccattgaggttgttggcacgacaaggagaccaccacccagggccacgatgacctcggcaagcgctgcgctaagtactacgaggccggtgcccgctttgccaagtggcgtgctgttctcaagattggccccaacgagccgtcacagcttgccattgacctgaatgctcagggtctggctcgctacgccatcatctgccaggagaacggtctggtgccaattgttgagcctgagatccttgttgatggccctcatgacattgatcgctgcgcttacgtcactg

SEQ ID NO: 5384 - DNA, 378 bp, Zea mays
  unsure (1)..(378): unsure at all n locations; Clone ID: LIB3279-049-P1-K1-B4
gccttggagtgctagattctgtttccattgtccattctcagtcacctgagcagccgaacgttctcagtcacctgcagtcaggaaccaacgatgccgggcatccaccgctacaccgccgagctgctggtgctgctcaccatcattacccgcctcctgctgctggccacggcgtggccggcattgcccgccccagcgtcgctcgagccgtcgctgcttttcccgtccgccggcgccacctcgcccacgcagacccagtcagccggggtcgcctccacaatcccggccttcccggagcagtcagaggccgccgcggctgctgccacctncgtctgccagctcaccccgtcgcctccgctccttcccgctgtcctagcatcg

SEQ ID NO: 5385 - DNA, 371 bp, Zea mays
  Clone ID: LIB3279-049-P1-K1-B5
cgctcaagttctcgcgcccacagccaaatttttctccactcaatcgcggcataagctgcactgcagccatggacgcagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccgccgtgcttgagtacctcgccgccgaggtgctggagctggccgggaacgcggcgaaggacaacaagaagacgcgcatcgtcccgcgacacttgctcctggcgattcgtaacg

SEQ ID NO: 5386 - DNA, 340 bp, Zea mays
  Clone ID: LIB3279-049-P1-K1-B6
caaacaaaatgaaatactatattaagaaaactggtacatgtaagacagccatcccattcatttttgttacatgtagcacttgaatcattctaatcctacctgcctatattccttacatcaagatacattgcagggaaacaatgtgcatcactggtaggaacttcatctctgctccaaccatcagcttattcaacaagctttctggcacataaaatggaggatgataacacaagtccgaataatttagttcatctgagggggctgcatctccagaaccctcgtattcaccgtcgccagccgggacgtccagatagcgctcgcgatcgggctcggtctcagt

SEQ ID NO: 5387 - DNA, 359 bp, Zea mays
  Clone ID: LIB3279-049-P1-K1-B7
gggagaggagaggagaggagaggagaggttgggtctgggacaccatggctccgatgaagctgtacggggcgtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaggctaaccagt

SEQ ID NO: 5388 - DNA, 372 bp, Zea mays
  Clone ID: LIB3279-049-P1-K1-B8
cccacgcgtccgcgacaacgaggcgctctacgacatctgcttccgcacgctcaagctcaccacacccagctcggcgacctcaaccacctcatctccgccaccatgagcggcgtcacctgctgcctccgcttcccggggcagctcaactcggacctccgcaagctggccgtcaacctgatcccgttcccgcgcctgcacttcttcatggtggggttcgcgccgctcacctccaggggctcccagcagtaccgcgccctgacggtgccggagcttacccagcagatgtgggacgccaagaacatgatgtgcgccgcggacccgcgccacggccggtacctgacggcgtccgccatgttccgcggcaagatgagc

SEQ ID NO: 5389 - DNA, 365 bp, Zea mays
  Clone ID: LIB3279-049-P1-K1-B9
ctcctggccgccgccttcgccgccgccccagctgcgcttgcggacggcgacgacgtggtggcccttaccgatccacgttcgagaaggaggtcggaaaggaccgcggcgccctcgtcgagttctacgccccctggtgtggtcactgcaagaagcttgctcctgagtatgaaagacttggtgcaagttttaagaaagctaaatctgtcttgattgctaaggttgattgtgatgagcacaagagtttgtgcagcaagtatggagtttccgggtatccaacaatccaatggttcccgaaaggatccttggagcccaaaaagtatgaaggacaacgcactgcagaagcccttgctgaatttctcaatact

SEQ ID NO: 5390 - DNA, 186 bp, Zea mays
  unsure (1)..(186): unsure at all n locations; Clone ID: LIB3279-049-P1-K1-C1
ttgccgggtccacccgcggatncgttgcgggccgctcccggcctcttcctgctgcctgaggtttaaatggcaacatcttcataagcttcatgaagtgctctgcatgtgtcattagacaccaccctaaaactgcataaatcgggcgctcggcacattgaggatgaaatcaagctgaaagaaatccaa

SEQ ID NO: 5391 - DNA, 371 bp, Zea mays
  Clone ID: LIB3279-049-P1-K1-C10
cggacgcgtgggcgcgttcaattccatagattcatcgatcgaggatatccaattcttaaacagaaattccgggctccaggtcctgctcaacaacgtatgcgaacatacaccaaggtgcacaagcgcggcgctgttggaagatctatcgacatcaacagatattctgggtacgatgaactgaagcatgacgttgctcgtatgtttggaattgaggggcagctcagcgaccaaaacagagttggctggaaactggtttacgaagatcacgagaaggatgtcctattagttggtgatgacccatgggaggacttcgtgaactgcgtgcggtgcatcaggattctttcgccgcaggaagagaggcaaatgaggct

SEQ ID NO: 5392 - DNA, 369 bp, Zea mays
  unsure (1)..(369): unsure at all n locations; Clone ID: LIB3279-049-P1-K1-C11
caagcaagcagcgagtacatacatactaggcagccaggcagccatggcgcccaccgtgatgatggcctcgcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctncccgtgctactacgac

SEQ ID NO: 5393 - DNA, 284 bp, Zea mays
  Clone ID: LIB3279-049-P1-K1-C12
gcccaggggcaccccatgctcgtggagctgaagaatggtgagacatacaacgggcatctggtcaattgcacacgtggatgaacatccatcttagggaggttatttgcacctcaaaggacggtgacaagttttggaggatgccagagtgttacattcgcgggaacaccattaagtatcttcgagttcctgatgaggtgattgacaaggttcaggaggaaacttctaaaagccgatcagataggaagccaccaggtgttggccgtggaagaggaaagggggacgtc

SEQ ID NO: 5394 - DNA, 380 bp, Zea mays
  Clone ID: LIB3279-049-P1-K1-C2
cggacgcgtgggtgaccgatctcgcctaggggttccggtgatccgcgcgcgccgtcctcgagatgtctgacgtcaccttgactcggcgcagagccgccgctcgccgcccccgccgtcgccgtcgccgtcgatgccgcgcttccagcagcagccgagcggacgccagccgccccagcccggcgccgactccttcgtcttcggcgtcttcgccttcatcgccatctgcttcgtcttgatttcactctcagtcccatcaagtgttctacatcaagttcctgaaggacatgttggggtatactggagaggaggtgctcttctgaagacaatcacccctccagggtttcatctgaagctccctttaatcacacagtatgagccaa

SEQ ID NO: 5395 - DNA, 308 bp, Zea mays
  Clone ID: LIB3279-049-P1-K1-C3
gccggctgcacccggcgtaccgcctgctgcacccgcacttccgctacaccatggagatcaacgcgctggccagggagggctcatcaacgccgacggcatcatcgaggagtccttctggccgggcaagtacgccgtcgagctcagctccgtggcgtacggcgcgacgtggcagttcgacacggaggcgctgcccaacgacctcgtcaagcgcgggctggccatgcgcggggaggacggggagcttgtactcaccatcaaggactacccctacgcccacgacgggctcctggtctgggactccatcaggc

SEQ ID NO: 5396 - DNA, 377 bp, Zea mays
  Clone ID: LIB3279-049-P1-K1-C4
gtgccgcgcacgctgccgcccgagagcagggagccgcgcctcgccacactccgccgctgcctcgacatcggcaccgcgcgctccgggagggccgcaccgcgctcgacgttgtcgagctcgtcgtgagggagctggaggactgcccgcacttcaacgccggccggggctccgtgctcacctccgccggcaccgtcgagatggaggcctgcgtcatggagggagccaccctgcactgcggcgcggtctccggactctccaccgtcgccaacgccgtctccctcgccagactcgtcatggagaagacgccgcacatctacctcgccttcgatggcgccgaggccttcgccagggaacagggggtggagactaaggatcca

SEQ ID NO: 5397 - DNA, 376 bp, Zea mays
  Clone ID: LIB3279-049-P1-K1-C5
atttcttctctctctgctcctccgcctccgcctgatccatccaagacagggatcgccatgtcggactcggaggagcccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttac

SEQ ID NO: 5398 - DNA, 311 bp, Zea mays
  Clone ID: LIB3279-049-P1-K1-C6
ggaggttctataacaaaaagagtgcagttttaacaaagctaactatggctttagaaaacacaaggctacctgaatgcatcaaccaggtaccctgagtattgaaatccaaatagtgaacataaaaagccagcagatggcctcccattgtgctatctgcttttcatcctgatcctgcttagtggcttgttcttactgtcgtggaaagtagaaattcgaatttggagggtgcatatcacaaaatcctaatgtattatatgagctgtataagcccgcaacggcaatcaagcagctgaacagggtgcatcccatgc

SEQ ID NO: 5399 - DNA, 272 bp, Zea mays
  Clone ID: LIB3279-049-P1-K1-C7
gtcaggatgacctgaggcttgaaattgaaagattgaggtttaaattgcaacatcttcataagcttcatgaagtgctctgcatgagtcattagacaccacccaaaaactgcataaatcgggcgctcggcacattgaggatgaaatcaagctgaaagaaatccaactggcagaggacacggtaaggagactagtaagaaaacaggagatggaagaacgcgaagcagcgacagaagctgagttttatcaacgctccgatgaaatggaagcaaaac

SEQ ID NO: 5400 - DNA, 372 bp, Zea mays
  Clone ID: LIB3279-049-P1-K1-C8
gtcacgctgacctgaggcttctaatacaaagattgaggtgtaacttgcaacatatttataagctcgatgaagtgctctggatgaactattagacaccacccaaaaactgcataaatagggcgctcggcacattgaggatgaaatcaagctgaaagaaattcaactggcataggacacggagcggagactagtaagaaaacaggagatggaagaacgcgaagcagcgacagaagctgagttttatcaacgctccgatgaaatggaagcaaaacagagttatgatggtgcgcaagaagctggtgagaacgaaatgggaaagaagattgctgatcgcggttttggcgagtataataggtacacgtgggaggagat

SEQ ID NO: 5401 - DNA, 242 bp, Zea mays
  Clone ID: LIB3279-049-P1-K1-C9
cccacgcgtccgcgaagccaacccgcccaaaatgtacagaattacagacatattcggcttcaaacgatcgagccgctgtacagctcactcaagggaggtccgggcaggatcaccatggactgacagccggcaatagcatgccttgtttttcatgtatgtagtgtaatggccagtgcatacgaatgatgaattcgattctgaatcctgctcctgcatcagattcggttgcatgattgatctat

SEQ ID NO: 5402 - DNA, 349 bp, Zea mays
  Clone ID: LIB3279-049-P1-K1-D1
ggtcaattcagttgtcaatgggctaaatgctgatgagctttacaagagaagccggcatgagattacatcatccaggaggaggatacaattttttttgggatgtgttgtttatttgttctctatgtaacattttctttggttagttctttgtttgtttagattgctgacagaggttcatatccgtacacatcatgcggactacccagaattcagtcaggaaacagaagcccttatgttttgcttagcatcggtgcgtccctttgaagctggagctaacattctacaaatgagtgctctatcaagtgcacttggcattccattgcacctgtcttgtacggatgtaaccacg

SEQ ID NO: 5403 - DNA, 370 bp, Zea mays
  Clone ID: LIB3279-049-P1-K1-D10
tctgaatatgcctacttatgagtcggtcagtggcaagttccgctcaaaatgaggagtacatgacccttccttcattttatcaccttgtttgctggacaagttttaccagtaccttgtcattcacgtctaggccatggttcttggtcagtttcagaagaaataagcaacctcatgcagttttgttcgtgaaacctgtgatcacttcacaattattcccttttctcattcttttgcggaacattcgtgtggttaatgctggtgatagaccagtaacgtgcttgtaaatttaaccgaaccctggcccctcattcggtaccaaggccccaagagaatgtacaaaattgtcgtaaaactcttgacaaaaatgttg

SEQ ID NO: 5404 - DNA, 290 bp, Zea mays
  Clone ID: LIB3279-049-P1-K1-D11
gttggcttctcctccccctccggttcgggttcgggttcgtgaggttctccggggttcggtttcgtgggtagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggctttcgcttcgtcaccttctccacggaggaggcgatgcggaacgccatcgagggcatgaac

SEQ ID NO: 5405 - DNA, 369 bp, Zea mays
  Clone ID: LIB3279-049-P1-K1-D12
ccacgcgtccgctttcagggatactgtctcttcaaaactcagtgaggaaggcaagcttaagaaacttgggatcttatgaacgagagccattacagctgcagcgtgctatacgaatgcagttgccctgagctggaggagcttgtgaaggtctgcagagacaacggagcactgggagcacgtctgacaggagctgggtggggtggctgcgcggttgctctggtcaaggagcccatcgtccctcagttcattctgaaactaaaggaaatgtactacaaatcaaggattgacaggggagtaatcaagcagggcgatgtgggcctgtacgtgttcgcatccaagccgtcgagcggcgcggccatactgaggttg

SEQ ID NO: 5406 - DNA, 291 bp, Zea mays
  Clone ID: LIB3279-049-P1-K1-D2
gaaaaggtgatttccttgattgttagtatctacctgtattttccctccttttgggagtgcaggttataatactatttgcttccctctattgccaacctcactacaaaatttcctctttttgtttttttggtacaaagcactttttaattgattcatgtgccagaaaaatgttttttatctacaggactatggtgcctatgagaaaaagcaggccttgtcgaatattcatcagcaggaatccagtcttcagtcaagctttaccgaagtcatagataacacttgtgcatcaat

SEQ ID NO: 5407 - DNA, 228 bp, Zea mays
  Clone ID: LIB3279-049-P1-K1-D3
cggacgcgtgggcggacgcgtgggcttaagcagcagggcgccgccgccgccaggcgaccagcctacagccagcacggggtgcggccctcggtcggcatgggcgcgcggaggccatgacggctcgaacgcggtagccacggccccgacgtctcccgacccggcgcgtcaccccgtggtgcggagggccctgtcctgaactgggtgggaggcgcgactctcgtcgacgcg

SEQ ID NO: 5408 - DNA, 329 bp, Zea mays
  Clone ID: LIB3279-049-P1-K1-D4
ataactctcgatcgactcacacaattccccaacaaagtctactccgcgccaagtggataagattgcggaagctccgtatgtaccatcaaaggagaggcggggaacaaccaggaagagatcaatttaaatgcaacaacttgaaggttgacaagcatctggagaattaccttggccatatggctatggacccgcctgctgtacgcaacataagaaaatatctgtactgctttactgccgattagaaatactgcacgcaatattctcacagggaagaaatcaggttagtgatggaattggacgaacatgttatgcgtgtagctctcgcctta

SEQ ID NO: 5409 - DNA, 369 bp, Zea mays
  Clone ID: LIB3279-049-P1-K1-D5
cacaaatccaacaaaatctaatatgtactcgcacaaaaacaattagccatatatattttttaatttaggtcatcaacactatgcactaaggaacactatgcaagcactgacggggctgggcgggaggaacctagcgaggcgccacccatcgtgtttcctctgaggctctacgatcgtcgttgtcttgttgcatgcactgaggctgaacgtgctgctgctgctcctctgcctgtgcgcgttccccgccccggcgcggtcgcagaacacgacaatggccacggccgcgccgcgcgttcgtcgaggggttcaactgcaccgccaaccgcacgtacccatgccaggcgtacgtgctctaccgcgccggcttcg

SEQ ID NO: 5410 - DNA, 378 bp, Zea mays
  Clone ID: LIB3279-049-P1-K1-D6
cccacgcgtccgcccacgcgtccggcgccacccacccacccactcgcttcagccgcctccgccgcgcgtaccaagcggtggagacaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgca

SEQ ID NO: 5411 - DNA, 370 bp, Zea mays
  Clone ID: LIB3279-049-P1-K1-D7
gcggaaaacttctgcggaaagtctgaaggatgtgaagcaggaggattgtctggagccagacgggagagcacgatgcagagggtaggcttccaatcatccatcatctggctggttctttcggtggctgtgctgctgcttctctattgtggcgtatggatgagtatgatatgtatcctggtgcggtgttttgcgcacatgggttcctggcatcaacctgatgtgtgaacttctgtcataacatgcgtttgacagcagtaagacatcccgacatatgccaatgcagctaaaaataaaaaaaagaggtagcaagtgaagagggagaaaaaagagatgtgttattgtaggtcttagtacatcctagtcttgccaa

SEQ ID NO: 5412 - DNA, 369 bp, Zea mays
  Clone ID: LIB3279-049-P1-K1-D8
gcggaaaacttctgcggaaagtctgaaggatgtgaagcaggaggattgtctggagccagacgggagagcaccatgcagagggtaggcttccaatcatccatcatctggctggttctttcggcggctgtgctgctgcttctctattgtggcgtatggatgagtatgatatgtatcctggtgcggtgttttgcgcacatgggttcctggcatcaacctgatgtgtgaacttctgtcataacatgcgtttgacagcattaagacatcccgacatatgccaatgcagctaaaaataaaaaaaagaggtagcaagtgaagagggagaaaaaagagatgtgttattgtaggtcttagtacatcctagtcttgcca

SEQ ID NO: 5413 - DNA, 270 bp, Zea mays
  Clone ID: LIB3279-049-P1-K1-D9
ggggggaggagctagaaacactacgctgcgaggaaatgatcgccaccacaaacaccatcgccacaagagctggatgttccatgatgcacctagtactcgaccccaacatgcaagaacgcctttaccactaggtgaggagcaaggtcggcaagaccgaccgagtcactgaagacctcgtggaggtcatgccctaccttctagcggtggtgaaggagacgttaccacgagaccggccgggccactttgtgctgtcaaacgcggtgacgcgag

(The sequence listing continues in the following parts.)

We claim:

1. A transformed plant comprising a nucleic acid molecule which comprises:

(a) an exogenous promoter region which functions in a plant cell to cause the production of an mRNA molecule, which is linked to (b) a structural nucleic acid molecule, wherein said structural nucleic acid molecule comprises a nucleic acid sequence, wherein said nucleic acid sequence shares between 100% and 90% sequence identity with a nucleic acid sequence selected from the group consisting of SEQ ID NO: 5427 and complements thereof, which is operably linked to (c) a 3' non-translated sequence that functions in said plant cell to cause the termination of transcription and the addition of polyadenylated ribonucleotides to said 3' end of said mRNA molecule.

2. The transformed plant according to claim 1, wherein said nucleic acid sequence is the complement of a nucleic acid sequence selected from the group consisting of SEQ ID NO: 5427.

3. The transformed plant according to claim 1, wherein said nucleic acid sequence is in the antisense orientation of a nucleic acid sequence selected from the group consisting of SEQ ID NO: 5427.

4. The transformed plant according to claim 1, wherein said nucleic acid sequence shares between 100% and 95% sequence identity with a nucleic acid sequence selected from the group consisting of SEQ ID NO: 5427 and complements thereof.

5. The transformed plant according to claim 4, wherein said nucleic acid sequence shares between 100% and 98% sequence identity with a nucleic acid sequence selected from the group consisting of SEQ ID NO: 5427 and complements thereof.

6. The transformed plant according to claim 5, wherein said nucleic acid sequence shares between 100% and 99% sequence identity with a nucleic acid sequence selected from the group consisting of SEQ ID NO: 5427 and complements thereof.

7. The transformed plant according to claim 6, wherein said nucleic acid sequence shares 100% sequence identity with a nucleic acid sequence selected from the group consisting of SEQ ID NO: 5427 and complements thereof.

8. A transformed seed comprising a transformed plant cell comprising a nucleic acid molecule which comprises:

(a) an exogenous promoter region which functions in said plant cell to cause the production of an mRNA molecule, which is linked to (b) a structural nucleic acid molecule, wherein said structural nucleic acid molecule comprises a nucleic acid sequence, wherein said nucleic acid sequence shares between 100% and 90% sequence identity with a nucleic acid sequence selected from the group consisting of SEQ ID NO: 5427 and complements thereof, which is linked to (c) a 3' non-translated sequence that functions in said plant cell to cause the termination of transcription and the addition of polyadenylated ribonucleotides to said 3' end of said mRNA molecule.

9. The transformed seed according to claim 8, wherein said nucleic acid sequence is the complement of a nucleic acid sequence selected from the group consisting of SEQ ID NO: 5427.

10. The transformed seed according to claim 8, wherein said exogenous promoter region functions in a seed cell.

11. The transformed seed according to claim 8, wherein said nucleic acid sequence shares between 100% and 95% sequence identity with a nucleic acid sequence selected from the group consisting of SEQ ID NO: 5427 and complements thereof.

12. The transformed seed according to claim 11, wherein said nucleic acid sequence shares between 100% and 98% sequence identity with a nucleic acid sequence selected from the group consisting of SEQ ID NO: 5427 and complements thereof.

13. The transformed seed according to claim 12, wherein said nucleic acid sequence shares between 100% and 99% sequence identity with a nucleic acid sequence selected from the group consisting of SEQ ID NO: 5427 and complements thereof.

14. The transformed seed according to claim 13, wherein said nucleic acid sequence shares 100% sequence identity with a nucleic acid sequence selected from the group consisting of SEQ ID NO: 5427 and complements thereof.

15. A method of growing a transgenic plant comprising (a) planting a transformed seed comprising a nucleic acid sequence, wherein said nucleic acid sequence shares between 100% and 90% sequence identity with a nucleic acid sequence selected from the group consisting of SEQ ID NO: 5427 and complements thereof, and (b) growing a plant from said seed.

16. A substantially purified nucleic acid molecule, wherein said nucleic acid molecule comprises a nucleic acid sequence, wherein said nucleic acid sequence shares between 100% and 90% sequence identity with a nucleic acid sequence selected from the group consisting of SEQ ID NO: 5427 and complements thereof.

17. The substantially purified nucleic acid molecule of claim 16, wherein said nucleic acid molecule encodes a maize protein or fragment thereof.

* * * * *